United States Patent 8,216,786 (GENETIC POLYMORPHISMS ASSOCIATED WITH CARDIOVASCULAR DISEASES, METHODS OF DETECTION AND USES THEREOF) - sequence listing, part 5

SEQ ID NO: 1138 - DNA, 1456517 bp, Homo sapiens
cgaactcctgacctcaggtgatctttctgcctcggcctcccaaagtgctgggattataggtatgagccaccgtgcctggcccagtctcaagtaattgatcccaggctgtttctcagcatggatgatggttctacatgtgcctattttaaaactgagtaaaccatccaaatgtttttgtgtactttttggcatagatgttattttgtcacaatgaaagtactaaaattggagtccctggatagatgtgtgtgaatctgggtatctgtgtgctcgtgagtctctgtgtgttcacgtgtgagtatatatacatatattctcagcctttgtcttgtagtgccgcatttgctcactttggcttgctttgggccatgcctagggccatctcagagttggaaatccagatcaagaagcaagaatccaggcatgcctgcagaacacagagatagttgaaggtatgtccctgaatcttatgacccctgctaatttttaacatttggaaagggtagtttacatgggtctctgttctgaagcattctttctatgaatttctctttttattccatgtccattatggttgaagcagttgcagctcatttgtattatcttgttaagcgctggaaaaataaattggctcatgtctttcctggtacctggatttcaagaagtcaaatcttttctgtctttgcttccagtagcaaggcactctttgcatcctaacacttttgtgaatgcatttatgatgcataggacagttcctttgcctaatggttcagcagtctccctttgctgtggcttttgccttaaggcaagcatttaaagatattaagagagcgttctgctttcattagcatgttttattctttattcctaagagtcgttttaatcatattaatttggaaggacccacctgaaattgcacaacctcttgtctccctctctctgaggtcccctccagctacatggtctaggagtccctaccatcttacccacttctgatgttcttccgttgtcttgacccctgtcccacccctttgcccaagccatgggctcctcccacttggtggctttgtccttgtactccctctgtacccttcctctcgctgtgcgctggaaagggtctaagattgggatttagaagctgagtgctatgcttcttagtagctgcgtgactttgggcaaataatcttaaagaccacaacttcttcgtctctgcaaagatatagtccccattcccattttatatagtgtgagaatcaaatggaaatatgcataatatcactgtgaaaacaatcattatatatatccagagtaataatcctgccattctaatgctaggttaactctactgttcatgtccttggctcctggccctggaacgaggctagatgtcttactgttagggaacaaatcctgtatacacatgggctgtgtcaggtgaagagatggcccaggaagtcctaggcagagcatgctctgtttcagaaatgcctgcagagaaacagggaggcttgaatcactcctgctctcagaagtgttttggaaggagtattcttttatttaacaactccttgttgagcacttactccataccagactttgtattaagacggacctgggttagaattctagatctgcccaagggtacacagtaagactggttaagcctggaaccaagaaccaagggtatacagtaagactgattaagcctggaacccaggacgatgggggatgccccatccagaataataggaagaaaggggggatgccttcttttttcttttttttcccgtcctttgttctcttcatgagtggcagatgggtaatcgcatctccataccacaggacatgccccttggatgcattctccaaaactgggaaaagtttaatttcctcaaatcttaaacttcttggcttaaaaataaactggaaagaaattacaagactcagcttcgaaacccagtacaccatgcaggaagtcctcagattagcctcttaagtcttttataatggagagtagaaaaaggatgacagggctaagcctgttgggtggggcaaatggcatcccctccctccaaaagaaaatattaaacttcttaccagtcagacttctggcttctctctctgtgcaaactggttgtagaaatggtaaaaatcactgtattccctgcccctccatgcacaacttctgatttctctctcttttttttttttttgtgacggagtcttgctctgttgcccaggctggagtgcagtggcgcgatctcggctcactgcaagctccgcctccctggttcatgccattctcctgcctcagcctcctgagtagctgggactacaggagcccgccaccccacctggctaatttttttgtattttttaatagatatggggtttcaccatgttagccaggatggtcttgatctcctgacctcgtgatccgcccgccttggcctctcaaagtgctgggattacaagcatgagccaccgcgcccagcctgatttctcttcttgaattttcctttctcagagctacttttgtggactctaaattttgtaaaaattgcttatcacttttctaaaaataccttgtacactcatggttaagtcataactttagttaaaacttattgacttcacctttgaggttgcctttggcaaagctcaaaagacacaagtatttgccatttggccaggctaaagtcaggtataagagattaaaagaattttggccgggcacggtggctcatgcctgtaatcccagcactttgggaggccgagacgggcggatcacgaggtcaggagatcgagaccatcctggctaacacagtgaaaccccgtctctactaaaaatacaaaaaaattagctgggcatggtggcgggtgcctgtagtcccagctactcaggaggctgaggcagaagaagggcgtgaacccaggaggcgcagcttgcagtgagccgagatcgcaccactgcactccagcctgggtgacagagcgagactgtctccaaaaaaaaaaaaaaaaaaaaagagattaaaaggattttaagagcattatgatcaaaagtcaacttaattaaaagcggatatccaagctatacctatatagagctgaaatgttcatgaatatcaagcagaacagagcttaactgaatggattgaactaataggagagtgaggtaatctttttttttgactttttgctcatctttattttatttttcagagtcaaggaaactttttagctatttacagcttttaacaattgagtatagtatacacccgtgaacaaaatttggagcatatttctctctacctgatttctctagaatttggaaaatttgtgagtattcttatggcaatatagttatttgcataagtggaataagaatgttttcttttgcaatagaatgcaattggagaaatttgttgttttaccaaggctttgactgaaatggtatgctttaagaaatcaagctcgacttatagagccaataaaagccccttgggaaaattggcctcattccttgtctgcacagtccctgtacagggttcttaacctgtggtgagtaaagactgtcactttctaacaggcccaagagccccaagttaccttggtaccttaagagaagaggaatttacccaattcataggtatttgagggtacaaacccatggctggtacatgtctttaaaaagtattatctaagagtccttgtggaacacagttccatcaaagccaattttaaaagcctatgtgaaaaataattattcttgctgcactttatgcaaataatcaggccaagtgtaataagactaaagttaattgtgcaaaaaaaatcagtcctatcatgatttgttaacaaaaataaggactggagaaattatgtttcaaaagttatggcacacctgtcattaaattcaagtctcataagttgtttttaagtttttgtctggattttagatcaaccctgcttattcctgtaaaccaaccagtgatctctggctgcagctcagaagaaacaaaagggatgggtaatgtaaaaatctggatcaatgttctaattctgggcaattatcctccaaatcctgtcaggtgatgggggtaaccctggaggtttcttttttggggaaataagaccaagggagctaaccaaagccaaaccccatgcacccaagtcttagcaggcataactgtagccaccagctgcctggatgtgtcagcagcctcacaagttttggagctgtcctcatccccttgttttgctttggtccatgtcttctaatctaataacccgatttgtctccacttgccttcaggccattaagttccagatgatcctcagtgagggataccgtcctttcaatatttaataatctcacccttctacacagaccctctagactgccagtcagtgggacacgacagaggcaaaatgctgtccctgtcacccttgacctggctggatactgctttcaccaactcatggagccaacccagccctgcaggcaagaaaccaagacccacagaaccaccactgcccctctgttagcaggaagcagttgcagaaggcagaccttcgtccattttaccccaaagatttggggtcgtggactcttgagggggaaaatgttatagtcggcagctagttaggtaggcagggcagaaaagggctcttccctcaccacacacacaccaggagtgttgggagaccctcagggcatggtcaggtggttgttaactatttctctaaagtaataattggtcacagccggtgccagggaaagacaggctcctaatagaaaacacctgaaactaatcagcagcttcccaataagatctcaggagtggggagaaatgcaagatcccagaagtaggccaacggataaaactcccagtcaagaggtaagctgcgcccttggcttctcaggtcacctgcttggccctcttccaagttgtattttccttcttttcttcccttactcttctaaagctttttagtaaactttcactcctgctctgaaaagaaaaaattctagatctgccacttagcttcagaaaggccctgtctttcttttcttgttctcttgttcgtgtttctctcattcaagatttccaggaaaatgttttaattcttttcaaatcttcagtgtcacctctacattttacagatttgagcagacttccagtagctgaaaacacagaaggcataggatatggactcccttgactctttagtgtttttccaaatctctgaaagacacacagccttctcgaagtggatgagtgttcttctgccaagtctcatctccacgcgccctctgccccgccccagggtacttcttattccttcccaacctccatttcctccaggccttctgaccacctccctccctgcctgctgcccacagtcactttccctcctttcccccagctccctccccttgggctgaaagcaggcaagtcacctccagactaagaaacaaccagccaaccatgagcagcaattttcctgtttctcctttgaatcgacaacatttctgtcaacaagacctctgcctgctcactcctcattcactcggcgacttaaatgtactattctactaaaaggtctcttgaacctccaaaaataaaaataagtgattcagtcgtacccctgcttctgagtgacatcattgcacatgtggtcactgatgttactccttgtttgttgaaatcctctcttccctaggggttcatggccctgcactgtccagtctctccactccttccaaccactccttccctgacccatctccccagtgtggctcctgtcccttttccttttgccaattctttaccttgaagatcataatcaacttttactcctagggtagtggttctcatccttggctgcccaacctttgtctcctggaggagctttaaaaaaaatcctgatgtccaggtcccatcccaaccaattacatcagaatgtctaggaatgggtcctggtggggtctggggagttcactcttaaatctttagacttagtttctcactgaacctaattttctgaaacaccttcatttttaggctgtgattattggctggatgaatatttccatctgggcaatctaagagccccgtgatgtcccttgtagatctgatcctcttcctattttctcctttcacttgggctggaaggctgtgattgtccttaactctcggcatccagtaagtctgaggtctgcttgtttcccctccttgaaagccctcaaaactctcccctccattccaggtgggcaggtcttcttatctctcacctggactgatatgaagcacctgccagagtttctccacttgctcttcctcctagacaaggctgccaggactaacttcagagccaagggctgattttgtcttttctctgctccgaaatctttcctgactctccactgttcactaatggctttgtggcctgctttcatccccgccctccacccactctctcttgtatactctcagccaaaaaccaataacttcccactcccctgatattcctccaacatttctcttaactttgctcaagctgttctctcccttatactcgctctgcctcttgaaatccttcccatccttcaaaatccaagtaaaatgccccttatccagaacaacttttagcatttctgcatcctacaaaatcctgcattcctactgtcacacagaccacattctgtcctgggttaattgtcatggtcttttaactagattataggcaacttgagaatagggcctgtgcgctgttcaccattaatgcttttacatagcagctatttgaaaatttttactatactaaattaaggaggtttgcctatgtgagtgctctttttagctcacatagcccctaaaataactttctaaaccattagatccaattttttaaactgacatctgcattttttaaatcataaatttaaatattacaaagaatgtatttcctcttgtatgcatgcatgccttaaatatattttcatttaaacctgaaatcaagtaattatagatttgatgcctttaatctcaaactcctgcactcaaacgatcctcctgcctctgcctcccaaagtgctgggatttcagctgtgagccaccatgcccggccatgatgcctttaatctatggaaaatatgtgctatataatctcattggcagagctagtctaagtggtcaaggcagacaaatagccaatcacacgttcaatcagaaatctgactttatttgaaaactcatatacatgtaggtgccaattctgagatcaccaggaactctgcctgggctcctccatcaaagaaggtgttgcccacttaactatttcttactgctgagggctgcattcaccaattgtctctttaattccctagaagtttttacaccataatgcaccagtgtcaaatgcaggacaggtgatagatggagcttttccttgccatgtaaagggcccttgtatagagcaggtggacatgcacacagcctgctagggttttagaaaatgtacctcccacttaggaggtcaaaggtcgctttattgtttcacagaataccaggttcttccaggtgagatcactctccaagaggcagtttcatcaggagaaaagattcgtcaaactcctagagctcttaagataaggctctcatttgtggtggccggttaccctccccaggggtggtgggacagacttaagctttttttttttttggaggcagagtcttgctctgtcacccaggctggagtgcagtggcgcgatctcagctcactgcaagctctgcctcccgggtttacgccattctcctgcctcagcctccccagtagctgggactacaggcacctgccaccacacccggctaatttttttgtatttttagtaaagatggcgtttcaccatggtctcgatctcctgacctcctgatccgcccgcctcggcctcccaaagtgctgggattacaggtgtgagccactgtgcccggcccagatttaagcttttatgaagtccctgatcattgagttgcctgggtgatctgctaccaaatgcccagcaagggtttggtttaattctagggtgttgctccattgtttatacccaaatgttcacaatcacagctgttattaccaccaataatcataatctctacacatataactggggccctgtatacactagacatgatgcagaacttactaaacacaggactcttaactatgttaagacttggaaactatattcttgtgattttacaggcatcctgtctggcactatagttgtctgaaacagaaatgtctgttaaatccaaattctttcagcaaagaggtcatttgattttgccatgactttggcctgaaatacagcagtatcaggggagcaggggcaggttacttaggggagccccaagtttacataattttgggggaaacattaaaaagagaatataaactttcaagtaagattcagggcccatgcaagcgtcagtttctatagatttacagcagatccacgtctactgcagaaatacaatcaggtttctggtggcgtgtctcatgcttggaatacacatttgaggcgattcctggcatgtgtgtaccccagtagccacagggtttaccacctctgggggctgtgcctccactgcttggaaggtgacccaggccctgatgaaaacaatgggttctcctgccaaatgcctggctgtagttccaaactgatgggctgtgggccagatgtggctgcatctggtttgttgtggtactgttttttttttttttccttgcgtagcctttcttataaatgtgaatgaaacttgtcaaactttaaaaaccaaaaaatttcaaataaagacctgattttttttttcttccttctcttgagaagttggaatactgttccgtactggacttgacaaacaaggagctttagaggaaggcacactcaccctttggccagtccccatctgagtccctcctctgttcagagtttcctgcctataccttggagacatgaattcatgataaggccctgttcaagccagcaggggccttgctggcttccccctagttcctgccttatccctatcctagtcctttgatctctggcttcctatcttttggtgtcttagtaatttgtatttcttattttaaaataagtagtgcaggatgaatatttatattccatttaaacaacatttttatataggtctttttcagcttgcactggcccattctcagattacttcataaagaactacatgtgttacaaatttcataatttttgtgttccattttatacatcacctctttccttttataaaaatgatgcacgatattaaaaattttgtattggaatgaaagatggacagtttgggaactttaggcctcctactgacaggtggagaggaggatcttgattagcgttgaactgttccttccgatcgtcaactcctcgatggcagggttgtaatcacccaagggccaagcagaactctcccttcctaccacaggcatcgcaatacatgacaaaagctatattcaaccattcattttggaccagttcactgctgcttgctatgttggcttctgcatgaactccttgggattttgcatgagaaaatttcagaattaaaaggaaaaaatgtgatggaatttattacagatggatactttaaatcctttttgaaaaaaggtaaagtatcgatcaatgtagcaagcaacagaaatatacagccaattcatgaatgatgtagtaacctgacaagcaaatatcaacaagactgagaaaactgtttacttaggccaaaaaagccaatgatctttcccatgtaatgccactgcttttagattcaagtttcaaaaaagtcctatttggggcattaaaacttatacttccaaaaataaaaaaagtcgatgaaaactgcagttttgaaaaactaagttaacccccagtaataatctatttcaaattaacacacagcctatatagttggaaaaagaaaagatttttggatatatattttatttgacagtgttttagaatatcatacagtaaacaagatttctgtaaaagttaatttatccatagtggtacgtttcataaaaatagttgctcacttacagtctttctgtgactattaatacatggaattatatttatagagatacagctgtacagggtaaattcacagctaacactacacaaatattatttggaatgggatttagatgatgtgctgtcttcacaggttatggattacagccgcataaagcaattactgcacaagtagtagctgtgaactgtgcaaactagagtttatgccagtgtaatctcaatttttttttccttttgtaatacatggaaaataaagtcagaggatacagtaccaggacgtgcagctacactacagaagcattgtccaaaaccagattcaataaattaatggcaaactatactggatttctagtccaggggagaaagactaattgagattaaaccaaaagcattataaactgctacaagtgtttgtgcttttgtttacgatgaatgggtttcatttttggaaattgcttttacaagctgcaagatccttcacttgaggctttcagccttattctcctcctgtcaaacaactaaactactccgatgtttgatgaaaattaaactgctactcaggatactgcaattacaaggagagggaatgatcagcccagggaggctattacgtgtgacctttgagatggacctgatcgccccttttactttttagactacaagtgcagggaggtggagcttatttgcatttgaactcctgtaaagagtaagaatatggaaaggatgaagcctcattcattcgggcatattaaaaagaaattgccttcagaaacactttgccttttaatatgtgtagctacagtaagtaccaatggctaattaattgaagctaacattttacaaagaaatgctaaaacagcagggaagaaaggcaagacttagaattttactaggaggtcaatcatagatccatgaagataaacatctagaagttgctaacaaaataaagtggcaaggaatacaagacgaaagaaaactaatggaaacaaaaggacaaagggtaaggaaagaaggataagcagaaaggaatgctaaaaagactcacgttctttaatgaaaataaattgattgtaattttttaatattataatctgagaaatataagacaaatactctgcctctgctctgtcaaagtgcaaatgaagtcatggagacagggtttaaaataagacaataaaataagtgaaatcacattgctgacaaagaagctatccatctctgctagcctgggacgacagaaaagcctcttcataaaggaactgcagcgttgcctatcttgattaaacaaattgtggtccttcaattataaaattcatattttagagaaaaaccaattaagatctatgagctaaactgcaaaattctgacttatggcaaactgttccctaggatacaatttttaaaaccttttttttctaccactgaaaatgtacagaaatatgatttgatcacagaaagggcaataaaaatggcatcacaccaagaaactcactagatttctaagtcatcctgcaggaggcagggaacgctgctgctaacaccgaggatggatgccaagggtgagccatggaaacatgtcatgggtgaacggttccgaatgtgtcaaagaaaccctttaacccctgtctagatatgtcgagaacaatttatttacaacgctttagatcaattaaaagatataatcttgtctcagtttcagcttgctccgtgcagtttgatttttaaggcgatattccagtttgtgattgctcttaactttgtcctgtttcttgatataaagtttggatgacatccaagtccttcatgcagtggggaggaatatttttttttcttaaactaaagctacactgcactgtctctctgtgatgttcttcacgttattttggttcttccatagctgccaaagcccccacaagggaaccgggggctttaggatcagtttaggtctgcgcgttgatgcgatgccgcccaagcacaccggacacgtgggacttcacgtcgatgctcccaggccttggtgcctcgtggatctatgcgtgtgacagtgaaaataaattaaaacgccgtgagacggaacctaagaagaactgcctgcgccggggcgggcgggttggccgtggccgcgcggctcatctgctggcggccgaggcgccgggtttgaggacgctgggcagcttgtcagaacccggcaccttccagggccccggcgcgacggcggccttgcgcgccggggcgccccccgggggtcgcgggcccggccggggacccgcgcgcgcacccgccctgccctcggcctccagcgcgccgctgccgccgccgcccgggccggcaaacgccggcgcagcccccgggccttcgcgccggcagagctcggagcccgccgccgcacggggcgcctccttcccgcccgcccgcgccgcgtccgccgcgtctgccgccgcgagcccgggcgccctggcctccgaggcgggcctgccggcctcgggccgcccctggccgccgggcgcctcctcgagcctcggccgcgcggccctctgcggactcgccgagcgctccctctgctccccgaggcgctgcttcttctggccgcaggctgaaagctcctttggtttcctaacgtcgtgttcccgtttgatatcccaagttgggcctgggcttatctggtgggaagggtcggagggtggggctggatgtgatggagagaatggagcgaggccgtcgtccagggagacgcctacttccggcagacctggggcggcggcagcgggagaactccagggggcgggttcgtctgtggacgggaagcacaggcgttagcagtggcgcacgcaggacgtccccgtgccctctctacgccggggacaggggcaggcagctggggcgattgctctcaggggccggagccaccgccgcccccacccccacccccaccctcactgccgagagggcagcggccgcgcccccggggatttgggggttccctccgccccgcttagcccccacgccccgaacctcgtccgtggaccggggaggccaacgcgaagcccaggcctaatcccttcgccttggccctgctaacttccgggggtgttctcgggcctgatagtcctgtatagacagctcacttgacagcccttgaataaatgggtctccaactcgagtagaccttggaatcaccagggtggtggtgaaaaatacagattccccgggaggagcaggcccggaggtttcagcagcacggggcccaggaagtcctctgtatttttatcaggcacccattctgaaaaaggtggcctagcaggggtgtccaatcttttggcttctttgggctacattagaattgtcttgggctacacataaaatacactaacgatagctgatgggctcaaaaaaaaaaggtccatgcataaatctcataatcttttaagaaagtttacaaatttgtgttgggtcacattcaaagctggaggcgggttggacaagcttggtttagagccaagctttgagaaacactggtctgggttctctggaagttgggaagtgacgttctcaaccagtaggtgtcactcaaagcatattcctagctgctgtcagtttcagaatttggataaatacattttaaaactatcattttttaaaaaaaatcgtccttaattccattttttttctttgccaagtccggatggaacttaattctttttagtacttctaacattatggagggccccaggactaagataattctttctaggaagtctagttccaacatttacttaggatttaagttacctacttccaaaaaggatttaagacaattgacaacatcaaaacacatataaaacaatgattaaaatgagagatgactttttttttaaagcaacagctggtcagaggccaagtagaaggacagatgtattaggaatctgagatgagttagctgctactgtgagcaacaacagttccctggagcttctggccactaaggggaaatgaaagcagggaaatccaattactgtgaatccttgatatttgtaagaaatatgtctcatgaccttggaaatgctcaaattttgtgatattctagagtgtaatttttcttccacagaattggtatatggtcatgagtggagaacgaagaaaccacattgatagatttgaattctgggtgccaggtgagcctccctcactagctaaaagattcagtcccacacagcaacctcagtgcatgtgattcaagctcttgcctctgtaacgtgtcagaggctgtcagtgatacttgtgcatactcagtccattaatgtccagggtctactttgtttgaaacttgagggttcttatatagtacctttgatactgatttataaagcaataaggagaggaaaagggcagtggcaatggttttcccaataattctggccatctttagaatggcaaatcaaaaacgtttctcattctatgtgaaattcgaatggaacattttgggcataatgttaaccttccttcttccatacactgatgtccattatcattttcacatggtaaaatcctagaagtcctggaatctaatcctggctctggcatgtatttactggtgacgtgattttggaccaacaactaaatctctctgagcctcaatttcttcctttataagatggggataaaatatccaactttacagatgtgagacatacactttctaagggaaagcactttgcaatgggagggtcaatcatatttttcttctgtaccccacctgctgcctacttatggattgggctcctgtggaagccgcctcattaactagtacctttgcaggtgaggttttgaataagtgcaataaggcagtcatttccaggtgctgtgattcccaggtgtcattttgctacacctcaggtatccttggttaccttaaggaatagtctgaaatcctcaaaggcaaatatatccaatgaaaatgagaatgtgttctacttttgggtgggttagagtttaaaatcagactaacaaatgataagtggtggcaatccacccatctagcgagatacagcttagaagagttaaaaagtggtcttcaaaaggcctaactagagggtagcttgtgcaacagtgatctctgacttggaccatggtaatgatatttcacattttaatagctcttttccccatcattacatcacatatggtagagttaattagctggcctcaaattacttcttagataaggggagaaggttgatattactcacaccatttcctgaaggaggaattgaagtagagagaggttaactaacttgaccaagattacaaaatgggccagttaggagtaaaaatttgggtttctttactctttttacttagaaactgtcccaagatgttaccttgcaaataggattaaagtatgtgaaatgggcaagaacagtggccactgccaaccaacaggaaccagatcttatccttaagcagaagacttagcatttatttctgaacatcttactacatatctggcattgaactggagagttcctatccagaaaaatgaaaaaatattcatccatccatcattagttggcttcaaattacttctgagattcagggagacactcttttctttccctcctccagtgatttttcatatcgtaaaaggtgaaattattcacaaattcaaagattcctcttataaaagtttctcaagagtttgtttatagatcattaaacacttaacagcgggagaaactaaaaactaaaatgttccaagtcactatgggttaaaaatattaacaagaaattaagatttactatatcacaaagtgatttaaaagatggatatctatatgagtggttgaatattttcatttttctgcacaggaactcttcagttcagtacgaaacatatggtgtctgtccaggcacgagcctgcaaagctccaggcacgagcctgcaaagctctgtaaagcacaaggggcctcttcagtaggcagcccatatcccaccttgccctatcacctgcctcagcaaggtgacacagattgtgctggacaggaagagcccttctctaagactggaaaatctagtttttatgaaatcttgacatataataaccagaagagttcaatttagttctgcttccttcagacgatgtttttctccttcctgcctccctgcctgcctacctgtttccctgcctcctccttccctccttccttccttgcctccctttctccttttttggacctgggcgttggctaaagtgtgtgatcatgttcatttatgaggtggttgccaaggaagatgtgctacacagcatcgttcacgttctgagatgctctaactacaattagaaataatagagacccatcctagaaggatgaaatcagccatatctggcctgctgggatttatgcagcccctttgtccaatgtccccaggcccagtggctaaaattaagaaggaaaatcctttcattccaaactggcttcctcagcctgccctctccaccactaccctggtgaaactgctctagtcaaggttgccgatgacctttctgatgtgaaatccagaggactctgtattcaacttaacatagttggccctccacatctgtgggttctacatctgcaaattcaaccaaatgaggatggaaaatatttgggaaaaatacaaaataacaatacaacgattaaaggtaatacaaattaaaaacacagtacagcagttgttgacatagcacttacattgtgctgggtattataaatgacctagagatgatttaaagtatttgggaggatgtatgtaggttatatgcaaatactataccagttcatataagggacttgagcatctgaacattttgatatttgtgggggtccaggaaccaatcccccagaaactaaaggatgactatatcttaccacattttcacacagctgactacttccattaacaaactggactcttggttgtcaggacaccccattctcctgctttttatcctacttctggcagtttctcctcaatttactttgcagattcctcttattttacctgacttctttagggcttggtcttacatagttttctttctctgcattccctcctaggtgttttcattattcatgtagcttttatataacaatactcccaaatgtttctgctgagctctgccagctgtacactggtatatccatctgccttctcgatgtccacttggacagttcatcggcttctttaataagtccaaatagaaatcttttcccccaaacctatcctggactctctcccttatttccccatgttggtgaatggcacagtcatcacttggagtcatccttgattcctttctctcccttactgcacaaatacaacccacctgcaagacttattagtcttatcttcaaatatatgtgaaccctgtcaacttatcttcaccttcactttcaccgccctaattcaaaatatggggatttcctggaaggatgcaaccaatgtgggctgctgaagacacaattgaaagagggccacgtgtggacatctttcataaacccttggggatactgttgaagacagaaatttctaaaatgaatttcagtgctattcagaaaagagaagtatagtctaccatgaaccacataccctccccagggcaactaacctaattaccctactcaagggattggcctgccaagctatcatttctcacatgggctacaagaacccactcttctttcattctactcttgcccacctccagtgattatctgtataacattcacagctatctctttgagacataaattagatcatgccattcccttgcttgaacactcaatggatccccactgctcttagatcaaaatccaaaatgatttaacatagcctaaaaaagcctgcatgatctggcccctgccagcctccccagcttcatttcccctcattgcctattctccacccacactggtcttcgttcagttcttcaaatgctccaagctcactttctattctgggacatcattgctgacttctctgctggaggaaggcttccccacaactatctaaaaagaacatggcgggttctttttcatccttcaggactcttaatatcatcccagagaactccaatctacagtagatactacaccccctcagcagcttctcgattttatttcgttgtagtaattataatgtgtaattatacttttgcttgcttatttgataaacatcagtctcaaatgctagctgtaagcttcataagggcaatgaccacattggccttgtttatcacagtgtatttaataactagcatagccctcgacacaaaaataagtgcttgatgaatatttgatgagtgaatacatatattccacaaatagaaatggaagacttgaaaccaaatgctgacttgaggaaacacttcagggcaaaggattttcatttgaagtataatctgtcaaaaacaggtttgtatttggaactttgatcagttttgagagggatgatggtggtgaaatggtaatgtgtatgtgaagcgggaggggaaatgactaagtttggggagagggaacaaggaggaagccagccacagaaatacactgggaagagttcccgctttcatcggaggccccttaggatggacagggatgaagagaagctcagattcccagggcgcaaagtcaaattctgaatttttatggatgttctttcccgtgttatgagctctaatgatgcagtaatagctttacttaaaggagctctgtccctgggaagtcattaaccaacatgccagaaaatgttccaatgaacccacaggtaagatagactctaaatatcttatattccactgtgggagaagcaagcccctctcctaagttaggatcaagtttcttacccttcctattgtcagttctagccagtttggatctttcctagaaaacagattgattaatccataagtacatatcagtatatatacacacagatcacacacaccccattatgttttagttaaaagatgtatggtttctcaaattatcttgtaggagcccagcaatattaaaaaataaaatgtgctccttcacttcatatgccagaaataaaaaatctcatctacagaaattgtgtttcaacagcttgtttatgatatataaccaaagtgatggtaaaaccagagagctgacccaataggaataaactgcttgttgcagtaaataagtatctgtattcttggttttcccatatggctcttaactccagcaaacatttgtgcagaagaggaaagcataacccacatcaaaggagagttaattttatcctgtgctgaagacacagaggttgagaaagaaaaatcttttaaggattgtgcccaaattataatggttcatttgcatctgttccaccatcacaaaggtgattgctctttataacaaaacataaacaagaaaacccttagaagggagccagagactgtgggcaatggtggggttcgggtggggccggaggtggggtggggaaagagactttgtcagctgtcccatacctcaccagtggcctcagggcatccagcttcaggctgggtgtttccgaaagccatgaataagagttcctacattgctttcctactctcattacagggcatgaacccagggcctaacgactgcgtcttggattagagtggtcaggaagataatagaagcattattgctattgatactactcataatggcaatagctaacactgactgaggtacttactagatgccaggcactctttgaaggccctgaaatgtattaactcatgttaatacatgtaaactgacacattttacagatgaggaaacagagacacagaggttaaggaacttgttcaaggccacacagctggtagctaaggggcattgaatggctttcggaattgggtaatgttctacaaactcagctgaaacactgacgctgaatgtctttactgtctgctagtctgattgagaaatgagggctcatgtcttcttctggggcagtataacagaaacttccatctaaagtgattgtcagaagcaggtccatcgttattcctaatggagactctcaaacgccatttgtgtttgaaccttggacacagtcgctatgattagagcattgatctgtgaaaatgatagaaatatgacctgcaggccaggcgcggtggctcacacctgtaatcccagcactttgggaagccaaggcgggtggatcacctgaggtcaggagttcaagaccagcctggctaacatggtaaaaccccgtctctactaaaaatacaaaaattagccgggtgtggtggcacatgcctgtaatcccagctactcgggatgctgaggcatgagaatcgcttgaacctgggaggcagaagttacagtgagccgagatcatgcctctgcactccagcctgggcgacagagtgagactccatctcaaaaaaaaaaaaaaaagaaagaaaaagaaaaagaaatatgacctgcaatcagagaacaataaaattggatttcttaagggcagggatagtactatctacttaaaaaaatatcttcacagtgacattccttgaagctggattgaattgaaaatatattagatactggagacactgagtcactttgagacataaatacttttactgctcaaatgactagaattattctgtaaaaatatccatgaatttagtgccatttgttataaaactctttcctgttgcaacctacagttgtctggggttagacaatactggtgtggttttattgaaatctattttcttttaatttagaatattatgggaaaatactaaaatgattaaggtagatcaaaggacagtaatgtgaagtcatttggcattcaaaagaaaaaccttttaagaattgtgttcaaactataaaggttcatttgcatctgttcagccatcactaaggtgattgctttttgtaacaaaatataaacaaaagtaccttgaaaattgcagaacaaatggttttactttgcatctgctctttctgaagcattgtttccaagtatggagccatcgttaatggccttcaaacatgtatttgtttcacttatattaccagagatgtaaactagatgttatgaacattaataacttttacaatggtgatggtatttgcttattgaagcttcacatttatattcattttaaaagcataatcaaaggtgcagcaatgaatctgtggcaagttttagctacctctatggccaaaagggcaaatctcatggataggtggggctgttaacaatggagcagctatctactgagagccttctatgtactaggaactctgctgcgtggatcacatatgtatattatcttttaatcctcctaacagttcaaagaactatggtgctattaggccaggtgtggtggttcacacctgtaatcccagcactttgggaggccaaggtgggcagatcacttgaggtcaggagttcgagaccagcctggccaagatggcaaaacaccatctctactaaaaatacaaaaattagctgggcatggtggcacgtgcctgtaatcccagctactcgggaggcaggagaatctcttgaacctgggaggcggaggttgcagtgagctgagattgtgccactgcactccagcctgggcaacagagcaagactccatctcaaaaaaaaaaaaaaaaaaaaagaactatgttgctattatccccatttcaaagatcaggaaactgagaggtagataaattaagcaatttgccaggaccactaagctagtaagtgagaatcaggataactgactgagtaactctagagtgcaagcccaaaacactactctgttatattaataaccttattaatataaccttattaatattccaaccttttccacattgggacacatacagaaaaggatgatacctggacagtgcactgtagtaaacatgaaaatgatcaaggtctgaagataccaaaccctttctgaacactctgagggctaaggggaggcaacatcttggtataactcacgagaggtgtgagcacaggttaggaaactcaggtctattttccaagattttaaaaaatcccggactggtttgggaatgtggggatgcctaaggatgagtttgaatgagtaaaatctgcattagagaatctatgagaaatgtgctggttcatttatttcaagcatgtgttaagtgtttgaatgatgcttggagaccttcttcccctcaaatatttaaagacaagttttgaggcagtggttttcagacctgtttagaaagcaacacatcctcctgctcaaatacgattttaaatgaaagcccaatatgtaaaacagataaaaatggatctgcttttgttagtcaagtaggacccaaagcctgctgccacccaccctgagtcccaaccgcagaggccctttaggccatttcttgggatgctccaggctctaacagaacagtctgcaaacgactgcgtgttgaaaactactgcgtgttgaaaaccattgcgtgttgaaaaccactgcatgaagaagtggtgtctctcaaagtccccattgaagtgcagaaatctctactctggtggtagaaaggcaaggaagtcagagatttgctcactagcctgtgtttttaagtattggtagctgagagttaagactccaaagaagggagataaagcacagggaagttttgctgaagtaagggggttggaagcatctgtcacacagcagggaaggacagactttacctttccgtaattttttctagggcactcagtcacttggagcctcagctgactgttcacagtcctgctgagtcaagatttgtcctacttgtctttaggaagcaagtcagcaacttgtggtagagagtggctactgggagacctggtttccacctctaattctgccccttggtgtgaacttgggaagtcatgtaacattttcagcctcaatttctcacctgtaaaatggaacaatacctgccatacttccttctcagagttgtaaagagcaaatgaaataatctatatggatgttatatgcacattagccattaaattaatagtttgaatccagttatttttatttttattttttgagatggagtctcgctctgtcaccaggctggagtgcaatggtgcgatctcagctcactgtaacctcctggttcaagcgattctcctgcctcagcctccagaatagctgggattacaggcacacgccaccaagcccagctaatttttgtatttttagtagagacggggtttcaccatgttggccaggatggtcttgatctcttgaccttatgatccacccaccttggcctcccaaaatgctgggattacaggcatgagccactgcacccggcctgaatccaattatcgaatggacagtttaccaagatgatatgcggatggacaaataagcacataaaagagcatcttttatgttcaacatcagtagtagaaaaataaaaatgaaaactacaatgagataccactgcatacctatgtggctataattaaacaacagtgacacaactgaaaataactggcaagaacgtggagcaattaagactctcacacaatgttgtccggaataaatggtagaacagccactttaggaaacagtttggccgatccttaaacatttagttaacatctgactcaggagtctcactctgaggtatctacctgagtgaaataaaaactgtgttcacacaaaaacctgtatgcggatttctatggtgactttattcataatcaccaaaaactgggaaccaccaaaatgtccatcaactggtgaatggataagcactctgtggtacaatgggatagttctcagctatgagatggaacaagcgacttatacactcaacgtgagtgaatttcagctgaggtatgcttagtgaaagaagccagattcaaaagtgacatactgtgtgattccatctgtatgacattctcaaataggcaaaactaaagggagagaaaactgattagtggtttccagggctgggtgtaggaggaggcttgactacaatgggggataagagaattttaggaggttatgaaactgttctatatcttaattatggtagtgatgatataactatgtatttttgaaactcatagaatttacactaaaaagggtaaattttaatgtatgtaaataatactcaatttttaaaatggaaaagcttaatagtgctgataaagtatttttaaacctgggtgaagaaacatttttaagttgattacaccttttggaaagaatatttccaccactactttgctttatagcttcaagcctctgtgtccctcaccattggctcaagatgagccttagcccaatgagatggataatgaattctgagttcgtagagttagaagaatctgaattaaagaggttttactttaatctttagaaggcatctttaatctcaaagcttttctagaatcgtgttcttcttcttcacagaaatacagccctgtctgaagtggcagagagctgagaaaagggatgagaataattaatcaaaaagtacttatgtcacgggagagatgatggaaaccgataatagccacatcttgccaaagatggaagaagtggaaatgaattactcagaggatattcttgggctccagctaaatctataccttctggggtattcatgatcttcctcctgatctcttcgtctcctctgtaaaccgtttatgtgcagggcttgggcataagattagttcacttctagactaaggcctcataagtgatgtgcaactatatccccaacagtgtgtccccaggggacaaagcccccccacttttttttttttttttttttttacaattccggctgtttaaaaagaaaatgaattagtgaaaatagagcccctgtgcctggagctgtccaattgtgttattgtatttcagcaaggatatccttgctacatttttttctgtactcagctttatctttcaaaaccctttcttctcattcatatctttctacattagaacccaatacccagctgctttattcaacaaatactatttctttctttagtcacccaggctgcagtgcagtggcacaatttccactcactgcagtctcaacctcctaggttcaagcaatcctcctgcctcagcctcccgagtagctgggattacaggtatgcgccaacacacctgggtagcttctgtattttttgtagagatggggtttcgtcatgttgcccaggatggtcttgaacttcggggctcaaatgatctgccttccttggcctcccaaagtgctgggattacatgtttaagccattgtgcctagccaacaactatttattcagcatctactttttgtgttgtacaggtctatgcactgaaaatatgcctgtgaagaaagcaatatttctgtctccatggaccttactatcaaactggaagagaccaaagattaatatacaaataggtgataatagaaagtctgatatggattggtgcaatgaagaaaaataaggtaagttaaggagatagaaagtggtgggtgttgttttagataagctcatcagggaaggtgatattaagcagggatttgaatgcagaggaggagaaagtcatttggattcttgggctaagaacagactaggcaaatgtaacagacagtgcaaagatcctgatgagagagggcttgacatgttcaaggaatgacaagaggactgggaggtagaaggaagtgtgagatcatatagggcttcaagagagagtctggattttattccaagtgtgatggaagccactggatggtttcaagcagagaaatggtattttaaaaggccaaacacggctgctgtgtgcaaaatagattgcaggtggaatcaagaacagcagtctggaggccattgtggtagctcgggcaagacatgatggtagcttggatgtgggtgatcgtgatggaggtagtgagaaggggttggattcaggatatctttttgaagatagactagagtggacctgctgatggattgaatgtggggtgtgaggaaagacagcagtcaaggaggacccggagttttgtatttgttcactagaaaacaccagtctgggcaacatagcaagaccctatcgctacaaaaaataaattagctgggtgcggtggtgggtgtctgtagtcccagctacttgggaggttgaggtgggaggatcacatgagtccaggagatcaagggtgcagtgagccatgatcatgccactgcactctagcctgagcaacacagtaagagcttgtctcaaaaaaaaaaaaaaaaaaaagaaaaaagaaactactaatttttatacaggcttgtgcaaggcactggagaagtaaagaagaacaagacacagttagtgccttcagggaactcatggtactatttcaaatttctagacttctagagggaagtacagagtgctgtggagtgggtgggaagagaacagattgttctgtatatgggccttagggaaagtgtgagtttgagtttgaagggagaataagagtctgctagatgcagagagtagggaagagtatcccagaaagtggggtcaacaagggccgagctcagtgggctgctgtgggaagggggaggggtgcatgggatggtggtggaagaggtggaagctcagaaggcaatttgtggagaaccctgtgtgccaaccaaggagtgggaccctcaccctgtagacaatgggctgccagtgagattttttaagcaggagagtgatgctcaatccctccgtcttacctaaacagatgagtcaacccagaataccaacaaataaactacatgtggattacaacttattgtggtgttttaggttcttttatcagcaaatttctatattatttgtattgacaagtagaagcacgctcactcttagggtgaagaaattctactaattttgtggctaatgaatatcgaacatctactttgtgccaggtgctgtgtttgaagtttaatttgttatgacaaagtgacatgcccttaaggagcttgttataggaggtagacatagaacaagtgacttcaaatgtgatgattagaaagttggggggaaaaaagacgaaaggtgctacagaagcatttaatggaggaggtactctcatttaggggttcagggaggcctccctgaggaaatggtcattaggtgaaaactagctgatcataattttattataagcagcagaatcattccctatttctttaataaccagccattctttcaagtggtcccttcccttctactttgaagcacttccagctcttgcctaccttgaaaagaggaaaaaaccaaatatctcagtttattttattttattttattttttagatggagtctcgctctgtcacccaggctggagtgcagtagcgtgatcttgcctcactgcaacctctgcctcccgggttcaagcagttctcctgcctcagcctccctagtagctggtactacagttgtgcaccaccacgcctggctaatttttgtatttttagtagagacagggtttcaccatgttggccaggctggtcttgaactcttgacctcaagtgatccacctgccttggcgtcccaaagtgctgggattacaggcatgagccaccgtgcccggccgaaatatctcacttttatacacccaaactaagcttttcattattttctagaatcagccatataattctgactttcctacagtcttacatccactcattcattcacctgttcaagttctgtgcctcctgcgtggtatttggggggactccacatggattctgtagttgaaacacaggatgtgaggtgtggcgtgaagcaggggaagccatgatgcgcttctgcatttgcgggacatacacaggactaaggcgtccactgtgcaggtgctggagacacactggagggtttgaagcctgggcatcagaggtgtgtgttagatccctggcatgggtgctgatgcggccttgagatgagatgaggagccacggtggccggcagggctgctgtgcaggtgagagatgggacggggcgggacaaagcagagagggagggatcagctttggaaggtagcggaggcgagaaataggactgagatgtgtggaggtggcggaggagagaaacagcaggactgaggaggtgcgtggaggtaggagtgagtgaacgaggggtcccaagagagcctcagggctccagcttgtgtgatggtggatggtgatgccatagcggagattgggaacagattgaacaagcaggtttggacctgcccagtgtggggattctgaaatctcctttaacctcttcctttcccttaatctctctatataatcagtcaataagttccctcagtgttttttcagaacgtctctcgggttcattcccactctcccgaggttgacttcagcccttgtttccttaaagtgagatgttacagcatcatcctatcaggccatctggccactggcttccactcttcagcccagcctgtattctgcttcctaaaatacaccctcttatttgacatctaatcatggcctgaatgttttttttttttttactttattgtagtaaacccttagtctatcccttacttcttcatgtgtttactctcctttttatgtccttctttcacaattaaatgatttattccttgaagacagaaactgtattctaaagcttcgttgttagtagtgccttccaaaaagttttgcccaacagtaaatttgtgttaaatttaattttactttaaaaacaataagaatacaatgtggtgaatattattttaaagtctcacatttcaaagcatttttcatcaggtattggcaaatgcacgtttgtgtgtgtgtgtctgcgtgtgtgtgtgtattttttaaggcatattatccaaatttttgccagtagcaacctgaggtggattacctattgaatgaattccacttcagtagctgactttgttatgtcagcatcgacaaatgccagggataggaaagaattgaaatctagagtgaggcagtgtagatatagatcttagcttcactactgaacagctgtgtggctttgtgcaaattacttaacttctccaatcataagtgatataatatctatcccaaagactgttaaaaaattaaaattatgcaaattttcataaaaattaaatgagcatctaacatggtttttggcatatagtaagcacttgtaaataataataataatgatggtaaaaaaaccagctaacattcactaggcgctttctcttcatactcaatgctgtgcatgcgttctgtcatttaagtttcataacaaacctaagaagtagatactgctgctgtttttattacacagatgaagaaacagaggttcatagaagttaagtggctcatccagagattgtccagttttatcccctttagataactttttagttttttttttaagacagggtcttgctccgttgcctaggctggagtacagtagtgatcatagctcactgcagcctcaatctcctgggctcaagcagtcctcccacctcagcctcctgaatagctgggaccacaggtgtctgccaggcccagctaatttttgtattttttgtagagaaggggtttctccatgttgcccaggctggtcttgaactcctgatctcaagcaatccaccctctttggcctcccaaagtgctgagattataggtgtgagccaccatgcttggcctctttaggtaacttttatcttaagctcctgtaaggagagaaaaggagaggtgtaggtgtatcacttctttcccatatatcctgcagaagatgctatgagtagagcaatagccctagagaaggatgaacagagaacctggtagatctgccacctggataacccccctgtgcaagaaccagtgcccccaaggcatccaggtaaaaggagctctcctaaaggcaagcaggggctgattaacatgagcgttgggcagacagtggctctgggtgtacctagcgcaattggggtcacaggcccctctttgaacttagggtgggggtggagtggtggagggcctatgatgtccttagctccagctgcaagctcctggttactgcaggcttctttctccataaggcagctgaggatgcagaaaacctttcctttctactcctgtgttgtgaaagacccctgcatctttcctgctgtgataataaagaacaaaagatgagactatttggaaccatctgagccctcatcggtgttgataaagcctgcctatgaatttttatttctgcgaacagtcccagaattccttcctaaaaacaaactgattggtgtcaatttgtgtagcatttagggctcatatataatggccgatttcaagcaggcttaatttcattttagcgcaagataagttttttcattggagccactttgtcagaaataaaattgagctggaaagaaaaacaagaagcaatttgactatccttacagatggtggtttatcaagccttgaatttttataggtgtgtgatgcaaatgtggaaaaaccctcctgtgtcagcaacccctgcagagagtgtcagtgcagcaccccagggagggggagccaaaggatggctgaaaaaagatctcagagctgaggggagaggatttatgttggtggacctgctgtagaatggtccccatttctttcgttcagtacctttgctgaagcagtaggaactagttcctgggctgtgtgcacgtctggagtctaaaaactcagcgctttgtctcttcacaggagtagacatgtcaggattagatctttggccatcagcgtcacctactcagagaggcctctcttcccaccttgtcccaagtggttattttcttagttccttcttcgtttcttttacaacatttactataatttgtgttcgctctttttttgtaagtgtgtctccctttactagactataaattctgttagaaagggactgggatctgtcttgttcactgttgcaatttcagcccctaacacagtgctgggcacatgttaagtgttcagtaaatattaattgaatgaagaatgaaatcagagatcactcattcccctttcttgaaagtggagccaccttaatttttcagatgaatatggcgtatgtgtatatttcacatatatgtaactagatcaggatctgcacctgtaatgtattcatatgaaacactaacttgatgttttactttttaattaactttaattttattgtagtattgtattgttaaatgcaaaaaatttaaggctatcacatgctttgtaaaatttgcaggaaaaaatttgtatgaatttctatatccttgccactcaaagtgtcctctgtggaccacatcacctgagaacttgctagaaatgcagactccccacctagacccactgaatctgaatctgcattttaacaggctccccagggattcacatgcgggttgaagttcaagatggctctaaagtcacaatttagcctgtgagttcactttgtaaactgtgggaggcaggtgaactgaagttgaggaaagaaagaagagcttcaaccaggacactgaagtgaatgatagttgcaggaagaatgagaaattctatgcttcacaggccagtttttgttttcaaaccctcacagtgcctgttggtttagttaagttcgtgggcgttttcactgagccaaactcacgtcacgttaccggcatagccaggacaggacaacaacacctggactgccataactatgattccagagagggtatctaaataatacgttaatagtgtttttaagttttcacaagtgattctaatgggtgtctaatattcacttagaggattttttttttaagttagtaagttagttgctgttgttataaagaacatcttagagcctgtttatccaggtaacacattcctgagatttgcagctggttcagacactgcagccaagtacctggcccttcctctctctctttgactggcaataagctgagggaagaattgaaattatacaggctcttctttgaaaaactgggttaaaaaaatctcaattctctaaattgtagatgtgatctctcacacctgaattaatcaattaaataagcatttattcagtgcctaaaggtgccagtgtggggctggttctggggaccaaagactaagaataccagattcctgccttcaagagagagtctgtgactttggtttattcatgacaaatctcttccccgcctggtggaaaacctggaattctctgtctttaatcaatttactttgtgctctaggtcaataggagtacccatcacaatgaaaaagtcttgttctttatcatttggaaaattagaccttctttccaagatgtccttagtcactgatcctcatcagtgtggatgatctttcctttaccctgagcaggttgtttttattctgtgggccttcagagcagaaagaaaaaccattttagaggcggttctgttgaatgtgcctggcacattggtgctaaacagggaataaatcataataaatggaaatagtcgcccatggcatgatctgattgagtcgtttaaacaatcattttgtgttgacaaagggtagagtgattatgctagaggaattcaaaggtgctcgaaacaaagcaattggagaaattgcttgaaaaatgtggggagttattccagggcaatagacttgcttcattctggctcagtcttgaagtctatagacccaggcggatctctgcagttttgcgagatgaacctcctagcaacctgctaataccattcattctgcagcttgggaggttaatcctcacagtaatgtgtgggtagagtcacttagagggcagctcctagcatacgtgcaactgtgctcatacagatgtctgtttgacttgaacaaggaagacattattagtaataataattcgtgcaaataggctgctattgccagagcattcctgagacagctcgttgtgctcttggggcgcccctctggggcttgtgggtggggactatttttgtatgtcttttccaaagggaaatgccaggagggtaagcgacttcctttggatcaccttgcaggcgggccggagtgagagctgaattctagtcttccccaccctctgtccaagcagagcgaggatgaggggaggcacaggcgggaaggaggacgggcgccccctggcggcccctggtcgtgccgcagcctcacattcccgcgggttcccttctcgccgcgttctctaccctgcccggctcagcccagggtcaggaagggggcgcccgattccacccctttctcaaccttccctgggtgggtaaggtcaccccacacgggttcaggtggtggtccctcgactgggaatgaggggatcctgaggatcccgcaggtagacgtagagcagcggggctcagctctggaagcgcgggatgacttctgggaaccgcacccggggcaggtcacctcgccttggagacagccctgagtcaggtcaggtggcaatcgggatgacgttacacctcccacggagacgtctaaaccctcgtgaagtctgcctacacatttacatcattctctattcattacggctcaactcaggaatgattgttgactggcacggaaataaatgacaaccattaaggggctaactggagctgttaatcgtttgagaggcctttcggtaagtcatccttccaaggcggctagatcattctggagtagcctcaaaggtgcctgctgctgtccagagaaatctcactgcccgcttgtgcatcctttgaccctccaccagcactttgttgaatgctcgtggcgtgttgatggggaaagattgaaactaactcaggctcctttagtaccaaagaccacatctgattcttctcacctgaagtctgtgtgctttaatgtgagtctctgtggaaagaaacaaatccaccactcattccagctacctgagactgcagtatgcgatggaaggctccttcagcctcagacactgcacaagaagcctctggaggctccttgggttgggatacttagacagccaaacacaaacacacagaaaggattctttcaaaatagagatacgagtttggttgaatgaaagacatagtaggaaattcttgaggttaggagctttgcaacctctagtcagcttgctgcaaggctgctctctcaggctcctatcacctggaaaggcaccaggtgtggtggcttacgcctgtaatcccaacactctgggagcccaaggtgggaggatctcttgagcccaggagtttgagaccaccctgggcaacatagcaagattctgactctacaaaagtacaaaaattagctgggtgtggtagtgcgtgcttgtactcctagctactagggagaatgaggtgggaggattgcttgagcctaggagtgggaggctacagcgagacatgattgcaccactgtactccagcatgggtgacagagtgagacgctgtttcaaaaacaaaaagcaaaacaaaacaaaaccaaaacaaaaggctggaaagtcagcttcctgaatgccagttggtgggctgtggccagaacctaccagacttgatgccctgctctgtcctctgagtgaatagttcattgaatggaccttctttaagtaggccttcctgctggaaaagactgacagaaccctactcctacaagtgaggctgctgtctgggagaggtgaagaggtttggcatggaggaaatgagcagctgggaccccccacaacccgccctgtgatagacacaggggtctgccgcattgcggactggcagagctgctcccttcactgtggtccactttctaaggctgaaagatggttccattaacatggatactgagagcatccatgagtacaggagacatgagacatgggcctaaattgctccttctgatctcaaatcagtagtgttatttactttaccctttcttccttgattaataaaggaaggtccttgaagaggtttgctgttgactccaaagagtcagggtcatggggtctttgttcaggtgcccagtggttgaggaatatgttctttggctaagcttacatgctttgatgagttacccaaagaggaacgatatgataatcttaaaatgctaacatggcagctctttctgattctggcaaacattataggttttgagccaacatgggtgggctgctactttgtaagacaacattctgtgtaatggcttggagtctggttgaattttgggagtgtctggagggttataggctgatcaagagggcgtgaactcctctgggctattgtagtacagggtttaagtctggcctgtgaagtcaaactgcccagcttctagtccttgatcgtgctccctgaccaagcaggtcacctgaaatgctctaagccttggttttcttattagcaaaatgtgagtgagtagagtacctacctcatagttgttgtgaggtttcaatgggctcaataacttagtgtgccaggcacattgttaataagaagtaaatgctcttgttatcatttggcctgccaaaaaagacctaaccttctggaggtgctctgaaggcctcggactggactgaatctcttggaattactcccgataaataagctttatctagatttggagtatcagagctggggacatctggggatgccaaatgcagctgactgatacaattgccagaccccacgactcagggcttcatcagtacatcaatatatacaatatgccgggatacaccaacatccccttaaaccttttgaatcagatcagcagggcacaacataggagaaagaacattatcgtttggagtcagaggacaggttcaagtacactgtctgttgcttcctagctgtgtgaccttgggcaagccacagcctcagttttcctaaatgttaaatgttaactacttcccttgccttcttcacaaagctgcctgtgtgaaataattagataacagcattatttaatatgcatatagagtgggatattacttttcttacctataacacctgacaagaagaggcttaactcataaaaatagtgttttttttgagccatcttttggtaactaaaattgatacaaagggccttggatcatgtcctaggtgagctgaatggtcccattgtttctgcgtgtggcaggtggagtagggggtgggaaaatacctgcgtagccagtttgtataatactctggagcttcctatcagccttaaaggtcaagagaaagttttgttgggaacatagttttagattaatttttagaagtgcagctgctcccttgacctctggggctggaaaggattggccaaaatctccatttatatccacttgaaataactgacaaagctggatttgggattcagagagtcccagaggaaggcctgtcagtgccttcttcttttttagcctttaagcttgaatgagtcgagcgagtcaaagaaattttaacggatgtacagacaatgtcttcacggtcaacttttcacatcgtcgtttgcttaggaaagagtgaagattaagcagcttgcactttatttttggcaatgcctttccctagaacacaggaatccacaatttactgaggggaaataattataaaccttaagaggtgtaagtttcagcctcaaaaactaacaaactgagaactaatgtatttttggtataattactagttttactaagtttgatttttgccagactttcacctaaagcaaatgcaaaaaagaatagtgacaattaatggattgggccagttactagagtagaaatctttcaggttcaagctaattctctttactcctctattttcccagggtagcatgattaaaggtaaatgaaaaaccaatggggataatttgtgttataacttgcacttctattatgaggaggacatcattattctattattttatgagaaatgttcattaaaataatgtgactcccccaactccaaaatttacggtaccattaatgtttccttttcagaaccgagagttcctatagcattctctcactttttaagtttgtcatccattatttctaagtagacatatggctgctttaactaatagaggcatgtgtgtatgtctgtataggactagagaagagatctttcttttcctctctccaacatagctatgaggaagacaggtcagttgcaattactgccattccagagacagaatgatagaggtgtaagggccacccacgatggcattaacacatctgcagactctagattctccttttgctgaacactagcaaatcactttgaatcaatgtggagttttagtatagctttttgttctttttctttttcacagcagtatggaagactggttagtacgacagtacactgtgaaatccttaattcattttttcagttgacacatatttttggggacttggtagatggtcaggatacaatgatcaacaagatagacaaagtcagtgccttgtgaggctaatgtaccgtgtgtgtgtgtgtgtgtgtgtgtgtgcacgtgtgcacacgcagttggctcccactgagagatggaatgagtggcaaagttaagctggcctttcatagaatctcagtgttaccttttgctaagaatgggaataaaggccaaatgtgaatagaaacttaggactcaagagactttatttgataagtctgtctcagaaatctaaggatgtggccgggtgcggcggctcacacctgtaatcccagcactttggaaggccaaggcgggtggatcacgaggtcaagagatagagaccatcctggccaacacggtgaaaccccgtctctactagaaatacaaaaattagtcgggcgtggtggcacatgcctgtagtcccagctacttgggaggctgaggcaggagaattgcttgaacccaggaggcagaggttgcagtgagccgagatcgcaccactgaactctagcctggcgatagagcgagacttggtctcaaaaaataaataaataaataataaaataaataaaacaaaatcaaaaccaataataaatctaaggatgtacttaaattgtagagacataggtatataggaggacagcaacagccatttaatgatctttggttggggtcttattttttttagttttgttattcattcatccattcactcatttcgtcaaacactgggtgacctatccatatccttaagttagagcaatgtgctagccattgggaatatgaaaatgaatttagaaacacttctcttcatgaccttgagcagctcacattctagggaaaggaaaagaatacctgaagaaataaatatgatacaatgtgttaagcactttaatagaattacatactgagcgatataaagatatagaaaagtccctcagaaatacatctttgagaaaaagaagctgaataatgatggcgttttcatgagccttttcagttccagtcaacaattttatggttatgtttatatgtgagacaagccctctttgccttcatctgagatctgaagattcacttaatcagagcctgactccaatttcctttacaattatgtacagttctcttagtaaagagcatgcatgcagggtgctttatagccttatcccacagaacccatactccggatgggagatgttacatttcatctccattctctgtcccttaacttttccctgccagcagccatcctatactaagtactaatatataaaccttgtgatacttgctctattggacattcagtggccttgcatccttcccgtcaatgccaagcttaagaactagatggtttccggtgtctcagacctggcagaacttgaatgatgaacacacagttgagaaattcaggagagttaggaacttaataccaagggaaggaatcccgctttctctggggcctaaaaggaccagaaataggaatgtgggccaggcacggtggctcatgcctgtcatcccagcactttgggaggccaaggtgggtggatcacttgaggtcaggagtttgagaccagcctggtcaaagtggtgaaaccctgtctctactaaaaaaaaaaaaaaaaaaattaaccaggcatgttggtgggcatgtgtaatcccagctactctggaggctgaggcagcagaatcgcttgagcccgggaggtggagattgtgttgagacaagattgaaccactgctctccaacctgggtaacagagcgagactctgtctcaaaaaaaaacaaaaaaaaaacaaaggaatgtgtccagtatcacacccagtgaaaatctgggtcatcatcataggtgagactgctgaccacacatgttgaattaccttcaacatggcttctgcaagctaaagatttgaccatggaatagaattcactaacagatccatttgagaataaatatctgcatagagctctgacaaggtgagatatggccaagtcatggggctgcatgtgtgacctatgaggacactccttttaatcaacgtcctctaccaagcaactcatgatagctctaaaaaaaaacccagcgttagttatggaccaattgaatgatggctctagctacccttatttgcagatcagggaagaactaaatcaaaagctgtaattaaaaaagataatgacttttaaattagtttttattaatagaattaagccatattaagtcttgagatggtatcataagtatgcgaataaaatgttcttccctaatgaaaacatatatggactgaataatttaaaagtcatatattacatgttggtttataacattaaatattaaatatattaattggcaatataaagtagcttatggacattttgtatcactagctaaataactaggtaattccttattgatctctatagagtccaaacccacatcaaccggatgtaacagttttgatactgactagacagaatgagcacttcttagagaaccacaggatgacgatgggggttctgtgctctctgtgcatcatcttaataggaaagaaacagagactgggggaggatgatttagattattcacaaataaattctcccttgaaggcaaataaaatggggagtgggtgtcagtggaatcttctttcctagatatgtatttggtcagctgtctggggaagtctggcatggaactgcctggggaggagaaaatgaacagaatcatctcctggtgagcctgtaattgcaccagcctagattccacatggtagcctgttgccttttagaaggccgccgagccttcttggattttctaatgatgaccttgtcctttgtcctaaacctgctgtcttcttacacccccacatctctcctctgccagcagtaactcaggagccaagcctcagggtttgtcctcctctgttttcccttaatctggtaactgcagctcctgtgtctctgcctgattttccactcccaccctggtggaggcctttgtctctgctcacctgcaacactgccatggctgcaatattgtccttgtggcccccagctccaggaactcctttgttgccccactgctctgactgcccgctctgtcttgcctctgtggatggcctgggcctgcactgtgggccttgtctgcctcccaccgtctcttgggaagacaccttacattccagtcacactcctttccatgcttcagccccaagcccttgcttgcgttgattttgcctatgactggattgccccactgcctctctgcctcctaaaacccagctcagctcagatgccgccatattcttgcagtcctccttgataagctcacagagaaaatgcacttttccctcttctgagcacgtgttggctgaagtttacttgctgataggattgtgttggctttgcctatcagataacagctgtggcttattaatctttccattcctaacagtgccaaagtaagtgccttgtaccaaaagctttgtggatttgaggaatgaatcaatttaagagaaagtcttgcccaggtgacattttggaatggagactctgaaattaaatggcaaccaaatggacattatgatgtcctcactggcttgtcttctatatgcagggtatgttaaattgggtttattgctttgctttttacacttgaagggatagtgtcttaggaagaacgctccagtggagaaaacagtgactcccctagtactgaggtcctgtgaatagaatctgtattttcacatatgcatatctctacatatgactgtcacaatggatgtgtcagttggagtcactctctcaccttcttcctcgttgttcctcacgctcattaaaaacagtccccgccaatgcccccctccaccgattactaaaatatcagaagcaatttggataatatataaaaatgtatgatctgggtggtatttctcactacccccctaaaaagaactctcttaatttagattttcctccagtttttttcttcctataatatttctcctcagtctcatatttgtataagctggactttcacttcatactgtttttgggtcagggaagtggtttgtcccagggcttccacctaaggataagcctgaaacataagcagttccatcaatttctggtcttagttttaagacattctgggagatttccaatgaatataaggaaagctggataattttaagaaatgacttctggctgtgtgcggcggctcatgcctgtaatcccagcactttgggaggctgaggcgggtggatcacaaggacaggagatcgagaccatcctggccaacatggtgaaacccgtctctactaaaatacaaaaaaaattagccgggcgtggtggcgtgcgcctgtaatcccagctacttgggaggctgaggcaggggaatcgcttgaacccgggaggcagaggttgcagtgaactgagattgcaccactgcactccagcctgcgcaacagagtgagactccacctcaaaaaaaaaaaaaaaagacttcaaaattaatgttaatttattctttctttttaccctcagacttaagacatgctgcttttgtttaaaggacaggacatgatgagaaagagacattgtgaaataaaagacgagacggcatctcataatttccaccacattaccagtctcattagtaaagtgcttctcccaggaaatggctattgcaagctaaaaacaagtgtaaagatgaggaataagaggagcttaaattcatctttggctcagagcagttagggctaaggcccagagttgaagttttttccttctagacattttacttagtgctcctaccttggctgatgtctattgtactgctcagccattccgcttaattcctctctcagccattcttccactgcaaatcatggctgagagctcggtagttactcttgtaatctgctcttgcctataacaaatggttgcagacagaattgcagtcctatgatgttttttttaagtggctcgcggtagaacccctaacagcctttaacaccttttctccacttctagttgtgtatgtgggtggtgggatctatgtgaacttgataaacaaaacccatcagttccaagaatacagttgacgagactgtatccttgtaacagacgacatcctgtaacagtatacctggcagagcaaaaccatcgatgcaatgattcttttaaaacattgcagagatgttgcaacgttttcttatttagttcagaaggggcaaatgagaatgccaggttttcagggtctcactgaacaccgatgaacttcagaattgatatctgtaattttccacacatttgtactcgtggcaatgaaatgctcactctaacatcttatggtcctttggcctatgaaatatgccactatttctcttttctaataaccatttcatacattgggactgataatgagagctgtatgatacttacgtaaaaggtcaataaatcgttcacaacagagaaaattcacctggtagatggtccagattttctatttttctcatctaaaagtttcctcaactcgttttgctagctattacgtatgtattaagtgttacatctgtgtttatataacacattttcatactcaattttgtccttgaatagtttttacccttggctgtaaacctgtctgaaccttagggatctcatatttaaattgcctgatggttttaggccaatgtgattgaccagaattgtaatttatttatttagtctcatttttccacaccataggctcttcaaattaagtcagtattacaaaaaaagagagaagatggctatttaaagtgaacattgactaggaataaatattctcaactcagtcaaggtggtcacacaagacactttctaaacatgcctgggacgtctgctttgaacagcatctaaatgacacaagaggatttagcaaaggctactgctgttcagctgagaatattgtatgattagagagaaagcaggggaattgaaacgtttgtttctctctcaggtttgcaggttaggctggtcagaaatgctgtttgtgtctcagatttctgagctacaaggtggtgatcattctctcatgggcctgatctatctttatctgacttaaggcattctcgggggcctgtctgctctagttctcattctgcctgaaaacatcattttatgaggactttcttaatgaaacagcacatatttgcaggcaaaggcattcttaccaggaagagtgataactaacgggctctactggctccctctactatcactaactcagcagcaaccccctgttgaagcactttcacactcagttaataggaacaggccacacaactctccaccttgcccagtgatacctctggagccagaagctagtggtctcctggcaaaggccaacccccacctggagcattgacctgttttgattctgcggattagtcactgtttagtgtgccataggtcagttctgtcactagcaaatgaagcctgcctggcatttattctcagagaaatgtctgaaaagctcttatggcccatcacatttcagaagaaagccatagtcatgtcaaagatgtcatgggcttcagccttctcttgactaattgctcttccccaaagaaatacagtacacagatgcaggcaagctccgaggtgctggagagggccgatgatttttttaaactgtcaagaaagtgtgttacgaggttgtacacagccctctgtttctgagaaatattgttactgctgtttaaaaacaaactgaagaaaatggaaggagcaataaaaataaaacaaactgtacatatacataaatgttatgcaattgttggtcctcactgtctttttcaattttgaagggagtcttcttgtgttagagcttgaggagaggtttgagaattcacagtgcagccattgcgtagccatttccatgaggtcagggctttgctgggtgtggagatgctatagtttggagatacatatttgagacagagtctggctctgttgcccaggctggagtgcagtggcgcgatcttggctcactgcaacctctgcctcctgtgttcaagtgattctcgtgcctcagcctcccaaatagctgggactataggcatgcaccaccatgcccggctaatttttgtatttttagtaaagataggatttcaccatgttggccaggctggtcttgaacccctggcctcaagtcatccacctgccttgacctcccattgtgctggaattgcaggtgtgagccaccatacccagcctttttttttttttttttaagacaagatcttgctgtgttacccaggctggagggcaatggcagcatcagagctcactgcctgggctcaagcaatcctgctgcctcagcctcccaagtagctgggactatggcacacaccaccacacttggctaatttttgtatattttgtggagatggagttttgccatgctgcccagactggtcttgaattccggagcttcagcgatccactcaccctggcctcccaagtgttggaggtgtgagctactgtgccagctgttagtttggatttttgaccctccaaacctcatgctgaaatttgatccccagtgttggaggtagggcctgggaggtgtttgggtcattggtgtggctcgctctgaatggcctgctgccgtcctcatgggactgagttctccttcttggtttcctggggaacgagttgttggaaagagcctggcaccccctcctctttcttgcttcctctctcaccacgtgactgctgcacagtttctctacaccttccgccaggagtggaagccgcctgaagccctcaccagaggcagatgctggtgccatgctccacagcctgcagaaccacgagccaaataaatccctctgctttataaatgacccatcctcaggattccttttatagcaacaaaacaaactaagacaaaggggcagccaggcatcctggaccattgcttactctcagcaatggggacttttcattatatcacacggcccctgccagagctcataaatgcttggctactggggaaaaaaatactttaataatttactttatcacccaagagtggctcccaaagctggttatatatgacaaccagaactgaccccctataagaatgcaggtacactgacccactggttttgctcttcaaagttaccctgaggaaataatcaaggatatatatgggaagatacagcttcaaggatttttttttttggtaggatttttttaaagtagtggaaaaattagaaaattaaaattaaagaatgatcatcccaataggagactgcttaaatgataaatgtatagaactaaatgctgagcagccagtaaaaacaaggtatagaaggatatttatatcatggaaaagtagtcgaaatattgtcaaataaaaaaagcaggtttcaaaataaaatggttacatttttaaaaagagaattattttacctcttttgattattttctgtttttgaggtattctataattaacatgcagtattttgttaaaatcagaaaagttacctaaaaagagagcccattagagcatcatttgagaactaacgctacttgcagaatggcagtaggaacgttttcaaaattgagattttaaatacatccttttaaaatgtctgtcctaggagttttagaacattagtctttcaaagagctttgtcagatgtgtaggtgaggagacccttaatatagaagctgtcccaggactgtgttgtcccctgtctgagggtgcagggaattcagcgggaggggccgttctctgtccctccttcccctctccttgtcagattggccccaagggggtgaggacctgtgtggacagactggctatgctcctgccatgggaatatgcatatatttgaaggtcaaaaagtgaggccaaagcttctaaatgcttctctctggagtaatctactaaccagaaattcagaaaaacataaacacctttcctttattttctcttctgaggtctctggcaggaccagatggtttctggctgtcttttcccattctcataagctccaatccccaactgtgagtccatctttccctgtttcaaagtagaagtgcccatttattggggtgggtggattaaggaacgatcaggtagagaaggatgacaaaaacgcgaagtgagaaaaaatttcagctgaaaaattgtttactctttgctgggctatagaggtgaaaataattgactggattttgttgcattctgttcagcagtccaaactgaacctccagcttgctgtgaggtattaaaggcttagttccagccttttgatttttcaagcacacttgtactcccccgagatctacctcagaatctgctggatccaataccactttcttttatggattgagtttattttgtaccttctctttataagtggaggaaaccaggcctttcagttagatatggtagttctttctcaaaatggactcactttacacagcaatacacatattttattttattttatttttttgagatgtggtctcgatctgtcgcccaggttggagtgcagtggtgtgatctcagctcactgcaagctctgcctcctgggttccagctattctcctgcctcagcctcctgagtagctgcgactacaagtgtgcatcaccacgcctggcaaatttttgtatttttagtagagatggggtttcaccatgttggtcaggctggtcttgaaatcctgacctcatgatccgcctacctcaggctcccaaagtgctgggattacaggcgtgagacactgcgcctggcctaaagggatataatttttattctgggatgctgaagactggagaggcaggaattctgtctttaaaaagcctccatctcactctacggacattctccttcacatgggtgtgtgtatgtattatattcttatgtaacgattatttaagccccttcattcataggcatacttttttttttttttcctgaaagaccataaccttctggagggaaggacctgacttgctatttcacttaatttttttttttctgttttgagacagggtcttgctctctgtcacccaggctggagtgcagtggtgcaatcacggctcactgcagcctcaaccttgtgggctcaagcgttcctcaacctcctgagtagctgggattacaggcatgcaccaccaagcctggttaatctttgtattttttgtagatacagggtcccactacgttggccaggctggtctggaattcctgggctcaagcgatcttcctaccttggcctcccaaagtgctgggattacaggtgtgagccactatggttgaccttaaccttatttctttttcttatttcttaaccttatttcattcattcacacaatgtaggcctgccttggcctcccaaagtgctgggattacaggcgtgtgttttttttaaataggtgacatccactggtgtgaggtgatacctcattgtgattttgatttgcattttctatccagtgttaaacatgaggctctgggcacaatcatgcttgcaaataatagatctagtgctttggaactgtgaaacagataagataataacctagtaaaaatttcctgagagacaaggtcacagaaaggcaaaaagaaagccatgatcttcatgtcacattttgcaatactaaataaccttgcaatgtttacatttacattacctatccccatagggagtgccttagcctgccacttgcagctcccagtgaagatgaatggaaacgcttttcccttgtcagtgtgcttctgagtcagaatcaggattgtgttctattagtatttgtctgttttgcaagctcctacctagagtggctgtcaagacaattgatattcttcctccctactgaacctgggctactgtctataataagtcatcgtgaaaagaggtggggtacaaaggaatataaataaaccaccgacacctcccagaccctggaacctccttttctatacatgcagttctacttccttactgcccctggtagagtcctccttccaaaatcaatcaggggcaggacccaaaacaatagcagcaaaaacagaagctgaacaaaaacctgataactagagagtgaactgatgataatgccaaccttatgataatgagctgcctggctcctactgattgctcctttaagaaactcagcacctcttatctaattgtcctgaaggctgcataatgtatcaaatgaagctcaggaaggggggcaatcctctgaagtaacctccgctgaaggcttagggctgctggagctcctgtgtggcagtgtcttttttttaattattgtggtaaaaaacataaaacttaccatcttaaccatttgtaagtgtgcagtacagtagtgttatgtgtaacagatccctaaaagttcatcttgcaaaactgaaactctatatccattgaactcaccctttccctcctccccagcccctggcaaccacgttctatgtcctgtttctaagagcctgactactttagatgcctcatgtaagtggaatcatgcagtattcatctttttgtgactggcttatttcacttcccataatgtcctcaaggttcattcatgttgtagcagatgacaggatttccttcttttttaaggctaaataatattccattgtaataccatttgacccagcaatcccattactgggtatatacccaaaggaatataaatcattctattataaagatatatggatgcatatgtttactgcagcactatttacaatactaaagacatggaatcagcctaaatgcccatcaatgatagactggataaagaaaatgtggtacatatgtaccatggaatactatgcagccataaaaggaacaagatcatgtcctttgcagaaacatggttggagctgggagccattatcctcagcaaactgacacaggtacagaaaaccaaacactgcatcttctcactataaatgggagctgaatggtgagaacacatggacaaattgaggggggaacaacacacactggggcctgtcagggcttggggggaaggagagcatcaggaagaacagctaagggatgctgggcttaatacctaggtgatggggtgatctgtgcagcaaaccaccatggcacatgtttacctgcataacaaacctgcacatcctgcacatggaccctgaacttaaaagttgaagaaaaaagaaattccactgtacgtaggtgtacacacacactgacacacacacatccctcccacattttctttatccattcatgtgttgatggacattgaggctgctccaccttttggttattataaatattgtgaataatgctgcaatgaacaagaatgtgcaaatatctccttgagatcctatatattttatatgtataaatatttttatgagtgtgtctatatatataaattatatatatatatatataaaatctccaaaagtgggattgttggattatatggtaattccatatttaattttttgaagaacctccataccgtttccataatggccacacttgcaatcccacaaacagaacacaagagttctaatttcttcacatccttgccaacacttgttattttctgtgtatttttatttttatttttgagatggagttttgctcttgttgcccaggttggagtgcaatagtgcgatctccactcgctacaacctctgccttctgagtttaagtgattctcctgcctcagcctcccgggtagctaggattacaggtgccctccaccatgcctggctaattttttgtaattttagcagagaaggggtttcaccatgttggccaggctggtcttgaattcctgacctcaggtgatccacccaaagttctgggattacaggcgtgtgtgtttgtttaaatagttgccatccactggtgtgaggtgatatctcactgggattttgatttgcattgccctgataactggtgatatcaaacctcttttcttatgcttgttggccatttgtgtatttatgtctttcacaaccatagcacaacttggggtttctagccagagcttttttacatgccttggagctttggatgtagagagattgggacatggtttcactgtatttgatcactgaaaggcaagcaacatttcacttacatggtgagtaagcagtgagattttttttttgcctgggcattgcctgatattttactttgaaaacaagctaaagatattgactgctgtatgcccaggggtaacaagctattgatggctataatggaaaaggccaactgaacagatgtattttacttagaagagataatttttctcccctctggcattttatatatatgtgtatatatatatatatatatatatatatgtatgagaaacatcttgaatataaaaagacattaagtattcctgctagttgctttttctgtagtagtgaattttcataaggaatagcaaaaagacccaactcctttttttgaaggtactatgctaacatcaaacaatctttcatcagaaaaacccagtgtatgaaagcagctccaagtggtcatagtacaatgattgtgtctatacattaaagttggggttatgagggaaagtagcctctgtatcactgctcatgtgtctcaaagtagcaggaaggtgacacagagcctggagccggcaatgagggaatgtctgtgttcttgctcgcctttgccagcctccctccccccacttttccgtgcccttccctggggactccatctgctctttcggttttaactgctgaagccacaactatgatgcagttgcttgttgtgaatcactatttgaatgttcacatacatcttaaaattcctttttttttttgagacggagtttcgctttgttgcccaggctggtgtgcaatggcgtgatctcggctcactgcaaactccgcctcccgggttcaagcgattctcttgcctcagcctcctgggtagctgggactacaggcgcctgccaccacgcccagctaattgtaatcccaaagtgctgggattacaggcgtgagctaccactcctggccacgtgtttttttataccctcagattaattcattcatagtactctccatgtaagcattaaaaaggaactaaggcatcttataactgaaccctattattttatggatgagtagaccaaggtccagagaaattaggtaattcttgaaaggttgcacagctagttaacggcatcactttagaattttcctatgtctttttccctgatgatggctctgccgttttctcaaatacttagtttctaacgtggggatactttttgaatccttcttaattcttagtccctttataccatcattcagcaggttttattgattcttctttcaaggctcttggtattgacaactcacctgcatcttacttctgtttttagtttctcattaccccatccctgcatctcctaggttatcttaatagcttatctgatctacctctagtccactggttcttagctctggcttctcatcatattgacctggggcatgttaacaacagcagaagcccacctctgcctgccagtctttcccaccccgttctggttgaattggtctagggaggagcctctgtgggtatttttcaaatccaaatccacaggtgatgataatgggtacacaggattaaaaaccctttccagaaatgtttgccaccacccataaagcacttctttggcagtgtcaatatgatgcttgagaactttctgtgccttctcattgtcattagtttctagatatctgcttcttccaatcattcaatgcttttgtgactttaccttttggtaggaaccctatgctctagatatatcatttgcgtgtcagcttcaaaatcatctctgacaatatcctacattcgtttcaagttgtagagccctttgctctcctctctgcccatctaaaatccactggctccttaagggtatctcaagactaccttcctccaaggagccctgtctgactattctggtcattatttctgctacttgcctcaaatgctcttattctggtttgtactctcttattctaagtaagaattttcagctctttagtgagatggagagctcctcgagggaggaacaatgccatatatatatatatatattttttttctggagtccctacagcatcaaacaatggctgacatataagaggcaaatttggttaaacttggtagagacccaggagactagaagggagcttagagaattttcgtggcagccccttttccacaacagaaaggcaggcacagaatctcattcagacagacctaacattagctctcattccacaggtcctggctaccttatgtctccaggagaccgtgctagacatggcatttctgtagcccagcagcactggcatattagactacagtttgtgctgccaacataggtcacaattacaatgtgagaaaaaacactttgtagtaacagtaaaacttagatgaaccagaagcaactacctggaacattcaagtagccagttttcttccactcaacaattaacacagagatacattacatgagaataagtggataggcaggaaattatttaaaaaacaaaagggacccccccccctctttagattagattgagagtgtcagtgaaaatttgggccaccaatcttgtggcttctacaaccatctaaataaaaacctgcattgaaatttgctgtcagaatgatgacctcgttctgacaaacatcttgataaactgcaagatgtttattcatccattcacttacttattcagtctttcttgttgtcctcaatctgctaagcactgtacaaagaacctaggttcctggcttcaaggagtttgaataccacaaaggggaggaagtatgtggacactgataactatgctgcaaagcagagagtgagagagaacaggaaagaagcatgagggctatgagacttcagacgactgagagatcccttctgattgccggacttgggaaaggattcatggaggaggcaagctttggacctggatcttgaaggaggacaagatttggggaaagggtttactaagccaagaaaacagcatgtgcccaaccctgaaggtggggatgcaggtcaatgacaagtgttcccgtgtaactggaacacatctatgtaatggagtattgtgtgagataggagatgagagtgaatagcaggatggggccaaatcacggatggcttggggatgcacttaaaggtttttgttgggtgcagtggctcacacctgtaatcccaacactatggggggccaaggcaggcagatcacttgaggccaggagttcaagaccagcctggccaacatggtgaaaccctgtctctattaaaaatacaaaaagtagctgggggcggtggcatatgcctgtaattctagctacctgggagactgaggtgagaattgcctgaacccagaaggcagagattcccctgagccgagattgtgccactgcactccagcctgggtgaaagagcaagactgtctcaaaaaaaaaaaaaaaggttttctttttttttttagatggaaaagattttgagtggggcaatcctttaggacaactgtggcatcaatgagcagggaagatataccatagcagtatagcagtagggcaaacaagtaaaggctgtctaatccgggggagtgggcctgaactgggacagaatgacaatgggaatggaggagaggctgatgtgggaaatgaaagaagtatgctcacatctggggactggttgtacacacacacacacacacacacacacacacacacacacacacacacacgagtggggaagccagccaaggtagttttgagccaaccaggagggttgatggccccttaattaataggtgattcaagaggaggaatattttgggagggaaggtcatgaatacaattttcaatgcataaatgcagggtatctgggtagaattgtctagcaggcagtttgaagtcttgggatgaagctgtgaaatgaaggcaggggtggcaaacagacacaagagtcctctgcacagtgggacaggtggaaccatgagagcaagagagatcctgaaggaaagggtggggagggctgttatgggtggaaagagagttgaagaccccagaggagcaattgaacaggtaagagaaaatccagcgaatacactgaccaacagtgttagttgttacaggggctgacgggttgaatccgtcattagattttgttatcatagtgaaactggagatctttgaggggacttcgtcattggagtcttgataaaattcagattttaaaatgcagtatgtcacaggaaaagagaaattgggcagagcatgcctgtttccagaataccttatacatcagccgggaaaggaacccaagaaatgatttcaacaagagtgcgacatttttttgttttggtaacctacaagcaccccgttttccttaacccttccccatatagagagttactttagtgtagagatggtatcttactcatctttgcactctgaccacctctgcctctgaaaaaagaaagcagaaacaacagggcctgggcccccatggctggagctaagtagaagctctagttatccgaggtgggtgtccacactgggtgggttcctggagtggctcagaacatggggaggcatgtggggagggcctatagagaggtccatggagtagcaggcgaaggccacttcccacccacaatccacacaaagccatcatgtcttgagtgctatgtgcctggcattgcgccagtcctctccactccttttctaacttgcttcccagcctatctctgggtggtgcaaccactttttcatctagaaaatgggtaattatttttgaagcccctctctggcttccaaattgcttttctctctggttctcttcctgtctctcagattgccctctcctgattttcttcaccaacttctcttacttccctgtccaatgtggctttgtcatctggcgctcctctctctgtatgcagtgggtgctctctgggagagctcagccccacttatggctccaagtcctttccaggactccccaaatgctccggctccagctcctgagtgcctcatccaagtgccctgtttctgggcttcctcacttaagtgtctctcaggcctctgaagctcagtaagtccaaaattcccctcatcatccttctgcctaagcttggcccttcacttgtgtttcctgttagcttcctgacatcatctcccacccagcccagggccacagtcctcctctctgatcctgtccttcacattcattattcaccaaccttctttattttcatcaatgaaatgactgaaatatccccaatatccaaccccaatgtgctatttccaccaccactttcttaattccagccctcacgtcatttgcttcaacttctgcaataacattttaactgcctgcatttttctataaagcccatcttaaatactactgaggtatatttccaaatacagatgtttttaccctcccattaaaaaatttcttttggtgacatctgattatataaacctcagattccttcgcttgggatagaaggtatttttttcttttcttttcttttcttttgagacagggtcccactctgtcacccaggctggagtacagtggtgcaatcatcgctcgttgcagcctcaaactactgggctcaagaaatcctcttgcctcagtttcccaagtagatggaactacagtcatgtgcttgcacacctggctaattgtttatttttttgtatagataaggccttgctatgttgcccaggctagtctcaatcttttggcctcaagcgatcctcctgccttggcctcctaaaatgttgggattacagctgtgagccaccgtgcccagccagaaggctattttttaaagggctcctctttcattttggctatccccctttgccatttagcctatgttatagctgttctgaacacatctccctgactttccttgaaccatttcgtctgcttggaaacaaacaggcttatcttttttccactctggtgaaagcaatgcccagctaaaattttaccacttgggtagaattttctacaattctgctaagcagattagtttactgcctgctttgggttcttatcaccctttgctgatactattgatcttgccccattatgtaattatctccctgtcttccatcctagcttatgaatggacatagcagagcctttttattaatctttatatccctagcaatgagcaacaggcctggggtcacaggtggtgcttgacagatgcttatggaactgaactgaaaccacaaagagccctctctctctttttttaaagttaatgactctagtgaattgactcaggcctcctcatccccatggattacagactagttaaagtaaattatatggcaagcatagacttttcttttgtcagaaacagaaatctatccctccttaacctacagtcattggactagatttccccaataagtattccatggctttatcccttttctagcacattgcaactttctcctttatgccttaacttagctatgtagttttccctgatcagcaagttaccttttgagagacatactttggagaaatgatacatttaaaatttgtttttgtagatagcttcaaggaatgactgtgatggttttgtgtgtgtgtgtgtgtgtgtgtgtgtgtatctacataaatttatataagcataaaactttttgataagaaaatgtttagtagtaagccaattaaataatttacttaatgaataatgttgtcttttatgttaaattctagccagtcctggatggtaattagcagggtcattaacaattggaaaatatgtttcagaaaaaattcagagagccagtttaaaagaatttggtggaggggtgcttagccatggttgtgacagtgtgaatgggatagaatcaaaccagaattgagaagtgtgtcagtttgatttatacttatatggctaaccatggagactgagcatgagtacagtttctgctaaaaagccaaagtgacatataaaatcccagtccagttaaattgcggcagtagctacatgccactgcagaatgtgacagtgaaatgtgggctgctctagggatgtatttcaggggtaaaaagttgcttgaaccatggttgcaaggctatcatctacattctgattttttaaaaaattatgggttacattttctttccttgagattttttaaccaaggctaaaatatagccaacacttgagaatattccttttgaaacagtagcgaatactaactcgatgtaaagttatgactactttaaaaaaaatagtcacaattgggcccttaaaattttttttttctttaaacttggtgcatcactgagtatggaggaaggaaggtgacaggatcttgtcctgattggataactgccacagagcaggctgggaaatacccatgatgccaggtggagtttggagtttctagggctagaaggtctggcaactgtggctctctttctatcggacacaaaaaggatagcttaggttacagctgtctatactttggctgagaggaaacaaatttagtgacttgcactgaatcccagggaggatgctctgaaatatgtggggtggaacgcggccagtgctgctctgctgttctctacctgcttccttcctgctggggtcattctaggctggcccctgctagaatgcggtgcatctcaaattttcatgaatctgcaaatcttatccttatcacttataaggtctgagctatacatatattccagaactctagaaataattagacaagctactatgaaagagaaagcattatacatcagttaaaaacatatgcaaaaccaaggctcattagagaaagataatattcatgcagattttacaaaccgtgtctttagggtggcccaataagtagaaatatggggacccatgcttgtcacttttcatgcacatggagagactggaaggtaccattcctaaaggaaggggaggaacagcctaggaccaatcattagaattaacagaaccagtaacaaagatatattattactgttagaatcaagattgcttagtatgtttagagcagttgaataaaaattatctaggcagtaagaataaagactttaagtaaagctaaccctatcaagcatgcagcaagtgaaattagtgaaagactgagctatatgtgtatttcaaaagtagacttttctcaaaatattgagggcatcctgaggtgctttaatggaggcacaaatgttaataaaatttgaaatggtaatatgtaaattcttgtaggcttttctcataataatgagatgttttagggatatcaactgtcatttgagaatcagtcacagtaatcatttctaaattttaaaaggattataaaaataaatacgtagtgtccccatgtttatattttctctaataatctcataaattcatagagttccccttaccactaaaactttgcgtattaaattcaaaattcatggtcaggcacggtggctcatgcctgtaatcctagcactctgggaggccgaggtgggcggaacatttgaggtcaggagttcaagaccagcctggccaacatggtgaaacgccatctctgctaaaaatataaaaattagctgggcaggttggtgtgcgcctgtagtcccatctacttaggaggttgaggcaagagaatcacttgaacccgggaggcagaggttgcagtgagccgacatagcaccactgcactccagcctgggcatcagaatgagactctgtcttaaaaaaaaaaaaaaattcatagttgacttgctggatataattgctttctggaagaaaataaagctgaaaaaaaaatgcagcagtgtcttgcctgttctgttccactgtactcacctgctgtgggttgtgctctgaaaccaacctcttcgtggtggtcttggtctgaatctagctcagatcatggactacagttctttacctatacaaagatgagtactagaaattctggaatatctagattagtaatttccaagagacaggcccctagaagaggcaacaactgcttcctgcactgcctgtgttctctcagctctgctcagggtgagataagggggatgtgctcattgtgaggttaatgtgatcagaagaacttaatccatgcagcttggatgtgttgaggcctgatttcctctttgccagcaaacactgattctccccgtctgcatgcccaacttgctccacacgtggtgctatgtatatacggcttcaatgtgcagaatggaattgcactccacatcaattttgggttttgccacatggggtgtttttcatagcacggtgtgtttgaggaaagggagagtgcaggcggagccctaacacctcgaggttaaatggaaagtagaacctctggagggtaaggaagcacatgcttaacaataaatgtcagaagtagaaattaaatttcacgatttattaattgagtttaccacttagccctgccaagatgcaagtaattttgtgcaaaaatgatcaagctgtttcagtgtcacacagcgaaggctctcatttggttttaaacatggcctttactgggcttggaagatacacgtgccaggagacctcatgcccagaaggtcaaataaaagtgcccagagcatggtggaaataaattgctgtgaaggctggagtagaaactgcagtgaaatgtgagaaacagagagttgcatactgtgctaggcatattaatgcatacattatgagtgtatgtgtccaatcctaaaacccaggatcccaataaggccagggtcactcttgaagagtgcatgctgaaccgaccagagaccttgctacagaactgtaaaggcaggttattttgaaagcaaatgtctgagccactttatagttaacagctatttagtctgggctaagtgtgcatttgttgttctattaaaaaaatattgaatccaaacagcacattgatgaatgtgtgattcttaagtttagagattttgttgtagttagagcatacaattaaagcctggagtaaggcattatatgactttatttctgatcctgactgaaggtctatagttaaatattgggagttcttatcagaacaggacattggggcaatgctaacttcgagcaaggttgtaggcagtttgtgaataacaaaaatctggacttatggtaaaaaatacagagataataagacggttattggttgccaggggtgggtgtggagggaatggatgaatagatggagcacagagggtttttagggcagtgacactattctgtatgatactacaaaggtggacacgtcattagacatttgtctacacccatagaatgtgcaacagtggtctccaacaattttggcaacagggactagttttgtggaagagaatttttccatagaccaggtgggggtagggggatggtttcaggatgaaactgttccacctcagatcctcagagcatcaggcattacatgctcataaggagcaggcaacctagatcccttgcatgtgccattcgcagtagggtttgcgcccctatgagaatctaatgctgccactgatctgacaggaggtggagctcaggcagtaatgctcccgtgcccactgctcacctcctgctatgtggcccggttcctaacagaccatggaccagtcaggatctgcagcccaggggttggggacccctgatatacaacactaagactgaaccctagtgtcaactgtggactctgagtgataacaatgtgtcaatgtaggttcctcagttgtaacaaatgcacactgtggtgggggtgctgatcatgggggtggctgtgcatgaatgggggcagggagtatatgggaaatctctgtgcctttctctcaaatttgctgtgaacctaaaactgctctaaaaaatcaagtcttaaaaaaaggtggccttatggactcacctgtttgttccactggaaatgaggggtttagagtactttggttaaaaaattaaagcttgagttatttgactaggggaaaccaggacagggcagtaggcatgggcctggctgaagtgatgccttggagactggacccttgctggtgatggcaattggttggacttaccctggaatttgtcttaagatactggactgtactttgagcagccgggctttgttgttaaactccttaagatcaacatcttttctgtaatgtctctatttcaagacatgagaaaatgagactggagaaaacagctttggcatgtagcaccaacttcttaataggtccagctgagaggttcgaagccttttctggaatcaacattctcacattgtgaactacagggccagactctccgtaatgaggagagctcagattgtcaaaaaggcctgatatggaaaatgggaagacaatgggaggaaaatctagtttcctttctctaagttgcaagggctgacaagtcatagaatggagagcaattcagacttgatgggcaaaggctgaaggggtggggcacactcaaatagtgggaggccatggacagaaagaggacaacaagtagaaacttcggcaggcctggcctttacaatagagctagagcagatacgtccggcaatccccaggatatattccctgaaatccctggaatgatattaatattttaaaaatatagagtcctggactgaactgactcagtcagaatctccagagggtatgtggagagcgagagggaatgcaggcatctgtgtatttaaaaggctgaatcatttctctaagactgtgtgtgtatgtgtgtttgtgtatgtgtatgtgtgtatgtgtgtgtgtgagagagagagagattgaaagaaagagagaggagagagagagagagagagagagagagagagaggcttctgattcctcttaaagaagtgttaatttttctcctcttctgcattttaggattttcttagtttccatatttgatcttgtcccttgatcctcaatctcaactcctcaccccacaatccccggttgtgtaagaaaaattttcttgaattggtgacttctttaaggtcttccccatagttcttacagtattcagcaatgtttccactgagacagctgccttttctcctggactcttagggaaagcagccctcttgcgggagagctcaactttgtgttggggcaaggaagggaatgttcctattagatcctaaaatatgactcttcatgatgggttactggaggagctggaacctttaggttttccaagatgtacatgggtgctcttcttgatgaagtttgggaaaaatacctctttattcactcatcttctccacgacttaagtgtttgggaattgaggaaggctggaccttaatagctaaacaggttcttcttggtagatttcttggtcactataaacacacacacacacatacacacacacacacacacacatatatgtgtgtgtatatatatacacacatatatatacacacacacacatatatatatatatatatatatatatatatatatatatatatatacacacacacacacagacattctgtccccttccctaggtgctttatcattttctattacgcagtggaaggtgttcttgagtgatttgtggaacctctcatggaaaaggaagatatgctcaaccatgaatgtcagaagctgaaattaaatttcagaatttattattgcagcaagccaccttttgccctatgtgtgtgtgtatatatatatgtgtatatatatatgtgtatatatatgtgtgtgtatatatgtgtgtatatatatgtgtgtgtatatatgtgtgtgtatatatatgtgtgtatatatgtatatatgtgtacatatgtatatatgtgtatatatgtatatatatgtgtgtatatatgtgtatatatatgtgtatatatgtgtatatatatatgtgtgtgtgtgtgtatatatatatatattttttttttttttttagacggagtctcactctgtcacccaggctggagtgcaatggcatgatcttggctcactgaaacctctgcctcccgggttcaaactaattctcctgcctcagcctcccgagtagctaggattacaggcacatgccaccacacccggctgatttcaggcatgtgccaccacacctggctgatttttgtatttttagtagagatggggtttcaccatgttggccaggctggtttagaattcctgacctcaggtgatccactcacctcggcctcccaaagtgctaggattacaggaatgagccactgtacccggtctggtctaatatatttttatcagagtcttaaatacctaacaagttaggacttgcaggttgtgggcagggcacaaaatatccttaaaaagaaaaatgcttgttgcaaatcatgtaagaatatgtaaaaaagaagaaatatcattatagtccgtgattttcaataaaacaataggaagaaatgtgatttcatcctcatcctaaaatcacttacgataacaaatgaggttttggctgagcatcagggaaaaggaattcagtgttgtgttctttaagaaagcccctggctgggcctggtggctcatgcctgtaatcccagcactttgggaggctaaggagggcagatcacctgaggtcaggagtttgagaccagcctagccaacatggtgaaacccggtctctactaaaaatacaaaaaattagttgggcatggtggtgcatacctgtagtcccagctactcaggaggctgaagcaggaggatcgcttgaacctgggaggtggagtctgcagtgagctgagatcacaccgttgtactccagcctggactacagagccagaccctgtccccgctgccagaaaaaaaagaaagcccctgtctctggctccatgaagcaagaacttatttactgcagtttttatggttagcggatttcctggggttgcctacatgctgcagagagcatcctgagcctttcagctaggaagaaccctgttctctgtatgatgtaacccaaggttctgccagacattctgtccccttccctaggtgctttatcattttctattgcgcggtggaaggtgttcttgagtgatttgtggaagctctcatggaaaaggaagatacgctcaaccgtgaatgtcagaagctgaaattaaatttcagaatttattattgcagcaagtcaccttttgccctattaaaaatgcaggtgaattagtgccaaggctatggtgccacttaaaacttccatcaacgtggtctctgaggaacaggttagggcagtggtgaccgtcctttgtcttttattgaggaggcacgtcagcacaccaaggcagacccagggtgtgaggtaacacgtccgggctcccagaagtggctgatggccaccggaggggaagagtgaatttgatagatgaagttttggctcattaaattataatttagaaataattcagacaaggtctcagtagagatttacccccactcagcaagttctttcttcagaaaaactactaattattagtacaaatattataaaggaaattcttaacaaactgaagaagccaagtgctcttcaaggattcttaacactctagaagtacttgttaaattctacaaataattaataaaacccatttaaatgtttttcatgagagcagatcctttgagacctttttatgagtcactactctgctaaaaacacatttcttcattattagtgtcagctcactgaggaccaggactacattttaccttcagtgcctgcaaagcatcctgcacatagtaggtgttaagtaaatctgatttagttgaggaaatactaattatatcaactaataatattaatcacaggatttgttccatatagagtacttggtaggaatatattgtctggagtttatttttgtatcattagagggaagaaaggatgtactcagcagataatagcaaaaaagattataatggcatacttataacatttacttggcaatattttttctttcttttgagttggggtcttgctctgtcgcccaggctggtgtgcagtggcacgatcatggctcattgcattctcaacttcctgtgcttaagtgatcctcctgagtagctgggaccacaggagtatgccaccacgcttggctaatttttttgtagagacaaggtctccctatgttgcctcttctgttgaactcctaggctcaagcagtcctcctgccttggcctcccaaagtgttaggattagaggtgtgagccaccccgcctggctggcaatatatgttcttaaagaagaataaacaaatgaccattacttattgctatctacatagaggccagtactgcttcacctgctgctctaatataattgttgtaagtcattttaacttactgattaaaggaagacttttaactaaacaactgtttgatccattcatttctttacctatagtcactagctcagatcgatctgtttctccaattagtgcagttttattatacttacaaaacgtaaacaatttcatttaccaagtgcttgtagtcaagccaaaacctattatattaaagaaacgattaactttgaaaatgaaagcgtaggcagaagtataattcactgattggctgtttctcccccttggtgtgggtatgtggcattagttgtcgctgggccattttcattgtgagatttctgcttcatcctctttaaccctgcttggcctcctaagaccaccgagactcccacttacaactggactctcttcagtgttctattcataaagccctgccctatggctttttaagagaataaacaggccagagcaccaacccagactaaaaagcatgttcctattatattttgctttattctgattaactttgaacagcagtcattaacaagggaaaggctccactttggtctgaactgcttatgttgggaattttttcatccagcggcacctctatttaccttggccctgactctgtggctcagttgataaatcaagtgtatgttcgtgttgtactctttgaatgctaatgaaggaagcctgcatttcaaggcagggagctaatctgtataatttattcctgtgcagttttacaaccatgatgcatacttccttttctcttaacctttgtggatttcatttgaatagcaataaccagggtgaaggagggcactgcttttgatgcatcttctgattctcttctcagtatggcattgagatgtgtatcaggggaggggaactcacgcttcccactgagtttacaatcaacaaattcttatcctgaggactggagtggagttgaagtatctatctcctgagcttgtctttcaaggacttaactatgaaagcaactcctccttcaaagcccttatcattttccgactcctcttgcagctgctccacaacctctgtgtgcagccactactttcggggtggcatttgttgatttctacctctgaattggctgaggtggcacctgacgtttagtctttgggtaattagagatgacatatttgcggcatgtttactccttcccccagctcacttggagtcatgctgattttgtttagtcaatgctctgacagatcgcctttggtattttttcaattgtacctaggcttatctctcggtcacagatcaccttgagaactcagagtgagaaattttatttctcttgactgaaatcagctttttcttgacatgtccagaagtccagataagggtcttgcttcaaagctgtcctgaattttgaatcatagggatatcaaaaggaggactggttgaaatccttccacagggagtggttaaaaaaaaaatcggttttcccatgattagggtgcattaggaaaaagtaggattatattcttggctatatctactggttaaactcaagtatttaattttccttttccattagcactttcttttgttgttattgttgctattattttgctgttacccaattctgctacttaagaatttattaagatatactctagtttatcttagacaaaaagaattctttttttaaatgaaagcataaagttggtgaaagaagacaagaaattctgtttcatgatataatctatttgatgctggaggaattatggtgttcctagcagtgggcactccttgtatgtagtggtcacttgtatagttcatagatgtggccacttctctggcttgcttctggcgcagaaaaggttaacagagcaggcctgagactgctctccttagaaaggccagctttcgaggttggccattggctggtgcctggtgcctggaaatgtgactggtaaatcatcccctaagctaatgtaaacattttactaaattataagtgtgtctcgctgtatctaaactgtttgtacaatcagtgtggtttgtgctgaacctgctttgcttctgggagtctggaagtgtggtatgtgctgggcagagggtccctgcatcaccggctctagtgaaaaccttgggcactgagtctccagggaattttcttgagcagcaatgtcacacatacgttgctgcatttttgttgctgggtggaaagagtgttctgggtgacaccttgtgtgagagagacagcatatggaagcctgcatgtggattcctccagaccccgcctgtgtcttttcccttgtgagcccaatgtgtattttcactatattgatgtaataaatcttttttttttttttttttgagacggagtctcgctctgtcacccaggctggagtgcagtggcacgatctctgctcactgcaagctctgcctcccaggttcatgccattctcctgcctcagcctcctgagtagctgggactacaggcgcccaccaccacacccggctaattttttgtatttttagtagagacggggtttcaccgtgttagccaggatggtctcgatctcctgacctcgtgatctgcccacctcggcctcccaaaatgctgggattacaggcgtgagccaccacacctgctgatgtaataaatcttagctgtgagcacagttatattctgtgccccaggaggcctcctagaaaatctctaaatgtgaaggtggtcttggggactcctgggccccatctgcccacccatcagtcactatgaaattccagaaatatcacttgatgacattatcctcaaagatgctatgatccttaatcttggtttcttatgcataaccaagcacctttcagcttagattttgccagacaactaacatttatttagtttgactattgttttacttccttaaaggagattgttctatgctattaagttctttcttttgtgatatcatctctaaagtttttacagtcaaaatccatctcaatttaatatcaaaagtagcagacaagtgctaatattactagcaagtatgatttaatgttccactttagaagaatatatttagaagaaattctgcaatattgctacagttaacaatgctgatgattggccactcaaaagcgtgcccaggctgggtgcggtggctcatgcctgtaatcccagcactttggaaggctgagatgggcggattgttctgagcccaggagttcaagaccatcctgggcgacatggtgaaaccccatctctacaaaaatacaaacaattagctgggcattggtggcttgcacctgtagtcccagctactcaggaggctgaggctgaagaatcgcttgagcctggttagcagaggttgcagtgaaccaagatcacaccactccactccagtctgggcgacagagaccttgtttcaaaaaaaaaaaaaaaaaaaggtgtgcctggatatttaaaaaactctggttaatttgagaatttcactgtaatcatatctttttaggtgatgttaagaattaatgaaataaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaagaattaatgaaataatgttgacacgatcttgaatttttgtcttgttcaaaaacatgtttttatttcttcttcatgatagcttgaggtggcttcacatttgttcattacagtttgagttatgccacaggctgatcagtagtatgttctacttgctcactacagacaagcagctgatgtggtggatgctgagaaagcggggaccaatagtgattctacagaaaaatgaaaagctcaggatagtcatgcaggttagattaactttttaaagataaacttgttagaacaacattaactctgtgaaaatgtctgggtatagataatattcaggtctcaccatggagtgaagcataccattaaaggtggtatgttttagaagtgatagaatttcacaggtcactttgatattactgaatcagtcaatgctctagagtgcaaaaggttattctattccaagagttcagattctttacaaagggattaatgctggtacattttagcaggatcatgcctgtgcttattgataatatatatatatatatttaaaaatattttattagatccaagcattaagggtaggaatctggaatgaaatgtttccttgggcctagagccagccctgcagaaacttctgaatgctttttgactcactgtgaaggcttgctagctctctctgtacgctttgaggggtgcacaagatgctggaaacaacgcatttaaggtctttgagtttagatatttcatttgaactcagggtatagatctgccctgctaagtaaggagatattagctatttagacaatgtatgcaaaaagaataatctgaaatgaaaagtactctttagaatgtttttttttttttttttttttgagacagagtttcgctcttgttgcccagactggagtgtaatggtgtggtctcagctcactgcaatctccgcctcctgggttcaagcgattcttctgcttcagcctcccgagtacatgggattataggcatgtgccaccatgcctggctaattttgtatttttagtagagacggggtttctccatgttggtcaggctggtcttgaactcctgacctcaggtgatccgcctgcctaggcctcccaaagtgctgggattacaggtgtgagccactgcgcccaccctagaaatcttttttttttttgggtaggtgatagaaggatgaaagtgagtcaatttatcttaatcaacttagagctcattattcaggtcagcagttagatcttgttttcctaatctgaacaggtattatctgcactagtctgatgtgtctgtatgcccgtctgtttctgtctgtcactcactgagattatctttaaaggccacctcaagttttggtgcttttcatgtaatgaccactcagctgttttggatacactagagctatgctgtcagtagtgtctataatgggctgctgggaaacaacaactttaaagatgtttgaagacaaatccatgaatcaaaacatgctttaaagccttcctcaaaagcatacagaaacacaacacaggagtgaattttcagaataattcctaaatgtcaaagaaatgcaaccattgcgtgaactgaagtttacattttaaacttcacaccctgaagatatgttgcttgtctctggccccagttacaaatcctttgagatagtctgatgcataaacaatgttaggaaataattgataaattactgtgtactcaaatgaacagtggactatcagtcaaattgtaacagttctaatatttaagtggtgctagatctcctcgcacactcacagatgccctgaaaggtcctacatttcatattttaaacattccttaatggagggagcaaaagaaagagttcacacacatttatttcctgggcataaacatacgtgtgtgtgtgtatgtgtgtgtgtgtgtgtgtgtgtgtatatatatacctattgatagctaaatatatatttaggtagaagtggagaactgatgtagttttataaataaccataagcatttatggttcacagaaggaagagcaaaagggtgaattaaaacgtgaaacgtaccatattctgggacctgtcccgtgcctctcttgagcagcagcctcactcgtcttcctccagatttgatgagttctattgctctggcatgtgtcatgtcccttgtgctttccccattgatttcaatgatttgatctcctacctgttgattaaagaaaaattaagtcagccaaagatggttttactcaagttgcattgtcaacagattaaaaaaaaagcatgtctagatgacctgagagcatccgaacaatttggtggcagcctgctgctttttggaagaggctattccctggctgcatcctgaatctgatcaccaaattttatttacctttacagaaatgaaaatatcagaccacaaagactgcagccatatgttacttattatgttacttattacttattatgacagagactgtaaactagttagcattgttttaaaaattagggaatatatctgatacaaaaattcaaaataacctggcatctttgctttgaatcaaaaagtaaacattttaagggcttttcattgattctattgccaactgtcaacttagtgcagcatccaattcagcatgttggataaatttattggtttttgtgcttctctgagaattttttgtatgtatcatttaaatttccctgggtgctgttgtgatattgccttctttgtaaacagtggttggttggtattcacatttgatgatgagttttctatcacagccccttgaattaaaaatgagattctccattctctccacatgactaatgccctggctaaatctttgccatgctcacacttgattgccagaagctgtctggttaaataccaattcctcctaaattttcagaaatgcctgggttccataagcaattcccttttggcgtttgtgaatagatagttgaaataaaagaggttcaaccatgagcacatcatgtaactcccacagtaccattactgtcaggaacccttgaattaaaaaatgtctcatctcagtgcaagtaacataagacaaattaaccagcaaaagcacaacgagttgctttgcaaaaatgctattttagttaggtcccttaaagcagatctcagtctaaactctgtaatgcaaacagaactgtagaaaaactctttatagctaatcattatcagtgtggatgctgcaggctggctgagaataggaacacaaattttccatcacaatggcaggagagcctgaaaacaagacccccaaagtcggggggaagaacatgtttgttgtagcaaggaaatgacatctctacctaaggatgattctctaagtggtaagggttccactgtaatgaaggtaaagaccttcctttgtatactcagctgcctttagaagtatggatttggggcagtggatgaggtttacctcactggtatgacttccacattccacagaaaaaccaagaagacggaactaacttaactgttttagggccagtagctttcttcaggtttccttaattgtctcctttcctctgaggcaacgggcataacttgaatagtttgccagaggccatgtatctaagccagaggcagaaatgggaccaattatccctcccccagtagccctctcccacaacagaaacctcatggcacagaattaaactgaaaaagtaaaatagcagttccaatgaagttacatatagaaaaagtgttccttcctggctagactctcttctgagcttcagactcacacgtccagctgattactaaacatcgtcacctcattgtctgtccaacagcaactctaactcaacagcagtagaagcagtagacagggctaactacctttctcccaaagtggttcttcctcttaattcccaatcctggttaatggcaacaccattcacccaagcagaaacctgggggtcacgctacactccttgttttctcaacttctctgcatctgtccctgtcctcatatgtatcccatcgctcacaagctcaattcaggcctttacatggttattccagtattcccctgtccctctcccgccaacctcttttcattgtcaccagagtaatccttctaaggaaaagcttgccaaatgtgtcatgctgactgaagcattcaggcctgtacacatactgctgttcttttttctcctcctccccacaggcctggtgatttcttgttctttctgaaggtaataagaatcttctcctatgggtgccttcctcgactctatgctcttcacaagcagagatgtccactctctctgttcagtagtaatggcaccccactctgattattatgcctcattacagattcatgagtctctgtcttccctcctaggttttgagtgtcttcattcagtaaataatttctgagcacctgttatgtaccagacagtcaactggggatatagagagaaatggtatcatttctatgtacagtaagttctcagtctagttgggaagaaaatgggtaaataaggctattactactcaatgtatctttgctatgacagaggcattcacaaagtactaagggcacagaaagaacagacatctaacccagaaagtgggggtggtgggtagtcagggagagctgccaggaggtggtgacatatcggttgagttttgaagtgccagtaggagttccctaggcaaagaggaaagcattctaggcagagagagtagcatatgtaaaggctgcaaagtttgagggaatggtatatttgggaaactgtcagtagtttattatactgttcaggagtttaggttttattttaaaggcaatggcaaggcactaaaaagttaagcatggggtaacctgaccggggaagctgagtggtggttagaaatctccctgtgacctcactatggaaagtggaagaagagaaagctggaagactgaggaagggagttgagttgcggtgttgtcacatggtctatccaagtgagacattaggaggctgtggggaaggagatgatgaggacaatgacacagagtctgggtctcttttaactgtgtgtctggatgaggtgcactgaatatattggtgaatgagtgaagtacttccacatgggttatcttgaacccatgggagagggaggtataaaccccctcgaaccccaaatcgaatcttgacagccactgccgccttgtggttacttgtgtcctgagactgacattttaaccaaaaaccatgtggagggcaaaagggatcttgtattgtgatagaaatagtcccgtcttttgactctggtcccatacttgagtttagcaagacttagaaaatttgaagttttcattcacttgtgtgtttattttcccttttccctacaaggaacttatgagacttaaaggagaaggcattagcctggaggagagaagcggtggtttgaaagctacgggggaggaggagaagcagaggggtttaggggctgcgtaagggctgagctgaagtcccctctgtgggggcctcaggaatgaggctccgggaagtcagggacattatttttatcgggttcccaggagcctgggctgacctcttcacctggcagatttccataatttcggctttccatgtagggtcccctcagagggagaggctctgatacatgctgaatctctcctatgccctttccccattccagggtatcagtgccattgggtggtgagggttgtgtctactgattttctgcctcattttggagcaacggaagtttgggaatagttcaagatcttactaaatcgaggaaaaaacatttctaggggctggtggtggttaggtaatggaacgaaaatgctgctgctgacatagactctgaccgttgcaaagcactctgggcattattttaaaagtgggctgactcacggggacctggtttcaatggcaacagactcagtccagacctggcttcaagacttccatctctctttggaacagtatgaactgtgaaagggttgaattttcattttcattccaatatcagtattctgtataataattttaactggaactccctaaataaatttgggatgtgatctctttcactgtcatctggatatataagaagatcgacttatcgggggacagcaggaggtggggcaaggggttctcttgttactttcctactttccgacctcatctgacttcagtgcagtggccagtgtgtgacaaaagagtgtcactttccgctatcacaatcgggagaattaattttttaaaaccaatagaaaattcgcagcccttttagaaatgaagaaaaagaccaactgtgactctgatgtagtctctttctatactctctctgccacagagctatcttcaactgagctatgttactaaaatgaaacttctaagatctccactcattcttagagtatttttaaaatatcgagttccagttgagagggagagggagagggagaaggagatggtgggggggcgggggagggagggagggggggagagagagagagagagagagagagagagagagagagagagagacagagagagagacagagatactaaaaccagataaaggtaattcaggagtctctgtgtgcactgcattatgtgggtcaaggaaatgccaaatttaggaaactgatcaaaggacttaagaggaattctaagcactcatttttttcctatggaagaaatacttttatctgtggtccccttggggcaactaacaaccttagagtaatgtcacagggacaaggcggagcgggataactgctgtgtctaggtccccgcctagtaagttctgcattcctactcacacatttctgctcatacatcatagcggatttttctttaacaaaacaccaaatctttgaacttgcttggggctttccaggtaaaaaactttttctttttttgcctatggaaggccaaggcaggagaaggcaaacatctcataattccttatgttgttaatagttcaggttggaagaaaaaatttaaactctgtactgtatgcatttttgtagccaagtcatatataaagtatttggcttgtctcaatgaaatatttataagaattagattaaatcctggatttactttagccatgagtcatggcagtcccagctcaaagggttgcttggacatcgttacaaacgtgcttacctggttgtaatcagttaattgccctcatgttaccattgcatcctaagagcctattttgcatgatcatatatgactaaagtgatcccagattataactaggtatgaggaattgagcttctttggaatactataccaataaatcatgaataatctctattccttatttcatgatggacttagctatggacgatttttgtggctaatgatctgaggtcacaggctaatgccatcatcgttcctcccttataggctggtttctcccactgacactagacccctcatggacagggaacacacctattgtctctgtgtcatctatacctgccacagttcctgagaagtaggccctcggttaatcacagttgagtcaatgaatgtttggtttgcctttcagcgatagtaaacgtcttcatttgcatgccgtgtaagttaagctttagggcacctcagcatacctcaagctttcttgaaatactgccttacgcagttccatccaaatcatgacaatttcaatggtacttacaggagaccaaatgaggcttcagtactggtgacctacatacattggtagtgacaggtaaagttataggaaacaaatgctaggattgagagtaagaggaatggaggctgagtctgaatgaaataatgaagttccaggaaaaggaaaagtcagaattagggtctttgctgctgcagtcattgttatgggtgctctgacgctgggatgcctgtgccctaatggccctgatggaacaaaggacaggctgatttccaacttgatggtgatctttaatatctactggctgttttcatgattaactttgttcaatattatttaataaccattacaggaagaatatttttcaaggggttacactgaatgttttcattaaccttcccatttctttcattagatcgcgattgaattagatgggttccaagtgcctattacagggcctggcttttgttataaactgttaggctcagttgcctcagcaaggcacaggagcccataaaattagcaggtttttccagagagaaaacttctaatccaattggaaactgaaacacatgtttgagagcaccagaactgtgaattttatttgcttcaattcatttatgtattgaaaactgtctgagactctctttatgctatgttttagacagtaatcacttaaacagaaaacaggctgggcatgttggctcatgcctataatctcagttctttggaaggctgaagtgggaggactgcttgagtccaggaattcaagactagcctgaaacacatggcaaaacccgcatctctacaaaaaataaaaaacatttgccaggtgtggtggtgcatgcctagctactcaggaggctgaggtgggaggatcacttgagcccaggagttcgaggctgcagtgagccatgattgcacctctgtattccagcctggggaacaagtgtgaggacttatctctaaaacaaaacaaaataataaaactcccacacacacacacacacacacacacacacacaaacaaaacaaaatcaaacccaaaaaagtcccagcatctcttgagaaacttcatccaagcagaagtgtgaaatgacccttatggatgcacagaagagagaagaatccttcatcaaggttctgcctaagcacataacctgcttaggagggtcacaaaggtgaggggaaaaagctgctattggaagtgaaaggctgctgcaggattctgagaattcaccacttgatgcaggtggtacgccttctttggtgttgttattatttgtgtttagaaaagatgtagtcacagctcagaaaatatccggcctttgacttgagcacagtatcctatggtgggagtgtggccttgtctggacattcataacggggagctggctttagcaaagatttagggggagctctcccttccggagcctccatttctatttacaaaaatcctctaaattaaaatgtgaaaatataagtaaaattggaagatgacacagtatccctactgtggaagtagttgagctctaaattatgatctggtatcttcttcactgattccttcctttttccttgtcaactgttactgatattaatctcatacagagaattttattagatagcttctttctaaatctccttactcttctagggctctttttttttttaatttttaatgttttttttttttttgagatggagtttcactctgttgcccaggctggagtgcagtggcacgatcttggcccagtgcaacctccacttcctaggtttgagtgattatcctgcctcagcctcccgagtagctgggattacaggcgcactccaccacgcttggctaattttttgtattttcagtagagagggttttaccatgttggccaggctggtcttgaattcctgacctaagatgatctacctgccttggcctcccaaagtgctgggattacaggtgtaaggcaccgcacccggtctcttctagggctcttaactggggtttatgtttaattcttttaagttttcccctcccctagctctatgcatgctctctgggtgatcacttcccattattattattatttttttttttgagatagggtctcactttgtcacccaagctggagtgtagtggcgtgacctcggctcgctgcaacattgacctcccaggttcaagcaatcctcctgcctcagccccccaagtagctgggaccacaggcgtgcactactatgtctgactaatttttatatttttggtaaagacggggtttcgccatgttgcccaggctggtcttgagttactgagctcaagtgatccacccatttttagcctcccaaagtgctacgattacaggcgtgagctactgcgtctggcccttcctacctttctaaggtatttggcatgtttcctttttggtgcctttctctgtgctgttctttttgctagaatctgagtcctccttctccccacttcaaaaagggaaatcctacttatcttttaggaaccaaacttcagggatgatatcatccagacagccttttatgatcccagcagtctgggttgggtgccttttctgtgcatttctttagaagtattgacctttgccaataatattgtaagctctccaaggacaggaactctgtcacatgggaaataaccacatatatctgttcaacagatggatgaatgtttgaaaaaaggcatttttcagaaattatctttttggctgtatgctccttagagtttaaaccaaatgtaaacaaggtttataataaaattctaatttggtttcataatatatgtcaaccaggtttgatcatgatcaaataatatatgggaagtgcattgtaatctctaaatatacaaatgtaatctattattaatcatagtagttacaattaacaatagatcattataattatcataataacggtagaagagataaaaaaagtaataaatttttcataatgaacctgggagagaagcggttgagcttctgagggtgtattaaatggggaaatggggcaaatgatatttttctggaaatatcattgagaggttaaaaatgaaaacaaaacaaaacaaaaacaactcttctttttgataagcactgcctgatagaaattcttttaggacatgaatggtattttgtattccatgattttagatgaagttcttaggaaaagaatctcatgaatgttgggcagataatccaaaccctaaactaatacagagaaataactgcaagtgtggcaacagacatgaatgtgaagaaagagattttaaagacaagctggttggagcaaaacattttctacaaaggaaaaataactaccatcattacatttttcatatgctagtttgactgctcaggtgaaaagaaactggggcaatatcttaaaattatcggcctaagaatagaaagctatcactggcagctcagctagcttatccagttctcagaaatcacttatattaggtcatgaagtcagtttccctagttgactgaaaaataaacaaaaaggaaatcaaagaggaaactttctattgtgaactctgtatgagtgttatttctcttccttggatgtaattgagagaaaatgcgggattattattatgtatacttatctaatcagatacatttattttctggataagcattcggctttgtgcaatgacttctatactgactcatggtaacaattccttgttttcctgaagctaactgtcttgcatattgcatttacatttcaactttttagcaccttctctcctctctgacctctgcttctgtctttacatctctctctcagactgtgtgtgcaccagtcctagacctgacaagttaacagcatgaatgagcatgaaaaggtacaccaagatgggtggcggggacattggttagctgggattttgaagataatttaatgatgggactgttttcgaagaatgggcagggttaatgcaatcaaagagggctgttgaggcaatgaaggataaatatggtgagtgctgttaccacctctagtctgaaagacatcagggaggaaaagaagttacaggggctgagtgagagctggcgccatgaaagagaggctgcctgtctacagctggagctgtagcgggaaggaatgctgccaggcccacagcaccaaggcaggagcaaagggtaagaaataccccaacctctctgtggcagacagaataaagtcccccatccccagatgtccacctcctagtccctggaagctgtgttatgttcccttacatggcaaaaaggattttgcagatgtgcttaccttaaggatcttgagatgggacgattatccaggattgtttgggtgggcctaatataatcacaaaggtcaaagtctgagagagaaatgcaagacagaagcagaggtcagagaggacagaaggtgctaagctgctggctttgaagatggaggaaggaaatataagccaaggagtttctagaagctggaaaaggaaacgaaatgggttcctaccccagagtctccaaatggaaccagccctgctgacatggtactttgattttaacccagtgaaacaaaccgatttcagacttctgactccagaactgtaagacaatcgattagtgttgtttgtggtcatttattacagcaggaatagagaactaatgtactttctctctttctgccctctgatctcctgctgatgcttctcattggccaaatccaataggaagccagaaggcaagagtgtttgggtgatacagacatagccatcattcccccagagtagggcagagaagcaagtagaataaatctgggggagaaggtagaataaaggaagaacaagcactggggtggggtaggtgtgggatggaattgattttaaaacatcaaatatgccaaatatgccagacgaaggctttaagcaataattcaagaacaagacaaaaatcaaatggcagtctagctcaaatcctattggagaaactttttggaaacctttatttgttttaatattttactttaacatgtgtcgcctctataccattatagaaagaggagtggcgtcagggttactgagttgaatgctctttttaaaattgcctaagatgtcagagttacctttgcctctggtcagtttccaagtcccgtcagttctacatgtaccctgtctccagcagctgcctctcatttcccatttctcttgctgccattctacattggctgttcctctctttcccctcttctttccatccatatggttgccataattatatttcaaagagcatctctgattttgcctcactcctcctcaaacacctcccctcctgccccatgcttcttgaacagaatccaaactccttgacatgaggtgtaaatcctttaggaccttgtccctgtgaccttctggcttatcaccacccttctcttgtgtttagtctggcccacttgtacttcctccactcttccttcctcggcatttttgctgctgtcctcagccttccttgttatttttgtcattctccctggatccttcaatcccatctcctaatcatgcccattcttcaaggctctgctcaaatcctccaagaagccattgctggtcactccaggggaaatttatcctcccttctctgtgtgtccactgctcttacagctatgcctctcttatagcacttacagtcacactgcctgttagtctaggtatctgtgtatttattttccccactaccatttctgaacctactcaattataaactcttggaaagagggagtgtatctttgtatcttctagtagtagctggtgcattgccttgaaaataatagatgataaaaccttgcagtggggacaaattgattactgtgtagggcacaaatgattaatggcagagggagagtctttgggggaggtgagggtgtatgggagactggaggggggctttgaggcagcctgtgccttgctcactatggttttcctactgtcaactgaggtgcctggcacaagataagagcttcataaatatttcttaaatgaataagtaaatgctatctacttcactttggccaaaggcaaccttgaattctgagagaacaaagtcttaacaaaggtccctaatatttgttataatatgaagaaggcaaaaaaaatgtattgaggtaaaaacaacacaatcttctacttgcaaggagaggcaagcttacaaacagcaagcctgtgccagcaaccagctgaggaagacacagccacaaggtggaagcatctcttttctttctgaaataaccatgcctttgttggcataactggctgaaagcagacagactgatttttgcatttaccagtcctgtgagaagcactgggaaatacactcttatttatgatagttattctataactacctcccagtatacagcttgagagcagagatttgattgtatatttccacaatatcttttgtagcttttaacatcgtagtgactgatgtgtatgtgtgtgtatgtgtgtgtgtgtgtgtgtgtgtgtgataagagagtaagagtgaatgaataagagacagaatgatcgattgaatgatttgggggtaaattaaggaagtggttgctgataattattactctgcacccactgctatggtctgaatgtgtccctccaaattcatgtgtttgaaacagcccccagtgcaacagtgtagggaggcagagtctttgggaggtttttgggtcatgaatgggtgaatgctgctattaaaagggcttgcgggagtgggtttgtcctctcttgcccttctgccatctgccatgtgaggacacaagaacgtttataccagatattggtgccttgatcttggacttcccagaaaccagaactgtgagaaataaatttctctactttacaaattactcagtctcaggtattctgttatggtagcacaaacagactaagacaccaattaaagcatgcataggggcactgagggcaaggagctcatcttattaatctttttatctctggtttctcttatccttacttaaggtgatgacactgacctttgggaggaataggaatttatgaaagatctcatagcttataagtggaaataacaagaccagttgcaggttccctaattccaacacccagagctccttaccctttatgaagttgcttcagcattgcggaagtagggagtggggagaaaggcacaatagtaggattttacttggttcagagataaaggtttcttctacatgaagaagcagctatttgagattttatgatgtattgttaacctttgggacattgtttgcaaatacatattcatgtgttgcaaatagctttaaaacccaggttcatttaagcatgagtaggatgaaaaagaaagtctgattcacgtgtactgaggatagctgtaagtgtgaatacatctagttagtacttcatgggtctgaatttccctggtcactataactaccttctcttcaaataaatgttagttttgtccttagctttcaaaactacatgtgttaaagtttcagatcagtgggatcaccaatgtccttgtgcccaattttaacagtgcacaaggagtataccaagtgaaaaaactcatgtctctgaggtctactatctttgtttggccataataaaaatacagtctgtctctaatagcttgatttaaggtcagctcttcagagaatctgtactctttgccataatactcaatggtattgacaatgagtgcatggattatactgatttttctattgatatgctaacaaaataaatagaaagagtagcagtgcatcactatcattttgatgcacgaaataaacattatccattttactttctttgactatttaaagtcacatattaattacttaaattttacaactaggaatgtagccgagtgtctaaaaatcttgtttctgttcatgttaattcagattgtccatccatgcatgagaacagctgagctatgaaattgggcagcatgttttctggcaataatgaggagataatattccttaggagtatttaagtgacatcactattaataggttaattggaaataaaaacataaagctttcttaaatcactaaaataaaaagcctctggtttattgtagctttgcaatgtactttttgaactgtcccacttttcagtttcggttaataattgtctgattaatgtaactgcagctgctctcagaattccacatacatcccttggataatcagccatttcaaaaggagactttcccatgcatatgttgattcacagtcatactgttacctctattgctttaccaatttcttgaaaaaatgactcctgcatccaatgaagtattaggttggtgcaaatgtaattgcagttttggctgttgaaagtaatggcagggaaaccccgtctctactaaagaaatacaaaaaaattagctgggtgtggtggggggtgcctgtagtcccagctactcaggaggctgaggcaggagaatggcgtgaacctgggaggcagagcttgcagtgagcccagattgagccactgcactccagcctgggtgacagagcgggactccttctccaaaaaaaaaaaaaaaaaaaaaaaaaagaaagtaatggcaggtggggcgtggtggctcacatccataatcccaacactttgggaggccaaagtgggcagatcatttgaggtcaggaattcatgactagcctggccaatatgttgaaagtctgtctctattaaaaatgtaaaaaaaaatcatggtggcgcacgcctgtaatcccaactactctggaggctgaggcaggagaattgcttgaacctgggaggtggaagttgcaatgatccgagatcgtgccactgcactccaacctgggcaacagagtgagactccttctcaaaaaaaaaaaagtaagtaatggcaaagaccacaattacttttacaccaacctaacatatgtagaatatttggtggagaacaaaatacaatttgatgtgaagtcacaagagctgactacaattgggaagctgatataagaggcgccctccatgttcagaacccagagtaccacttgctgctatttaagagtttcataattggtttgaaacagatagctaaagtgatattactctatcatacgttctaactagacttaaattatttttagttctctgtgtgaacattgatacttatgccacgagatacatgcatttagatttccatttctacactgagatctcaattaattgcccaagagcttgttacggagttgtgaaccacccaaatgaaaaaatggacccttcataataattagcacttattcacatggttttatgccaggtacttttgaaatattatctcacttaattctcaaatcaagctactaagcaagcaagcaaccaaccaaccttctatgggctggagggagcagaaaaattcaaattagccctgaaaaatataattctaattcatatatatattttttccattgagaactgatcaatcaataaataatgtagaatgaacaccaccggtaccaagatatcaagttaatctttgcatgattatttagcttgagctctcccatgccactgactgtaccccttaatttgggttagacagatacctttaacactgtatgggtgactgttcaagaacaacttcagtccacttcatgatgcttcctctgtccatgtattttaattccttgagcgtattttctagttttctgttcttggttcctgccttaaactatggctcttgtcatttcttccattcaatttcttgcattttctagtaatctttggatatctttcagtgatactccctcaaacctgcctgaattcatcattatattgctacttgtggaggctggcccctcctgcattgtccctgtacaatcttgcattgttctttggtgtgatgctgcatagtcattttacaaatgtggaccacttgtcaccaaaggttggggtacaaatacatgaatgggaaccctaaaattcatcaccatttctacaaaaacaattccactggcctgtcctgacagaaaatccttattttcttatcacctttattttccaaggatatcacattattaatgtaactggtttgattgaactgtctgtagtcactgagagacaatgtgcaattgatttatttttccaataactgctaccagctgtgctgttgactcctgcccttttcccactgggtagcagcctaatcccattattttttcaacattttaatctattaaagtctagcacaattagcattgcaatcttcaattaaaatctctcccactctcattgcatactaggctgaaggcttgagctacttaagtggagaaagggccttattcttccctctctcccctctgcagccgccctctctctttctttatccctccagtcatctaaggaagtgctggtagcagggtatgtatgagggacaacataccctagagagatcaagagttgctggtggcaagtctgctctcttctttttgctggtgttctctgtatggcagatcttaatcaagtgcttactttgtgccaggtcatgttagatgctggggatagggtaagaagacatcaaggaagacaagatttctgacctcagagaattcaaattcagtgatatacttgctgtctctcgtgaggatgatttgggttacttttttggaagatagtaaatcttttttggaagacctctccatattgggagatacagatgagtctggcctcctcctctttcactcagcaccccttccccactatggatattccaaactacagcctcttcagtaggggtcactttagttagcaaatgccccaacaggctgaagccccaaatcaccttttgtagtgtccactcaacccatgggaaatggtgggagtgctggcttctctagaactacctctcttttctatcttttctcagttcttttctgcgatccctagctcatctgggtctctgctgattcaatggctcagctacttttagacaagaagcaatcataagtctcccatggagtagagggcaaggatggttcaaggatccccaattatgaaggaggagaacagggcatatatgatacctttttccctcatggagaatggggtgggatggagagaagggatggttaatgcttttaaaaattctgttatcccaagctcccaacagtcaccacaaggaggtggctggcctcactattggtgactctctaaataaaatgtgaggaacttagtctttatctttggctgtggcatgagtcataatttcctagacaactggaaggatctaggctgggaacttatattatcataccatgtggagagaaagaacagaataaaaacagggaactagataaagcttgtggattatctgttaattttaattactcattctcactctagaaaatggaaaagtgacttcattttcatttcttctttaagtccttattagccaaattgtaaaaagggttaccgactaatgtgtataacatgtttattcttaaaacctaatatgctaggttctattctgacagtatgttttgatcttttagttgttattgtttatacaggataactcacattgtgaaggcatgaaggacactgtggaggaagataatgtagcaatggtagcaatgttattaagagcacgggctttggtggaatcaggagtccttggtttgcaccttatgactaatatcacttattaacttagagatgttagacaagtcatttaacctctgcaaatctcagtttcctcctctgagaatgggaattatggtggtgtccatctcataaggttgttgagaagatcatagggctatgcaggtaaccttagcacagtgcctgacacatggtaagttttcaataaatgttagttacattaaaacttattcaataggaaactttcaaacttacctaaaacctgaccatataaaactctaataattggggttatcttctttattgagagttaacattggaattaatgtatgcatctctgagtttagagtaggggttggtaaactgtgacccataggtcaaatccagcccagtgcttgtttttttaagtaacattttattggaacacagccatgtttatttatttacatacagtctacagcttcttttgtactattactgcagtagagttgagtagttacatgagagactgcatgttcccaaagtccaaaatgtgaactatttgtccccttatagaaaaagtttgcccaaaggcaaaaattgacaaatgggatctaattaaacataagagcttatgcacagagaaagaaactatcaacagagtaaacaacctacagaatgggagaaaatatttgcaaactgtgcatctcataaaggtctaatatccagcatctataaggaacttaactttacaagagaacaaacaaccccattaaaaagtgggcaaaggacaagaacagacactttgcaaaagaagacacacatgtgcccaacaagcatatgaaaaaaaacctcaacatcactgatcattagagaaatgcaaatcaaaaccacaaggagatgccatctcaaaccagtcagaatgcctattactaaaaagtcaaaagccaacagatgctggtgaggttgtggagaaagggaaagcttatacactattggtggaagtgtaaattagttcatccattgtggaaagcggtatggcgattcctcaaagaactaaaaacagaactaccatttgacccagcaatcccattactgggtatgtactcagaggaatataagtcatcctataataaagacacatgcatgtgaatggacatcgtagcactatttacaatagcaaagacatggaatctacctaaatgcccatcattgacagatgtgataaagaaaatatggtacctacacaccgtggaataccatgcagccataaaaaagaatgagatcatgtcttttgtgggaacatagatggagctggaggctattatccttagcaaactaatacaggaacagaaatccaaatactgcatgttctcacttatagtgggagctaaatgataagaactcatgaatacaaataagggaacaacagacactggtgtctacttgagggtggagggtgggaggagggagaggagcagaaaagataactattgggtactgggcttaattcttgggtgacaaaataatctatacaacaaacccccatgacacatctttacttatgtaacaaaccttcacatgtatgcccaaacctaaaataaaagataaaaaaataaaaaatttgccaatccccagtctagaactttaaatttaggaaaggcaactacttatcttggctgacttgtgcactaatagacctgtgggtagggtgtatgtagctcacatgactttttaagaacccttctcagattcataaatctatgatgaaaaatttcgtgtgttattaaaattatgtaatattcatgtgttattaaagttatgtaatatttaaaaatattacagagttgagaataataaaacacccatctttgcactcaccagccagagtttaattaggttaatattgtgagagatttaattcaaactgttttgcataaaaatgtcttcaggatagagttggagccccttgcatgctttctgactttattcctctcctcacaaaggtaacggctattctgtaattgatgagtgtctttctagttccagtttttatgattttcactacatatgtacatatccataaggaatatacatgtagtatttcaagttttaaaactttacataaatagcattacatatgtgattctgcaacttgttttttgactcaacattacgttgttgcaatttagcaaatatagaagatatctgttcatatagaggatacagttcattttcactactacataattctctattatataaagtctacagtttttttattctattgacgtatatttagaattttccctctaatatttgcaattaaaaatcatgctgtaataaacattgctgaaaatgtatccttgtgtacattagcaaaaacgagatctatatacatagcagtggagttgctgatttgtagagtatatgtgcacccttaaatttatttgatgttgccaaattattttccaaagttgctgcatcaatttacaccaatttccagtagtgaccgtagtaagctcccagttctccacatccttgccaatgtttggagttgccagactttaaacttttgccaatttgatggatataaagtgctatcttactgctttaatttgcattttcctgatacggagtatgttttcagatatttattagccatttgaatttcttcattcataaattcttccttaagtactttgccaatttttttcccattaggttgtctttcttgtttttaattcatggagttttttttattatttatatgttctggatagcattctttatccccattttcaaatacaaatgatttccaaagtctttggttacataaagtgaataataatcagcatttcagtttaagaacaatacctatgctttatctctctacttcacttgtaaagtttcatgaaatgtattaagtatcagttcctaactcaaatattttaattgtaatttgcagacaaaggttttattagaagttaatccttagatgtttaagaggtcttctttagaaaatgaaaagcatttttctcaaagaattattcatataaatcaaagttcaaatttttaaccatttgacattttctttaatgaaatatttaggaaacaactgagttataaatgattaacttttttcccttaaattatacattttacaatagtgttctgtttaatgcccaattgcctattccagcctattcaaaaatgagttttgagtgtgcattgaattaaacagggagctttttaaaaccactctgttccttttcaaatttagatattcccaacacagatttgaaaacagtaatacatcactaaaaagataaggcttttacctaatagaagaactgtataatgccatgtgttattatcatgatctatataaaattgtgtaaaatatgaggttccccaaactcttattccataattcaccttgctgcaccaagaaacaatacctttgttagcatagaaagctatgatatacttccttgtggtattgttttaactgttaccatgttctcttggacatttccaatgcatttctattttccaatttgccttttctcagtgtaagatttattgccacttgggtacttgggagacaaatggaaaatttacatgtattcatttcattccaggacactttaatgtgccaatgataatagtgtggtcaatttaaaaggagtgggaattcccacaaaggagtgggaatagaaacaactaacagtttaaaaaatgagtcactgattcttacactcttcttacagtggatgacaatattctctgtaatttcccatagtatacatctgagttgttattttcactagaggcctctaattcaccttcatgtgggagctcagatatgagacatacctgtttacaaagaagcctgcttgttcagtatgtccctctagggcgtaactatgagcctatgatatagtactttgcgtcgcttcccactggtgctcctctcagagtgtccaatatctactattcagtgtcaccatcccaactcctacttgacatgtcaggagggctgctttttccccacaaaaggatttgaagcacaatctgaatcatacaaccctgcattccaggctgagttatgcttgttccacatcctccttgggccacttctttttttctttttgagacaggaactcactctgtcacccaggctggagtgcagctgtgtgaacatgctcactgcagccttgacctcctgggctcaagtgattctcccacctcagcctcccaagtagctgggaccacaggcacatgccactgcacccagctaactttttaaattttttgtagagatgggggctcactatgttgatcaggctggtctcaaactcctgggctcaagtggtccttgtacctccgcctcccaaagtgctgggactaaaggtgtgagctactgcacccagccaagggccacctctttttaaaacaaagtttgggtatgatgttagatgtgtgcttgctatatgtcggtttcattattttgaggcatacagactggaaaggaagaagtaaaattgtctctgtttgcagatgacataatcttttaaatagaaaatactagagaatttaccagaaaagctgtcagaactaatatgtgaattcagtaaagttgcaagatacacaattaacatataaaaatcagttgcatttctatacattaacaatgttatatctgagaagaaatttttaaaaattccatttacaatagcatcaaaaagattaaaatacttagaaaaaaaaaagtaaccaaggaggtgaatgatccatatactgaaaactataaaacactgatggaagaaattgaaagagacacaaataaaggaaatgatatcctgtgttcatggattggaagaacaaatattgttataatgtccatactgcccaaatgatcaacagatttaatgtaatccataacaaaattccaatggcatttttcacaaaaatagaaaaagaaaatcctggaatttgcatagaaccctttgacctcaaattgccaaagcaatcttaagaatgaagagcaagctggagacataacacttcctgatttcaaattatattacaaggttatagtaactaaaacaatgttactgaaataaaaatagactcacagaccaatgaaacagagtagagaacccagaaataaactcatgcatatggggtcaactaatcttcaacaacatgagtgataagaatacacaatgaggaaaggattgtctcttcaataagtggagttaggaaaactaaattttcacatgcaaaagaatgaaattggacccttatcatacaccatacacataaatcaactcaaaatggattaaagacttaattataaaacctgaaaatttaaaactcctagaagaaaatatagggaagaagctccttgacattggttttggcaatgatattttggatatgacactaaaagcacaggaaacaaaaacaaaaataaatgggactgcatcaaaccaaagagcatttgcacagcaaagggaacctttgtaccactgttgatgggaatataaatcagtacagccatgatgaaaaatgtagtggcccctcagaaaattagaactcttattgaactagcatatgatccagtaatcctatttctggatatatatcggaaggaaatgaaatcagaatcttgaagaaatccgtgtatgcccatgttcattgcaccatattcacaatagccaagatacgaaaacaacctaagtatacatcaacaggtgaattttttaaaaaaatggaatatatatatgaatgtaactcagacttcaaccatcaggaaatcctgccatttgtgacaatgtgaatgaacttggaggacactatgctaagtgaaataagccagacacagaaagacaaatattgcatgatatcacttatatgtggaaccttaaaaagtgaaacttagagaaacagagtaaaatgatggttgtcaggggctgggggttggggaaaaggggagataatggtgaaagggtacaaacttgcagttacaagatgaataagttctagagatctaatgtacagcatggtaactatggttaatactgtattacatacttgaaatttgctaagagagtagatcttacatgttctcaccaccacaaaaaaattaatggtaactgttggatgatgggtatgtgaattagtttgattgtggaaatcatgcccaaggcacacttacgtcaaaatatcataatgtaccccttaaatacatatgatgttctatttgtcagtcatacttcaataaagctggaaaacatttaaaaaagaaaattatcttaaacttccccctttcccccacaaaaagacagtcccagacccaagtgacatcccacagcactgttggcttctgtctccggtaggactcacacaattttgcaagataagtaaccaaagcaaaagtcatcttaggctcaccaaaagggctacatagattagttacagaaaacaaggcaaggctaagcacactacctaacaatattactttttacttttcattaagcagtggaaagtcttttataaatgaaattttacttgagaaaggcaatagataatacataagagcagaactgctttgtctgaaacagggttgcgggtgtgaggtggtacgcagcgttctgctgattttacttccgtcttattttcctgcttccatacctacccggggggattctctggagtcctgaggattatctataatcttttccatatgataaaaaggcacttgggggatagggccatgtcttctgtcctgttctatgagactccttcttctatctggaattcctcctctctttcctcatatctacctgttgaagtcccattaaaatcccatttaaacttcacctcttttagggaatctcctcaagacaaaattgatctttcccactgcagatgatcagtgcttctgttacagctatagggattgcataccttagatattctgggacaatcccaatttttgatattagatcccaatatgctcttacattcatttacttctcagatcacattttaatttttggttttgaaaatatggttgtgataattatagttctcatttgtagtcagccttgtttctgagttattgatctatacagacatgaagtatatatttccaaagagtagggattgagtcattttatcataattaatgatccttccgacacttccctctctttttcatcatcatcatacttgcaacaatttattaatgccctagaacacatgaggtagtgttaggcacttatattaattaccttgtttaattattacaaaaactctgcaaggtaggtatgcattgacctttcttttgtgatgaggaagctgaggttacccggctagtaagtgacgaagttgggctctgcccaaacccaggctctttcccgtatactactctgcctcccacagtgcctcacagtgtctgtctgcatattctagaaatgtttattctggtatgtaatgaataaatacatgttcaattgctcagaattgaaagcatggaaaaagtacagtgcacatgaatttatcgaggctatgaattgaaatatttccctttcatgcttgcatgattcagaaaagaactttatacttgtatttagtgccattttaactcactctagtagttgaaaagcaaagtgaatccactcgaattttcattttactggcaatgtgtaggtaagaaaactggcactccaaaacacaacaaatacctctccatgatttgtgatatctgagctacggtggattacctgaacacagcctgggatcagctctgctctggtggggcctctcttgggcttctacaatactcctgggaggtgtaattactggggaccaaaacaaaacaaagtggctggccattactaatgcccctgatatctaggggccctgttccctggctgtgcttgtgaggaatggagcaggggagcagctcatgagaacttctgaaaaggacaggatggggagaggggctgttcaacaagatggagtctcgctctgtcacccaggctggactgcagtggctcgatgtcggctcactgcaagctccgcctcctgggttcgcgccattctcctgcctcagcctcccgagtagctgggactacaggcgcccgccaccacgcccagttaatattttgtatttttagtagagatggggtttcgctgtgttagccaggatggtctcaatctcctgacctcgtcatccgcccgcctcggcctcccaaagtgctgggattacaggcatgagccaccgcgcccagcccggattttctttaaaaggccttctacagcctagtcccatgccattttccatccttgtatgctactctattcctccaatttataccaaccattgctgtttccaggacacacaatgccatttcacacttttaagtctttcctcatcctgttcttcccagtggaagctcctctctgtccatttctatccttaaaaccctcctcatgtttcaagaaccagttctgactacaccatgaagccttcacggatccctgcctctcatctcccactcccacctcctttcagatgaagtgctccctcatcagcactccaatagcacactgtttgctatatctttattatgaaatatatcaaagtagaaaagagattatagaatatatatatacagcttaaacaacaatagtaaataaatgcccatgcaatcactaaccgccttaacaaatagaacaatgtgtctcctccctcccacctcatctcccagaagttactcttctgaattctgtttatcattcctttgcttttcctcatagtttataatatatggctatatccctcaataatatattgcttagcttcacattttttaaactttatagacattgtttatattcccttgatttttttagctcaacattgtgaaatttactggcgttaacgtatattactatagtgtattcattttcactgctgaatagtttcctgttatataaatactaacttaagtaaccattttcttgttgatggtcattagggtcatttccagttttttactgttgaaaacattgctgttacagacattcttctaaaggtctcctgatacacatgtgcaagattttctcaagtatatccctgagaacagatttgataggtcctggggtctgagcaacttcaactttgcaaaataatgcaaggaaattttccaaagtgtttgtagcatattgtgtatttctatgtgcaggatatgagtccttgttgctttatatctttgtcatcatttgatataaaattgatatacatttctattattatggtggaaatgaaaaacataatagtatatcattatggttttaattttctttctagttagtaatgaacatcttttcatatgtttgaatcattcattttcctcttctgtgatatgcgtgttgcctcttcgccacttttctattgttattgttgtattttcctttttttattttttatttttgttatgggtacattataggtgcatatatttatgggatacatgtgatgttttgatacaggcatacaatgtgtaataatcacatcagagtaattggggtatcaatcactccaagaatttatcatttctttgtatcagaaacatttcaattctacttatatttttaaaactacaatcaattattgttgactatagtcaccctgttgtgctatcaaatactagatcttcatcattctatctaactgtatttttgtacccattaaccatccccacttttcccccttctgcctgcttcacttcccagtctccggtaattatcattcaaatctctgtctacatgagttcaattgttttaatttttagctcctacatataagtaataacatgagaaatttgtctttctgtacctggcttatttcatgtaacataatttcctccagttccattcatgttgcaaacaacaggattttattcctttttctgtagctgaatagtattccattctgtatatgtaccacatttttttattcatccattgacggacacttaaggttgatgccaaatctttgctattgtgaataccactgtaataaacaagggggtgcacatatctcttaaaatacactgatttcctttcttttgagtacctaacagcaggatttctggatcatatagttctacttttagggggttttttgaggaacttccacacagttattcacagtggttatgctaatttacattcccaccaacagtgtacaagcgttcccctatctccccatccttaccagcatttgttactgcctatcttttggataaaagccatttaactggggtgagatgatatctcattgtaggtttgatttgcatttctctgatgattaatgatgttgagcatttttttcatatacctgtttgccatttgtatatattttatttttagaaatgtctattcagatattttgcccatttttaataggattattttactttcccctgttgagttgtttgagctccatatacattctggttattaatcccttgtcaggtagacagtttgtagatattttctcccattctgtgggttgtctcttcactctcttgatagttttctttttgtgcagaaactttttaactggatgtgatcccatttgtctgtatttattttggtcttctgtgcttctgaagtattactcaagaaatctttgcccagaccaatgtcttgtagagtttccccaactacttttagtagtttcatagtttcaggccttaaatttaagtctttagtcaatgttgatttgatttttgtatatggcaaaagataagggtctagtttcattcttctgcatatggatatccagttttcccagcaccatttttgaacagactgtcctttccccaatgtatgttcttggcacctttcttgaaatgaattccctgtggatatctggatttatttctgggttatctattctgttcctttggtctatgtgtctagttttatgccagtaccatgctgttttggttactatagctctgtagtataatttgaataatgtgacccctgtagttttattctttttgttcaggatggcttttgcctactctaggtcttttgtgattcagtataaatatagaattttttccctatttttctgaagaatgtcattggtattttgatagggattgcattgaatctgtaggttgctttgagtagtatggacattttaactatattaattcttccaatctatgaacataaaacatttcctgtgtgtgtcctcttcaatttctttcatctatgttttatagttttcattgtagagatctttcagttctttggttaagtttatttctaggcattttattttatttgaagcttttgtaaatgagattactttcttggtttctttttcagatggaaactttttagcagcctcaatctcattatttgttactggtctattcaggattttgatttcttcaaggttcaatctgggtaggttatggatgtctaggaatttatccatttcttcttggttttccagtttattagtatatagctattcatagtaatctctaataatcctttatatttccgtggtatcagtagtcatgtctcctttttcatctctgattttatttatttgggtcttccctctttcttagtattgattttgtttatcttttcaaaaaaccaagctttcattttgttgaccttttgtatccttttttggtttcaattttatttatttctgctctgatctttattatttcctttcttctactaattttgggtttgattttgtcatgcttttctaattctttaagatgctttgtaaggttgtttatttgaagtttttctacttttttgatgcaggcacttattgctataaactttcctcttaatattgtttttgctgtatctcataggttttagaatactgtgtttccatttttattgtttcaagaaattttttaattttcttattaatttttgtatttacccactggtcattcaggagcatattgtttaatttccatgcatttgtattgtttccaaagtccctcttgttactgacttccagttttattctactgtggtgtgagaagatacttgatacaatttcaatttgtttgaattttttaagacttgttttgtggcctaacatatggtctattcttgaaaatgatccatgtgctgaagagaaggatgtgtgttctgcagctgtcagatgaagtcttctgtaaatatctgttaagtccatttggtctatagtacagattaagttcagtgtttcttttttgattttctgtctggatgatctgtccattgctgaaagcagggtgttgagatttccacctgctgttatattggggtcggtctctctctctctcattctctctctctctctctgtatgtgtgtgtgtgtgtgtgtgtgtgtgtatacacacatatatgtgagtgtatacacacacatatgtgagtgtatatatgtgtgtgtatacacacacatatgtgagtgtatatacgtgagtgtgtgtatatatgtgtttgtgtgtatatacacaatatatactcaaaaggataataacagagaacttcccaaacctagaggaagatatcaatatatctatatctatatatatcaatatatgtaacatgatatattatcaatatatacatcgtgtgtgtcctggaaacagcaatggttggtataaattggaggaatagagtagcatacaaggatggaaaatggcatgggactaggctgtagaaggccttttaaagaaaatccgggctgggcgcggtggctcatgcctgtaatcccagcactttgggaggccgaggcgggcggatcacgaggtcaggagattgagaccatcctggctaacacagcgaaaccccatctctactaaaaatacaaaatattagctgggcgtggtggcgggcgcctgtagtcccagctactcgggaggctgaggcaggagaatggcgcgaacccaggaggcggagcttgcagtgagccgacatcgagccactgcagtccagcctgggcgacagagcaagactccgtctcaaaaaaaaaaaaaaaaaaaaaaaaaaaaaaagaaaaaagaaaaaaaaaagaaaatcctgtggctcacgcctgtaatcccagcactttgggaggccaaggtgggtgcatcacgaggtcagaagatcgagaccatcctggctaaaatggtgaaaccctgtctctactaaaaatacacaaaattagctgggcgtggtggcacgtgcctgtagtcccaactacttgggaggctgaggcaggagaatcagttgaacccgggaggtggaggttgcagtgagctgagatggcgacactgcactccagcctgggagacatagcaagactccgtctcaaaacaaaacaaaacaaaaaaacttgtgaacctagttagatcttatcctgcaagcaaaggcaggctgttgaagacttttgaggaaacaagtgatttaattacacctgtgatttagaaatacaattttggtagttgtaggaagcatgaataggagaaatttgaggctagtgggacccatctagctactggaacagttcaggatagcaaagacaagggtctgtattgtggcagtggcaatggaatgaaatgaaagaatgcataatttgagacctgacttatatttcctaaatgtatgtgcccatttccagaaagacacagactgaagcaaggtgtactggcttatttcaggccagcccctgctcaggcctgagcacgccccctagttaagtagttaattgtgagcactgactcgggagcttgcccccaattccctgttctccaattcctaattccctgatagaagtacattttccagttttcctggctgttccctttctaaagcaagggaggcagtatttgaaaacaacctctttccaatattcattaatttgtctttttgcttacttacatctgcccttaacttccctttctgggctttcattcttctcccaaggtctcatacacaagcacagtcatgctactaggttgaggagtctttttcttccacaagagactaattcagctgataccatcctaaagaccaggggtatatgcatccttcaggcagataattacacaaagacatgggacactaagatggcattaagatggcataacaacaactcgtgactggtctgagatgaaaaatgaatgcgctgaacatccaataggcagttggaaattcaggctaggcatttatgaggaatgtcagtccctacctcttccccgcaccatgcttgaccaaataatgagacataagcctgccttgggaattgtgctgttttattacgggacccagcaggggtgatccccatatggagaagtacttaattctccctttgtatgggctctacttgtatttattaaaaaagaaatattttgtcaagttgaaccatgcaggagtcagatcttttcaacctggagaaggaagcagcaatgttccacaggcaggagcaatgccatctctgagttcaacacagccagagctaggaagcagccacaaagaaagaaggggacagggtctgacaatggtgactgccaatcaggagaacacttctgggcaccccaaagaagaaacgtgaatggcctgagattcacatttaagaatacagtacccagctctccatagcttctgagtcgctctgccatgcaaaccaaatcctgtgtgaatcatgatcaaggtgcatttcatatccattttctgatgaaaatggaaagtagaaggtaactgggcaaactgagtgactcccctgctcatctgccagaagctttaggtctgggggagagatggaatgacaaagaatctcaagcagagagcaaatttgcgtaaacactgctttgtaaaaatgaagagggaagaaattgtaatttattctcaggcaaagacagaaaaattacggttaagcttaaaagagaaaatgatacaacccttctcctcactgaagaggcaagtaaagtgtattttttcagatcacagcagtggtttgtaaactttctcgttcttttccataggcaccggcccccaccatgaataattaaaatcaaagactctcctcacacttctaatgtattcaattcctttctatgtctttccatgccaagatgcaatctcagccctttgattccttaccaaacctttaactagccctcatgggaagatgcttttgaaatggttcaaagttgggcatctactagaagaagaaacagagcaaagaaatggagtcctcctcatgtgaggtaatgagcccctgaataattgacaatggagctccccatggctctcttctctaatcaacaccacgctctccctcattgctgcaagcagctcgtgtaactcatttaacacagtgctcataggtcagactctgaaaagaaaaaggtaatggatttgatctctgtgagaggcttttcttttccttcgtaaaaggcatggagcagggccagacaataaagggaaaagaactcatatttgcagacaatctgaaggatgattaagagtgatggctgagagacaaccaggcatctggacgaaatggtctttgggatggcttgtaaagaggcacgctgtatgcagagaagagctttcagggttggctgaatttcagcacccagacgtgataaaacattgggtggacgatctttgcaatgcagggccctcgaaatgatctacctgagcccatacaattgctttatttctctagacaggctgctttatttccctcttatgtacttgttatctctcttctctcatgcttttgatttcatcaacttccttaggtcatttgtctgcattgacctggaggggcttagctctgtggggttggtatattctgctaagctctggctttcacatcattcagattgcactgctttcctgtgtaccttttctactagcctccagcacacctgttttgtaacttttattctgtcatgttttgcatacccagtgcttttgaagttctttattatttactgtttgaccttattttactttatttccattctttccttgtcatccacgtttggtgagagatagtttacatataagggaaacaagtcttggaatgtcacctagtttaagattaaaggcatttcttaatgctaggcacaatagggttttgcatatacaacctcactgattctgcaaaatcttagttaggcatatctgaacagggacgatgtatttacagtgaggcacgttataaaaaaagctgactgcgagttagactgaattgccacatatattcatatagtcagttacctgcgcaatcccatgtcctggttcatcaggtatctttgtggccatggacttgaaaagcacagctagtgaatgtgcagagttggaaaacacaactgcagtgttctgtactttgacagcttctgttcacgtatgcattcagcagtcaatatttactgagtgccccaggtacacagccctgggccctggggtatagtgggcagcccagagcaacatgattcctgctcttgcagagcttatgctctggaaagacagacttcataaagtgatcagacacaaatatgtaaaattatcactgcgacaaatgctatgaagaagatgtgcctgtttctgggacagccaatgacaggtggatgagacccaactggaaagcacggggaagtcttctctgaggaagtgatgcttgaagtgggatgtgaaggatgaggaggacttacccaggggaacgggtgggggaagagccttttgggaagagggagcaacatgtgcaaaagccccatgggcaggaagaagcatggggagagagactggttggtgggataacagagcaagggatggaggagctgtgtgagatgagctgggagggggactggggatagaacacgcagggagggggactggggatagaacacgcagggcctggcagccttgtgatgagggtctgatctttaatctgaaagaccatggggtgccatggaagggttttaaacagtaagcagatagatcagatgagtgttttgaaaaggaaccatcttatctagcaggctgaggggaggaaaatacaagttgatttgtatttgaaagcttttgtagcctcttgacatacatacttacttaaaagatgctctccgtacctctgtgctgagtagtgagtacagtcgtgcaccacataatgatgttttgatcaacagtggactgcatatgtgatggtagtcccataatattttaatatgatatttttactctaccctttctatgtttagatatgttaagatatacaaatactactgtgttaaaattgcctacagtattcagtacaataacatgctgtccaggtttgtagcctaggagctataggttggtgggtaggagctgtaacctggtgtgtaggaggctatagtatctaggtttttgtaagtgtacttctttgatagttgcatgacaaaatcacttaataatgcatttctcagaatgtatccctgtcatcaagagatgcatgcctgtattttaataaataacagtacaggccttggggagaacaagagagtagaagaatagaagaaatttcagaaatattgaactaggcactttacccttcctggaaatattattcccattgattagatcagtaaaattgactctctgtgaaattactttcaggatatgaggacaagctatcattccactaattgctagagttgactcaactgatcctgctgctcaggaggacctggtatttgatcaaagctatagagcagctgtgagcccctgacagggtaacttgttcaggtcagagctagacagccagtgagttgttgagccagtatttgaatatgtctgtcaggctcctgctctttttactagctcgttatttccttacaagggaggaaaacaaatggacaagaaagtcactatgacaggtaagaattttcctctaagcaagtcttcagggcaaggaagaaatagagtgagcttaagagagctgatcagtgaaagtatcttaggtgattgaaataaatgaagtagatgtaaatcatgcaccaatgactggagtcctcaaacagataaactcaccaatgggtatataacactgttttacccaactttttcccactgggaaattctgtgcccacgtgacagtctttgttaagggaatcagcctcaatgctttgtttctctgaactcaggggcatattatttccagactgtatgccatgccattcaatcccagtggcaggatatgagcaagctatgaagaagctcctccccagtccaggcaaagcctccagccaggcaggcctgcacatttatggcccagacaagccacctgggtcctgaggaagataaaatgggattctgcagtgctgaggtgacagtgtgtggcagggtggaggggaccatgcttctctgtgcccgggacccaggagtgcatgagggagccctagggatcacagtaccagccccttgactgtggagtgtgttctcaggcaggactgtgtggcagtggcaagaactcattagtgactttgtggacatgggactcacacaagtggggactggagctggagaggaagataaggacgtatgctacagaatgaatgcggcgggcacacgggaggcaccctctggggttcctctgtggacacactgtgagagggggcaactgccagctctaaagctggaagtggttgcagctactgtaacttggtcgttaaaggtaaatgttactaactgctgtttatggcaatatggtggattagattccctaaccttaccattgctgaatagggaagaaagtaaagaatcatctgatgccaaaagcaaagtgagaataagactcctggaaggtaaacaagtacaaaaggcagcttgtagccagaaaataactgctgattcctgggaaccttgagtttccattttgatgactaggcaataatgatagaaaatcagcttaggggctacaaatggaaagtctaataggagatccttgcatgaaccggaaccccaaagaacaattcaaaagagagttgaaaaaataaaaagggtaagatagaataagtgaaactaataggaaaagaacaaaaatgatagaattaaatacaagtataagtaaataaaattaatgtaaattgactgaaatgaccatggtgaaatatattgttaaaatataaaaaatccaggttaataggccagagaaacacatacagtataaagacacagaacggttaaaagcaaaaggataaaagagacataccaaagaaaactagcatgcttataataatatcagaccaactttaaagcaaaaagcattgacagagatacagtaggtcactacataatgagaaggattgattcacctggaaaataaaagaaataacctgagtaccaaaaaacatgtcctcaaagcatacaaagtaaaagttgatagctcttcaggctgggtgtgttggctgatgcctgtaatcccagcactttgggaggctgaggcaggaggattgcttgagcttaggagtttaagaccagcctgggcaacattgtgaggccccatttccatcaaaaaaagtcaactgcttttcaaagaaaaatttgcaaaaccattagcaaagatttttaagaacctaccccagtatttaatagatcaaatagataaaaattagtaagactataaaatagctgaatagttcaataaccaaaccttatccaatgaacaaatctatacaacacagcactcaacaattgcagaatgcacattctttccaagcacacatggatcatatataaaaaatgcaacatgttaggccaagtttgtagcaagttgcaacaaaattgaaagactgaaatcttgtggagtattttctctgaagacaaattaagagtagaaaactaactagaaaatccccatacagtcagaaataaaaaaacaaaaacaccttctaaataattcatgagtcaaagaagaaatcacagtggaaattagaatgtatttggaacttaatgaacatactacatattaaatctacagccttaaatttgtattttaatagaaatgaagaaagcctaagaactactactctaagcatccaacttaggaaaaaaaaaaaagaagaacaacagagtaaacccagaaagaatggatggaatgaaatattaagtataaaaacagaaatgaataagcaagaagacaaatatgtaagctgactctctgaaaagaataaaagaaaattgaacaatctttggcatgattaataaagaaaaatggaataccagaacagtagtcaaatgaaacagacacaaatacaaataccccaaacattaaaaatagcaggcaggtgaggtgtgatgtctcccatctgtaatcctagcactttgggaggctgaagcagtagtattgcttgagcccagaagtttgagaccagcctaggcaacgtggtgagagccatctctacatgaaagaaacaaatcagccaggtgtggtggtgcacacctgtggtccttgctacttgggaggctgaggtgggaggattacttgagctcaggaggttgatgctgcagtgagccatgtttgtaccactgcactccagcctgagtgacaaagaaagatcctgtctcaaaaatgaaataagataaaaataaaaatgatataaaaagtttgaaaactaagatgaaataggtaaattattaggaagaaaagcagtttatcagaatagacttaaaaagcaatagaaaatctgaagataattatttagaaacataattagtgaactaaaactttcacatgaagaaaacatactagatctggatgagtttgcaggtgtcttccaccaaacattcaaggataattcaaaacatacataaactttcccagacaacaactgtaaacaacagcaacaaaaaggattattctatttctcattttataaggttagggtaacattaatatcaaaatctttccaagatactacaagaaaattataggccaatcttactcaataacatagatataaaaatcttaaaggaaataacagaaaattgaattgatcaatgcataaaaatgatacatcatgaataaatagggctcatcccaggaactcaagagtaattgaaccataaaaatcctttaatatgattaatcatattaattaccatataaaagaaaaagatcagatggtattgtctatggatgcagaaaaagtagacaaaattcaacatctactcataataaactctcctagcaaactagtaatagaagaaaacatctttaatctgttgaaggttatctataaaaacctattaaacatcatgtttaatgaaattttaaaaagcattctctttaagattagaaataaacaaaagtgcctgctttgaccacttctattcagcatcatacagtaagccaagccaatgaaatttaaaaaaaagaaataaaaggacttaaagggaaaaaaacctcaaaactctaattagagaaaatgtgatttttatgcagaaaatccagaggtaggtacagataaattatttgaagtaataagagagttcagtgaattttgcctgatataattgatcaatatacaaaattcagttgcctttctcttcactggttaacagttaattttaaaatgacattaaaaatactatagccaggagaagaataaagttggaagactgacactacttaccttcaagacttactataaagccacagtaatcaggacagtgtggtattggtgaaagaatagacgaatagatcaatggaacagaatagacagaaatagacctgcataaatatagtcaactaatctttgacaaaggagcaaaggcaatgcaatgaagaaaaaatagttatctcaacaaatggtactggaacaactggacatccacatgcaaaaaaaatgagtcgagacacagaccaaaacacctttcacaaaaattaactcaaaatggatcccgatctaaatgtaaaatgcaaaactatgaaactcctataagataacatagcagaaaatctataagaccttggatttggcaatgactttttagatatgacacaaaaggcataatctatgaaagaaataattaggaagctggatttcattaaaattaaaaatttctgctctgcaaaagacactgtcaagagaataaaaggacaagccacagactgggagaaaatatttatgaaagatgtatctgataaaggactgttatccaaaatgtacaaagaactcttaaaactcaacaataaaaagaaaaataacctgataaaaagtgggccaaacaccttaacagatacctcaccaaagaagatatacatatggcagattagcatatgaaaagatgctccacatcatatgccatcgaggaaatgtaaattaaaacaacaatgagataccactgcatgcctatcagaatggcccaaatccataacaatgacggaaccaaatgctgatgaggatatggagaaacagaaactctcaatcgtcactggtgggaatgtaaaatggtatagccaatttggaagactgctggttgtttcttacaaaactcaacatacttgtatcatatgatccagcaattgcattccttggtttttactcaaagaacttggaaacttatgtccacacaaaaatctgcacacaaatattgatagcagctctattcataattgccaaaatcagtagtgcatccagacaatggaatattattcagcactaaaagaaatgaactgttaagccattaaaagacatggaggaaagttaaatgcatactactaagtgaaagaagtccatctgaaaaggctactacatactgtatgattccaactatatgacatggtggaaaaggcaaaactctgcagtcagtaaaaagatcagtggttgccaggggttagtggggagggaggaatgaatagtggaacacggagaatttttagagcagtaaaaatactctttatgatactataatgtggatacatgccattatacatttgtccaaacccatagaatgtacgacaccggccgggggcagtggctcacgcctgtaaatcccagcactttgggagactgaggcaggcagatcatgaggtcaggggatagagaccatcctggctaacacggtgaaaccccgtctctactaaaagtacaaaaaaattagccgggcatggtggttagtgcctgcagtcccagccacttgggaggctgaggcaggagaattgcttgaacctgggaggcggaggttgcagtgagccaagattgtgcccctgcactcctgcctgggtgacagagtgagactcctcaaaaaaaaaaaaaaaaaaaaaaaaaagaatgtacaacaccaagactgaaccatactgtaaactatggactctgggtgataatgatgtatcaatacttatttgtccattgtaacaaatataccagtctggtgggaaatgttgatagagaggaggctgtgcatgtgtggggcagggagtataaggaaaatctctgcaccttcttctcaattttgctgtgaccctaaaaccgctcttaaaaaaatgaagaaaagaagactgggttaaaaatagtaaaagcatatattcactcaacacatgtatttgtgtaaagatttaaaaatactgtattcaagagtaaaaataaaacacaaaaagtacctgagaatcagtctaagatatttgcaggtatgttatggaaaaagctataaaactttaagcactttatggaaaatctacataaatggattacatcatgttcatggaaagactcgatattataaagatgtaaatttttccatatttatacatggatttcaagcaattccaataaaattctaacaggattttttagaaacttgacaagtggccgggcacagtggctcatgcctgtaatcccagcactttggaaggccgaggtgggcggatcacgaggtcaggagattgagaccatcctggctaacacggtgaaaccccgtctctactaaaaatacaaaaaaattagccgggcgtggtggcaggtgcctgtagtcccagctactcaggaggctgaggcaggaaaatggtgtgaacccaggaggcggagcttgcagtgagccgagattgtgccactgcactccagcccaggcgacagagcaaggccctgtctcaaaacaaaaacaaaaacacttgacaagaaaattctaaaattatatggaagggcaaaagcccaagaacatcccaacaccactgaagaattaagatgtgtgtctgggggagagaaagtttccccatacaaaactcaacactcattaaaaggtagctaagtatggcattgatgcagggatagacaaatagactagtagaacagtataaagaatccatatacagaccactgcatttatagaaatttaatttattatagagctgtcattgcagattggtggggggtgggacaaagaaatactcattaaataatgatgctgtggaccgggcgcggtggctcacgcctggaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaataatgatgctgtgacatgtggttatccatatggaaaaattgagattgaggttctaccttatatcatacagagaaatcaactgtaggtgattaaatacttagatataaaaagtaaaactatacaacttttagaagaagatataagagaagacgtttaagaccatgtcttggagaatgatttctcaaacaagacacagaaagcagaaactataaaaaaaaaaaaaagggttaagccaattacgctaaaattaagactttctcattatcaaagagcatcataaagaaagtgaaactgcaagccataagctggcataagatatctgtatcacattaattgatgaaaaagatcaccaataatatataagcatttctataatcaacatgaagaaatattcaacagaaaatgaggaaagacatgtacaggcattttttagttaagagagaacatgaacgtctaataaatataagaaaaaatgatgaatatgaatttgtaatcaagaaatgcaaatccaaatctaaaatatataattttctacctaccagaatgagagtttaaaagtctgacgtacaaatcttgtgagtgtgtgtagtaagaaaaacttttttacatatgctaatacaagtataactttgtaaaaccaccttggacaatacttttgtgttacttaggtaagttaaatttgtgccctccaaggcatctagtctagtctagagaaagtcttgcataggtacagcaggaaagatgtacaaagattgtatgagttacaacaaacttggaaacaaccaaagtgtaaattgacagggaaaatctcaaatgtccataaaatggaaaaatagataattattataggttgtagcatattcacataatgaaataacttatagcagtgaaaaataaatggactatagcttcatgcaccaaccttggatgaatctcatgaacataacatatagaaagcaaaccacagagaagaacatgtacagtatggttcagttacataaagttcacaaagtgcaccaagctaaaggttatagttgagagatacacacatctgtggtaacaacagaagaaatgtcaagtgctttatttaggaaggtggttccctctgagggctggagagtaggaggagaatgaaatcatgggagcttggtaatgttctgttttttaagtggggctatgggttcatgggtccttgaatcatggttagtatttacacttattacatatgttagaaatattcttgtaaatcgttttatgtttaataaaaacaatatataaaccaagatgcttttgtattgactagttatatctggtctatagaaggaaaggtgacaaatttagaagaagctaatttcagggaatgttgcttttcctttaaaaaaaagatgggcaaatgatatttttttgtgcattgattggttgaacaaaatgttttagtcattccaaagcccattgcaggcagacttttgcatcatgtgagtttcagaaagtaggtaaaccatcttataaataagcttatgtgatgctaaataggcatacacaaatggtacccagctgcaagtgatgaagttatgaaataatgttctttttcatcataaaaatacattttatggaaatgcgaactatattacacttttatggaaacaggaaaatattttaccattttaagagcaaacgatctcctttcagatttctcttttaacttgactctcagatttttatttaagcacttagaatttctattctttccctccaaatgtctcctgatttcttacattccctgttttactgagctttgccaatattattttttatgttcattattttttgcctgtgttttctatttagttttggcttttaattaggttatattcctaggagctttgtatcagagattttattcactagctatgaaaatttcatccctcccaattttattaggccattttacaaacgtaagtcttctttttataaacagctccagtaatattttctaataatttattatccttttccttaaaatctgaatgtccattgtgtttctcttatgacaccagccttcttgactgactgaagaaaagcaagcagacgtgacaatgatatatctctttttattattccccttattttctgcattcacagattgtgttttgttttatctattcaacttttaatacatcagtattaactgatgttgaaaaaccatctagtataataattaaagtcaaaacttgctactctccactggttttttgataaagtgaatatagtagctccctctcatacctcttgcatatattccaacatctccagcggatgcctgaaatcacaggcagaactaaccctatatacactgttttccctatatatatctatgataaagtttaatttacaaattagacacagcaagggatcaaaaacaataaaaaaagaacaattataacaaaatgccagcatcactactcttgcactttggggccattactaagtaaaacaacggttacttgaacacgggcagtgcgataccatgatagtcaatctgataatcgagagggctgctgagtaaccagtgggcaggtagcatctacagtgtggataaagggctgtttcaccttctgggaaggacaaaatttcagcacgatactcacaacgctgcacaatttaaaatttataattgtttatttctgaaaaattttatgtaatatttttggattgcagttgacacaggtatctataataaaacctcggaaggtaaaacctcagagtttcacctgaagagcttcctaaaacatagcctggtgaccccactcctagagtttctgattcagcagttttgggtggggctagagaatctacatttctaccaagtttccaggtgatgctgatgccaggaaccgtgctgagaaccattgctctggcttaaattctgtaagaaagaggaatcttttcctgcaagggtatttctctatttaggcttctttgccttgggagtactgtgtatatccagcagcgagtcatttagatcccttgtgaaaatacatggccactgtttgtaaccgacagagaccagccctgtagtccaccgtgggtctctatctctcacagggctctggccattttgcacatggtcttcctactgtgtttcacctgcactggaaagattaattttgttttacttaactgcttgtgagctggccttatagcaggttaagaaagtgtccttctggcttatagggaagctgtagagccaggaaaccatgtggaggcccatcttcaaatcagggctagacggggtaagaggaggctggtgctagatcacggggagggctgccagtctctggtgtcagccctgcctgggtttaaattccaacttggatgcttcccagctgtcaaaggattgtggtagtggggagaaacaaagacatgatgtgcatgccttctgcttttggactgtggataatcctctgacttggaaatgcgtatcatagaaatgcagacttggtggtagaaataacagattcagccatcagggaaaattggttggtgaggctctgcacaagaacctgaggttccggaaccccaaagccacagcttttctttattaacttaaagaggcaggagggagggcaagaataaattctagattttattcatacaccgacacacacacacacacaaacacacagagagagtaaagagactaatattttatattgttaacaagctttgttttatacccttaaatgaagaatcagttacccatcaatcagatgcctcaaagtaattattaaatgaaaaaatctactcttaactttaattggaaaatttctagctgctgtcttttttttttttttttcttgagacagattctcactctgttgcccaggctggagtgcagtggcacgatcttggctcactgcaacctccgcctccctgggctcaagcgattctcctgcctcagcctcctgagtagctaggactacaggcgcccgccaccacgcctggctaatttttttgtatttttagtagagatggggtttcacagtgttagccaggttgttctccatctcttgaccttgtgatcctcccgcctcagcctcccaaagtgctaggattaccggtgtgagccaccacgcccggcccctgctgtcatttttaagaacaacctgtatccaagaagccaaatcccttttactcctaatgcttctgtctgcccagtatcaaaccaaaagaccagtcaacacaaaggaaaaatttcctaaaagtcccgcaaaaccatgtgattaatcaatatgggggaaaaagcacaaaactaaaaataaatttcaaaagattcaaccttaatcaaaacagaatcatcaaaccatagaaagaattatggagaaataatgtttccttttcaagctatttcttagatttctttcatttgctctttagaaaaatagtactttactgaggttaatcaattagaaggtcataagcagaaaaatgagaatgagagatattataaaatagcaagtggccagacttttaagaaactgggtcatcatcaactagaaagagggcaaacctacagcaaccccgcttgacagcatgcttcagtactcttccaataccacagtcggtttttctttcagaattaagcaattctataaaaagagactgttcttaccctcatcctcccattccttattgctggtccatcttctgccagtctcaacacatacaaatccattttgtattcccttcctccacgaatgctgaatccaaatcctttggctcctttctccatgtccacagtgaaataatcaaaatcctttggggttggggagaaaatggaataaataattatttagttatcagagaagcttctgtggctagtctctgtgttctccttctgtctcttagttaatgtattccaaatgacatgatgttgggagaagtcgtaatctggcttcataaactacccaaatgaaagacaaaattccaaaggtttgagcaggccagagcacagtttacttggtcatcaaagaattactgtgtagcttgtttactttggtattcatcagtttacttggcaaacgtggaatgattacagataggcctgagtgacatcatctctccttttacttctctcattcactgctattgagcaccataaataaatgtcaggtgtgtgtgtgtgtgtgtgtgtgtgtgtgtacaaattacagagtttgctgattagaaaagtaaaatttagtgggatctgataattagatctctcagttgcacagactattgaatatcaagttggaatgtacaaaatcaatttctcttttacctaaaatgcagtatgtccaagattctctgatcttcactattcttaaaatctttgggcataaagttgatcttcaattcataataaaacacaatgtaatctgatagagttgagattgtacttaatttatatcttggtatgtagttacgaagtaggaaatattttctagataccaaactctggtctagactcttttcataaatgttgaatcctcatcctggcctgtaaggaagactctccctttaggaaactgaatctcagagaagttaaggaagttgacatgaagcacatcaacaaataatcataacaacagtgacactggttgtgtagacagagagttgttggctgtggcaggcgctacactctggattgtgaagccaagcctggtcttattcttacgcacaggggcttggccctttatcacagagtggcaggtagggggccacgtaaaaaaatatggacctaaaatacctccactgctagcatctataaaattttctgcattagcagcactctcagaggtcccaggttagagcatttttaaaactttgacaaggaaacgtacaaggagttagctagtattagcagggattagtttattccattactactcatccgctatttatttatgtatttatccatatttatttattgtcctgctttattctgaaatagatttatttatccagcatgtttctgaggatgcaggtgttaccccgatgttaccagaactaggaatagaacttcagctctccatcccagacaggtactctttcctctgcctctcctatttcattccttgcagttctctggaagccttggtcaggacccaccctgctctccgggaggaggtacctggggttgtctgtagtccgacagagggtactgcctggtgtcgggggagtgctgcctgtagtccagtaggggaggctgcctgtagtccaagggtgggggctgctggtagtcccctcctgggggttgcctgtaatccagcgggggctgcctgtagtctgtgaatggaggctgtcggatgtctggtttcacatcttgccttgctttcacttccgacctgtaactaaatcaatggaaatgggatttgcttttgtaactctgcattctaaagaggctagagtgatcacacggcctccagaggtgggccagccatgacagctcacacaaaccactcctctcggtggtcctgttggatgctcaggattatgagaaggttaaatattatttaaaaatctctgacaaatgccatattgtatgctttttatttggctccttacgaagtcaaggtaaaaatgatggttcaaccagaaccttgtgaaaaagcactcatggatgttcctctttgactttggctatttaaaaactgtacagccacagcaaatcaagggattgaagcactgaactatacaaaccaagacatcagcctatcttaagactggtaaaccaaccttcctctctcactcttacttttttctctcacacacaccccttggcagatcattcattacttcataaaaacatgattgaagtgatctctaaatacattacaaatacacaatcaaaggctattttaacctgctgagttgggtctttttgaatattttacagaggttaaaggagtgatggtaaaatataatcaccaactacaaaccaagtggcaagtcattggaccattggtaaaattggaaacatattacacagaggtaatactagatcatagctatcaagattagcatcaaatactactgtggtcataagatggaagagaaggcaaaaatgtttatgtccaacatttatctcttgcttgcttctagatattagttactaatgaaataaacacagagatgagagctaggagtgtagcattgttttgtgaatccaaactgctttaagctgagggggttactagtttcaaaagaaatagccaatccctaccattatgggatcattaataaggtgaactgaaaaattgtcaccatggtatggaggccatttaattctgttgttcattgcctattgccatggtaacagtctataatgggctacccagggatgtaggtagattgaaaaaatacattctacatagtaacaattttatctaaaattaattggagggtatgaggaattgagaaaatatttagcagcaagaaaaagctcaaatgtgtcaggaaaactagtgcaaaccagtagaattcttacctttaaaagagtctggatttttttttttttttaaactggcttacggtcttactgatgctgattagtattaagtatttttaaaaatcacttgcctgaacaattgccattagtgcaatctaatatttggcaaggtcacactgaaagtgcatggcaatagatgtatttacttggggctccttagaagggggttagtaatgtagttattttaatcaaccctttgagtaggtcccatttattacttaaccctgcagaggagaggcattccttttatgaggtgcataatttcggccttgctttatacctcaattgtccactcgcctactgagagcatgcatgctgagaatagaattatttaaaatatactttgaataagatgcttaactatgcaaatgcatgcattaaacaaaaggaattaaactgggtgacatttgtcagtgtgtgttggttcctttctggaaatagcttgtttggtggtttggatgtcacactgttttaagttatagcatagtcactttatttccatgatctgtatggtattgatatgcaatatccattgtgtgctcaatttccaaccaaatgtgacatgaggtatggccaaagagggtgaaatgtaagaatttcccccaaagtaatacaaacgagtaaaaataggagcagatgaaactttcaaaactctcatccaggccatcaggcacttaaactatattctacccagtgtcgtgtgtcaggattttaagttgaactacacattgaagaattctttaataagggaaacatactaaattttttatgagtgttgctaacttttaagtgaataatataccagctagggcaaaaaattatgttgctttgaatgtgtgaaacactttaaggaaaactcaggattattttaaaaagctggctctctaaagttcttttacttctgaaagaagatcatcaaaacccttcatagctattaattcaattgctaaagagattttagaaatgataaaaccagactgctaatggtaagttctagcaggttttttgtggtatgaaaaagttccagaacaaagaaatgctgccaatggtgagaatgcacatctcgtgggcccttcaagaatcacttccggccagatgccgtggctcacgcctgtaatcccagcactttgggaggctgaggcgggtggatcacctgaggtcgggagttcgagactaacatggagaaaccccgtctctactaaaaatacaaaattagccgggcgtggtggcacatgcctgtaatcccagctactaaggaggctgaggcaggagaatcgcttgaacctgggaagcagaggttgcggtgagccgagattgcaccgttgcactccagcctgggcaacaagagggaaactccgcctcaaaaaaaaaaaaaaaaaaaaaaaaagaatcacttccagtcctgagcatctagagttcaaagtctgtgaaagaagtcaatttccaatgctctttcactgaccttgccattttaaactgcaaatatcaattgcccttgctagagaaggtgaactctgctatttatacttagttttgaaatatattccataacagctcttctgttgttttcaacaaatgcttctccttgaatagtgtttttgcttatcttcacattaaacatactttatgcttcctgagcacacacccaaaagatgttaaaggactgagaaatggggagaagtgtatgggtgtcatgggaagccaatccaagagtaaatacagcaggaaaaaatatcactcattctaactcacaacacagacatttgcaagcagattgtcattttattttatcccgctctaacatgggaacgggctgaatctgacatgtaggtgggcacttcttacacaaatgaagaaataggaaattcataccgtgcactggcatataaactgtcttagagacatctccagcctgatctaaaaaaatggcaaagagttttccctctgataccatggccatctttaaatgcaattgggaaaaatgtttctggtacctgtaagattactgaatctcttcattcatatgcaaatgtgccaccaccaacaatcacagagttcagccaggaaacccgagtggcagtaaagggccctagagttggagtgggcacttcctgggctgttaatatagtaatggaagcaaaatatcttagaggcaatgtagtagtagaagaagcaaaataccttagaactctgggcaaatatgttggtgacttataaacatttggattaggtcaatctgaatcccagagttaggaatatttcattctgcagtcaggatgtccaaagaccactgcttctgtgatagggaacaaggtatcccagttgtgagctggcagcagatgggacatgacagtggctgtatccagctgttgttctcccctcagagctatagcacaccagggatgagctcacccactcaaggctgggagcaagagccatgtccagggaaatctgactctggaaaggagaatggaatgtggctgcgagattaatcgacagtggcaagaagagtctgaagctggctcggggactgctggggtgctcaagtccttcctcttgagtctaagatgaattctggggaaagccagtgcaatctgttgaagtgatagatgttgagagcaaacccatctggggctcattactgagacactcaggacctacccttcttagggattgtcaaattctcacctctgcatcatttgctttatggggcttttctcttccttgcgtatatttaaaaacataagcagctgaggacaatcagacatttacttttctatgaaagcaaatgggaaatcagtagaataaggctttgtagaaataccacctgtggcacagggaacacagtttactttgcaacaatgtgaatgatgaacccagagagttctgggaatcaaaaacagagtctcacttcatcttcgccatcatgggaggagagggatgggaagcagatgttcagaaaacattagaatcattaaaaaggccagtgaggggtttatatgcagaggtgtttctgtgagttgttctgtttttgtttgtttgtttcccacggaaagcgagaaagcatcatgggaacatgtcttcatctttctctttaatggctgaacccaacccaggctccctgttatatacaagtcacaataagaagacaatgttgttcttatgacagtctttttctggaagttcaaagtgtcttattcattagtctatgatgcctatctctaatgctatgtgtggaatagaagaacctcattagattgtgggtaggaggatgtaaggttgttataatcagtaaaaatgctaatttattttatttttgagacagagtctcactctgtcatccaggctggagtgtaatgggaacgttctcagctcactgcaacctccgcctcctgggctcaagtgattatcctgcctcaccctcccaagtagctgggactacaggcgtgtaccaccacaaccggctaacttttgtgttttttgtagaggtggggtttcaccacgttgctcaggctggtcttgaactcctgggctcaagcaatcctcacacctcggtttcccaaagtgctgggattataggcgtgagccaccacactggctgctaatatttactaatgcctacaaatccttcaacattctccctacctccacatcatcatcattctctgagccatgacttttgtggttcaatggacgtctgcagccacctcctaactgcttaacctgcattcaccctgccagcctcctgtctgcgctctgcagggcagaccgagaggccttcttataaagcaaatccaatgatagcagtcctcagctgaagacccttcaatgacttcccgctgcacttaaagatcaaaacattaagtaagcatgcttacaaggccctttagggtgggccccagccaccctcactggcttcatctcacatcatactcttctccttctgccaccccatatattggccgcatttccatcgtgcatactgcaggcttgcgcctgccagggggcctctgagtaagttcttcactctggactctctttaacatgctcttcagctgttaagccctactcatctgcaactgctcaccatttctgcaggaaagcatctctctttgtgaaggacagacactcagctatctttactaataaaaccatatctataacacacacaacctcgaaatcacacaaaggtatgcacggcgatttctactttataaaagtctctctctctgcctgtcctgtgctgtccccaaatactccctcctttccccaccctatcacctctcagaatcacaaaagtcagaggaaattttacctattttcgtgtccttgcagctgaagtggttgaggtggtgctggctgggcgatggggctgttgggggtggctgggcttggctgggccaggggactctgctgtgccaggggactctgctgcgccatgggactctgcttctctgagctgggtgccgaggtggggctgttgagctctgcgatggagaaccaaagcggcagatgcagtcaggttagtgttgataaggggaaagaagtgactagaggcagtgactttgcctctgctgatggctcaggctttggttatttccgtttctgctaggtttttagatagcaggttaatcttatcaagttctaataccatttctgatatttgtattctttcattaatgatcactgcagaacaaggctatgaacagtatcttgtcattctgccagaagaaaagattaccaaaaaacctcataaaactatgaaaaaaattattcaaaggactaagctctaaaacatactctatttttgcagcatcgcttgctgagagaaaatggatccgccaccagtttttgcttgtaataaacagcctgaagagtcttccaaagtgtggataaggaatgaaccataaaaagaaaaatgttttttacaatcttttcctcatcccttgtcagtcttattgcctcatagcccactggactccacacttttccagaaagaagaaagaaccctggacacaggaagagtcacaaaactattctattaaataattgcttctggaattctttgctaataacatcaaattttcaactgaaattgactctatatattggaataagggcccaacagacacattccagactcagaaaactgagaagcgtttagattttcagcgagcaatcttgtttgcagttaatttccattgaatagcttatacatgttggtgtctggagatagtaggttataaagcagcatggccattttcttttctctctctctttttttgattgggtaagaaaagggaggtgatctattagcattcccctatgaactcttcttccccccccttttttccccacagtccaaatcttttaattccttctccatttatatcagggtttcccagactcagcactgttggcattttgggtggggtaattctttcctgtggacggctgtcctgtgcattttaggatagttggcagcatccctggcctccaccccctagatgccagcagcatgcccacctcaatcaagacagtcaaaaatgcctccagactttaccaaatgtcccttggggggacaaaaccacccccgttgagaactactgttttatatttaaagtcaagtggctgtttagccatttgctgcctacatgtcagataatcctaaaatggaattgggggctgaataaaacagagggtaccaagttgagtgagcccatcagcctctgtgtgggacactcatcagtgagctccagaaatggaattcttcaatatcgttgatgagtcagcagccagaaactagtcatgaacccactgtctctggaaatggtgaatttttggtgcagtgatgttcacagctccatgaccccttagggcatggttatgaattgtgatgttcactactcttttgagcctcaggggggagtccttgtacagacaaattcaaaaggctcagtgggaattttaaattcttatcagatgcaacattttctaaatgagctctccttataccacaaaacttcacgttttcaaaatcaatctgactttgaggaatcctctagagatttactgttaacataaattttttttttcagatttgtaactctgtcacctctgttgaatgaattctgacttaatataaccataaaagtgggggcccacagggaatgattgaataacctggcgtcttggaattcacactatttagcctgcaatgtcacatagcttgacctctgaatgaaacaggtactgagtaaacaagatatggattgcaactgagtgtgagtttttgcaaaagtggaaataataatcaacctctgacactctgacaccacagtgacggcaggcaggtgcactccgcgaccctggcgggcaggctgagaacacccggtgagtgtgtccatgtgttggccgcctctctgcaaggctgcctcaggcactcaccctcctgaggaatgatgcgaagggtgacactaagacctgcatccttgatgagcttcacgatgtcagcgtgaggcatgttgatgatagactggccattcactgctaggatccggtctcccacttttagttttgcacagcgatctgcaggactcccatcaatgatgcgtccgattttatggggcacagctaaaaaaaccccaacagaaataggtatcagggacatcaccaatacatgttctttcagtcccagccccaaaggaaacaatgaaatgtcagaattccttccttcgtcagtgtatttgccttttgaaatcacactaatttctatcaaatggggtcctgtgcatactactgagaccaaagtttctaaattcaagtcctttgcagtgataggccaattccaaacacagaccaggggttctcaaactttggggtgatcataattaacctagagttaaaaagacagctatttgggccttactggggactgtctgagttagaatgtccaggcaggaggcgaggaccatgaatttctaagaagctcctagggagattccaatatatatgagtgtttgaggaccacatagaactttgtgccccatgagctcatattctagggacaataatcaataatttaagaaagctacaataaatgccagaaattcaatttctatccttttattattttattgagaggagaaaacaaggaaggaaagaaatatgtgttaaatgggtagtagccacttggtaaagaagttataaccaccttcccactcatgtactaagctataaaggttggtgtgttgtcacatcttacctcttctttttgatttacttttacatggtgctgatatcttgctaatgtctgatacataatgcatttattcaaatctacaatgccatggatggtaagacacacctttattttatatgccacgggaaaaaaaataaaaagaaacactgctaactaaataatgatgctccattgattataagatgctctccaactgtcaaaatattaaaatataaaaatgtttaggattggtaaaatgttatacgtcttttaaaaacaatgtacacttcttttctttctttcttcttttttttttttttgagatggagtctcactctgtcgcccaggctggagtgcagtggcgcgatcctggctcactgcaagctctgcctgcctcctgggttcacgccattctcctgcctcagcttcccgagtagctgggactacaggcgcccgcgaccacgcctggctaatttttttgtatttttagtagagtcggggtttcaccgtgttagccaggatggtctcgatctcctgacctcatgatccgcctgcctcggcctcccaaagtgctggggttacaggcttgagccaccatgctcggcctattttctttttactgtttatttatatgtgtgaggagagccacacacatgggaatacagatttttcctagaaggttgacttcagtgtaaatgtttaagtacctaccaagataactatttatggggtggacatcaatagtataccctgtgtaaaccccctcaaggagtttaccaaactagaagcctattccctttccattctcccttcaagactgtgagccccagctcagaaacctgtcaataactctgtgttgttgctctccctatggaatcaggtactgctttgatctgtagaaatatgcaaaaacacaacccaccattcagtatgtttcagggatgtctagtccttgaactctcaatcttgcacatgctttacagcgaaaggcagaacattagctaataaccatggcaaggaaggacaattagtgatttaatgagccagtaccttgttcattcttctattgtgaaaggttatagatagcatatgaaaatattggctgagcctgtgtccctgaagtgaaactcatcatgttggaaactaaaacatgtttttatataccataagcactaatggcttcaattaagaacaccttacatagagcatgctaatgatcatcttagaatcttaggacaatcaatgttttttcaagtagaaatataagaactcattaatttactgactttaaaaaaatgatgtaggcattgcaaggtatttagggttgcaattataattagggtgaactttagttcctgtttttgccccctttcatgttcaacagtgtctcggaatgaatggttcatcaatgatttggtctccctggccataatgtgtatattgttatctgtcccgtgacctctgcaaaattacctaacttctctgagtctgtttttcgacagtaaaattggtatactaatagcattgacttcacagactgcatctgagaattaaatgagttatcatatgtaaagcgagtagaacagtgcctgatgtgtgagaactgatctataagtattaactgtcattctttttattactattatcttttaaatatttctgatatcactattaaggggtatgtgtgtgcttgtgtgtaggtaccaacttggtttctttccacatggggtaaacctgtaatactgctagaattgaaggaacactttgcttactacaggattatacagagtaatatcccctaagtatcaacacaggaaaatagcttcagttatgaaagagatgtgttgggtggattagacagacactggatgaggtcaagagtctatgttctctgatttcacaaaaaagacgatgttgcaggtctctgtaggaaaacatcagcttgtaagagtttattattcaaagggaaatcagcatgatttaaatctcttaatcacccacattgagccctacacacataaacacacacactttcatatttattgaatgttattaaccatttttcttcctacctcttatgagtacctacctgagccaagcactgtgctaagtgataatatatgtgtgtatatatatgtatatatatgtttaaaaaatatccttaacaaatcatatgaaatgtttgatatcattacaagtttacagtagaggaaactgaagcatatagcagttattaatttgtccaaggtcacatatgccaaacagggcttagaaccctagtctatcagatttcatagcctttgctgttattatagccaccaccctgcatctcttgacttttctggctctgatctctaatctattacttgctttgtgagtatctggtgcttttatttgatgggtatagcctgcctctgagccaggaactaaacacttcatgagtggtcctgattcaaggatgagtggaagtcaggaactttgtctgaagcaggttctttgctgcagttgtcttttgacaggcaaagtgggaggaggagagagaagaaagagaagaggagaggaaattggacagctcttcagatcctatttagttaggatgtcacatcatggtgtcattcttttgtgtgaagtaatttctttgggttttagaaatactgacttttgaaatgaaatttaaaaacgtacttcaaaacacaaatggtatttggatgattttctgttttgacttatttatgcctctgctctcctctattactgtagatcatttaaaatttattgggcataaaatcccaaatgtttcaaaacatagattcacacacacacacacacacacacacacacacacacacacacacacacacacaatttgtatgctcaacgacaatgataaactattacttgttaatttccaggcactgcagaacttgctcattttaaatccttatagcaatagtgtgaagtagctgtaaaagtataataatcatgctaatttcactattaagaaaacaagtgtcaaaggcacaattcaaatccttgcctatggcttcaaaccttggggttattcctttcttttttgatatgttggaggttgaaagcaatttgaattacgaagagcaagcgaatgactattgagacttagtttggaaaagcttgctggttgagacttcaagatgaaagtttcactgtaaacagaattatttgctcatggtaataacttagtttcaaagccattttaactttattagggtagttagaataaaaactaagataaaagactagaaatcaaaataaaagaatgaaaactgaaataaattcagtggtagacacataaaatgactgagtgacttgcataaaatgtaagtgagcacacagtttaaaaatgtatcttcagtaattgaaagtacctgacgtggttttattacaaatgttttctattggcatttactttaataaaagcagtacttgaaactcttggcagctaacggcagcctcacttttcctttactagagttttccttacatatgtaagtgcactgaatgttgatgtacaacaaatctctgacaagggatgtgctcagagaggattctctctgaaaacaagatgcagttccatttgctcagtgataaggtctacagagcctatgacctaagtgctttcagtgcaatgctaacggaattacagagcaaggaagaggccctgaccttggtttctattattgggatgaatggtactcattaattccctgagaactgatgactaagggaactgccggagcacagtccatttagacagcatgccttgcagacatcatctgtcagggagcaacataaatcaagtctttggatcagtcgtcttgacacagtgtgcttaggatacacagatatttgggaaaagttgcagtatgtcatttggctttagacgtactgacatttaggaaggagataatgtgtcactagtcagaaatttccttttaattgaaaatctcataaattatggaaaaaagaaacccagcttttctatgtctttattcctttatagataaaacaatattgtctacttatattgcaacatgttttatattttcccatagatgaatgaactcttttggctctgctcaatgttccacactgttttggtaggaatattcagagataatcagttggattggatgtcctctaagtgaatttggaagggctggattcttggggtctgtagccacatcactactgaaagcagggatcctcccttttttgctgttggattctcttctgggaccttgtatagtctactccggctccttcagtcactggtcaaagtgggccgatccagccaatgaactcctgttatttctaccttgggtcagtccccataaagaagacaggatgtttacttgaaggacttttcttgctttggtgatagattcttcctgaaatcctaagggaagggattattagatccccccttctctcctctttcctcattatttgtcttgctatttatgtgtatttcatttcagagaaagaaaagtctgtgactcatgtttacatttaattatcttcttgttaatagatcccacaaagtggagttatatgtggagaaagtattaaaaaggcaaagtggattttgcatcgatcatgccaaacttacaagagggaagttcctgaaatgagtgtgagaaaaataaatacttcaaaggcaatcgatagcataaactctcattagctcgcatttccattaatttgtgaaggttaaacaacatgtcattagcttaaagaggcaaaggaagttagtttgggtttagaatctgtgacctgatgtgaaaataaatgctttttaaaagttggataattccagttgcttttctttcaataatatacgtgaaaattaccttctgtctagtttaaatttgtgggttggagcagaagggtcaattactacatcaatcaacacatttcagaatagcatcttcttaataacaggcactatgctaggcccagaggggaaggcaataataaagccaacacatggtatttgtccttaagaaactcactgtctggttggggagaccagggataaatttataaaaatacataaagcaaaatgcaaatggcaaatacatggcaaatataacgtgcagcaaaagtagagtggaggagtgaaatcctgagtccaggtgtagactgagagaatggtgaggaacgggaaggtcattctggggaggagggaatatgtgccccttggtaagtggcagctctcttagaaaaaacttatgagggtaaatgggtatataatccaaggaggtttgcggggagacaaggagaggtgctttgtgggctggggtccctcctgccctcataattattgcttccttgagagctctgatgtgatgcctttagcccagctcccgtgaatggagactgagcacagaggaatgatgcgagattgtcacaaagtgttcccatctctttaatacatggtggaaactcctgatctgtttttctgcctttagaaaccagagcataatattaatcttgcttattttccatcgctgcttcctaaaaattctgccttcatatgttttattgtgacaaacccattcagatagatattgtcccttcctggaatatgacaaggtgtccttcaaaagagttttctttgtcatcatggggtggagatgtgggaaaaaacatgtgttttgtattttaaagttttttttggtggcaaaattaagaaaaaacagacggcatgacttgttttcctctagaacgctgtgaaatttagctttccaaagatgaaaacgtcttccctgaaattcatagccaactgatatgcaaaacccaaaatcaaacagctggtgttttaaggactgcatattcaaaaagtgcgttttcccccctcccagcacccatgagtcattctcttgtggttgaacagtttagctaccctgcagttggtaataagcagatggtcagacaggagaatgggaagaagggctcatcactggcaatttgggaacccaactgaactcacgttgctgagggcagaaagcatcctatagatacgattaactaaatggctggagagaaacactcagcagccatatattaccgtttatgcttttattttataccaattgttaaaaatttgcatagctaagtactgagagtaaattagtaactgaaagaaatctcacgacattaggaattgtaattagctatgactcaactgttctatcctggaacatgaggctgggttaaaatggatttgttgtttggaaacatttgatgggccaggggtcacatggctagcttcatgtgacctgggcagtcacacaggccaccatgctcaaaagggcctggtgtttggtttagtcacctgtcaccagcttgatattcttaataatttttgaacaaggacctcacactttgattttgcgctagaccctgcaaattatgtagttggtcttaggtagatctgtccataatgtatttcttccttgcgccactccactgttcttagtgtctgccgtggaaggtgtaaatgagaatatgttacagctaccaagaaaaatcaccaacaaggtgggtggtaggaaaggagccaaaacaatccttttctctgtgggtgcattttccactcccctgtacatcactagaaaaggcagtccaaaaaatttctgttaagtatactcttacttttgattcttcacatatttattgaagaggtctaaaaattaccttgattctcttactccactgtgaaaattattcttataagtcactcattattgtgtcattgacaaagcaactattcttctgtaaccctctttaagtagatgttaagatagatcacggtatttcaaggggttcatgtattcttttgatatggtttttctcctcacagtctgacaaaatgtctagacattagagtggcaggaagcaaagaaacttcagaatagtcatgatcctcaaatctgtaggtgtgtggggtctgggagctggacagagagaatgaaaaaacatttccatttgtagatacacctcttttcttccgtagcaatacttttcatttctctgtatgtccctgaaaatcaccttgccaacttgtacaataactagcaaggatatcttttttgacctgtttgggtctgaatgtcaggatggaaaatctggtcccactaagccaaataaatattaaccctatttcggcaatttttgcatttttcgcaaagactcagaaaaagatatgtatttccattgcccaataaaaccagcaactcaggactttccaatcaaggggtggaaggtgaaattctattgttcaactagagtaattttagttagtaaaattgtgtagcttttagcaagcatggcttgcaaataaccaaacagcaagccgattcagtaataatggaaaaatctttaaagaattattgatgttaaaatatgataaaggaattcttccctgtagggcagaaaagccagttgctttattctttttaagaaacagttgcagggttgaggtttggtattatacttccatcccaggcatgcaaatctaccttttaaagggctggttgcccaattttatgatgaccaatttagttcctgaatatggggttccttttatttataatttattacagagcctcatcaagttattactagaaaatactagatggttctattatgataaaaattgtataaaaatttcaaaattcatataatgtaaaaggaggagagtaaacaatcttctagtgattggaaatataactaaagcaacttgattattttttaaggtgtcatttttattttttgaagaagcatttatatttaaaacttggtactgattattaagacaggtacagtttaaattgcccatttaaaaaatcgtatgtcattcccaaactaacctgtccatatgcatagagaaaaatacgtcaagtatgtactcattactttggcctttccttaatctgaataatttatttttatgaaacttaggatttttgtgatgttgcttcatcagctcatttccaaaactgctatatgatcttattcagtgttgcttaatcttaggaccatttttctttcacttatagtcctataagtttttttttttttttggccacagactcttttgtttctgtctttaaattagtggctgtctatgtttttagtcctcccactcactaccaattgctctcaatatgatgacaatttaagagacttatagcaagctaattgttttccttacattttccctatctatagatttctttcctcaaagagctctatgagaagtgttaggcattaaagcaacttaattgaagtaatatatgtgtgaacttaaataaattaaacataaccaaaatggttataataaaaaattctagtctcttgccctaactctcccatcctctctagttctgtgacccaaatgcaaacattttaaatctttcagctgtttcttcacatttctaataatattcctacatagctgtttctcattttatcaatgttagtcaatatctattcacttcttattctgatagaggatttagcactcttcctctgcatcccacctgctctccttatcccaaagtagttttattacaatttttagttaaaccagttatcattgtttgtggttttactatgtaaatcttgttcactgaagcgtttatgatttcatttattttcttgcacagtttctttccttctttcgccacttctaatcaaggtttctgattgtgtcttttcctcacatcattaattgcttccccaaaagctgttaaaatcatcaatttaatttattcctctgaagactttcctcccagacgtaggtagtttgctctccagtctgctggacagtgccatcgtggggattgttgttgcactccaaggtggactctgtgtcagtttttctgattcagtttttatttattttttgttattttaatttctgagatacacgtgcagaacgtgcaggtttgttacataggtatgcgtgtgtgccatggtggtttgctgcacttattgatccatcatctaggttctctccacttgcccccctgccccccatgtgctctggtgtgtgttgttcccctccctgtgtccgtgtgttctcattgttccactcccacttatgagtgagaacatgcggtgtttggttttctgttcctgctgattcactctttcattttgttgaagcatatcctacagcagctttctaagaaattatgcagggaaaaaaccaatttttcaattcttagtgtttgaaaatacatttatttttaccttcttttgattgaattctggcttagaattctagattgtatgaaactcctagactgaaaaaatgatttttcttcagaaacttacaggcactgctttattgtcttctagcatccagcattactattgagaggcctgaacccattaggatttttgctccttgtatgtgatatacttatattaccttttctttttgaaaattgttaagatttttccctgtactttttttttgttttgaattattgcaatggtgcattttggtatggttctttgtcagtatggagacttgtttcctttagtttggttttgtgaacctttattatactatttctttgataatttccattctgtttttctggtctctctttctgcaactctcattagatattggcatcccggattggtctgctgcttctcctataggtcataaggattacgccctcatggtagaattagtaccattataaaagggcaaatttggccccctgttgttctcttttggcccttcctccttttgccatgggatgacacagcaagaaggcccttgccagatgctggcaccttatattagacttcccagcctccataactgtgaaccaatatatatctgttcattgtaaatcacccagtctgtggtattccactataacagcacaaagtggactaagatggctacctccttgctgtatcctcatatgttggagtgagagagctctggtcttttcatcttcttatgagggcaccaatcccatcattggggtaccactctcatgaccttatctaaacctaactatctcccgaaggcccgtctccaagcaccatcacattgggaattagggattcaacatataggttttggagcaggagacacaaacagtcagtttgtagtaaatatcatatcattttttggctataaataagtttttgaagctttcttttcttccctgaattatctttatttcttttattttctttcatttctttcatatttgcttgctttattattttaaacataaaaatttcatggttgttttattccattctgtcccgagtattttaggttctgggcctccctgagtttctaaagaaatgagtgggtctgtgttattcatatctgttttagatttctctgccctgctgagttgtcacttttttgtctttgaaatatcttgaccactcctgcccactccttttctcattcattcactattactacttggggtctaagaaatgagaccccaagtagttataatttactactatcaattagaaattagaaatatctttagtaatttttaatcagtttttgcaatcaatattttggtgccccagttagagatttggaatctgtttggaaaaaaaattaaagttttatgtacccaacgtttaaaagccctgttgtcacttgtagtcttgagagataaaaacataaaggacaacttgtttcttttcaagtattcagaaagtgtcataaaattacctttcatcaacttcaggtttagggttaaaaatgttcaataaaactacactttctttctctcctctgtgtctcttgactacctttgaagcacttttcacacccatcaatgtacttggctctgagtaacttctcagcaggcccaatagaaatggttgatagttacaagcaggtgttgctgacaactcatgtttctcatttttacagatccagtgtattttatctctgccatctcctttttccttttatagcttctgaaattgtgttttgtaaaaagtcacttggctatcttcacacagtttccttgttacaataggtaaatgtcaaaagtgatcagatgcaatatcagacttccactgaattcccccaagccctccggcagataataacttcttgcaatattttcttaatataaatggaaacagatactaacccaggcaaatgatccctcctgagccagctgtccttttcaatatattatccagaagattacatgaatatttattggccctccagttacacatacaagccaaagttccactaacagtgtatacagtatgttttaacctgaaagaatgcaatttcgcatgactggataaaattaaatatgaacagaccctcaagcgaagtgttcaggagctagaagatcttgatcatatattaactttgaaaacaacttgcagtgtgacctctgaatggtcaaataaattatgtcagttcccggacttgaaaagtgagaccatcaccacatgtggtctctctttcttatccttatctttcttacccaagtattgtacattttaacttcatttggatttctgcttatatgtactttctctcatgacttatattttaaagtgttataactatatgtgttttcagttttactaagcaaatatacatttccataattttatttgagactatcatcacaaaatgacttttattatgctaacgtaagaaatgaatgggaaataaaaaaggattgaagagattcaaaacgtgttttgttgtccataatgaaatgccaattatactggagggggaagagactaaaagtgaaaaaaaactccttggcaaagatatgcagatggaaaaaagcacactaacgatcttcaatatcattagtctttagagaaaaacgcaaactaaaaccaaaatgatttgagaggctgaggcaggaggattgcttgagcccaggaattcaaaaccagcctgggcaacatagggatacccccatctctaccaaaaaaaaccacccccaaaccccaaaatgacatactactatgcacctattggaatggctaaacattaaaaaaaccataaaacctaaaaataacaagtactcacaaggataggaagcatctggagccttcacacatggaatataaaatggtacagccactttggaaattggtaccatatgaatcagcaatcctacacctagatatttaccaagtgaaataaaaccaatttccacacacaaaaagacctatatgaaaacgtttatagaagctttatttgtaatcaccagaaacaggaaactaccaaaatgcccctcaactagggaatggataagcaaactatggtgcgtctatacaatggaatattattcagcaattgaaaatgaaacaaatattgacacatgcaacaacatggatgaatctaaaatgcattatgcttagtggaggaagccagactgaaaaggctacatgctgtatcattccatttatataggagaggcaaaactttagaacaaaacaaatcagtgcttgccagggctgggagtgggtgaacagctgattcattacagcagtagttataactaaacacatctgtcaaaactcagagtatagactaaaaagggtaaactttactatatagaaattaaacctttaaaatagggggaaaagtgaaaaagcagaaggagataagaggttttggatggaaataaatagagataagtaaaaaggaactgatgtagaataactaggagacaggaggtgagcaggggaaagtgtaagggttggaagtcttcagagaagaaatcctgtctaatctgagtcataaaacacaaacaggactttgccaggtggtcaaggttaggggaagcaggcagcatagtcacagtggtatgacttgcaaagacacagatctgtggattagcagtgtctgtgttgtgaggggtgagagtgcagtgagcacagacatcagtgggccctggaataaagaaggaaagccaggtcatgaaaggtcttaatgtctatgctaggggtttggaatttatattatagccaattgaggagccactaatggattatggcagctaagtgagatcatcagactcgtcttagaatgagtctgatgataataggtagtatgaagggtagactgaagcatagggagagtgggaattaggctggaggcagggaagtaatttaaagaccaccataatactccagaattgtgcagtccaacatggtagctacaagcatcatgtggccatttaattatttgaaatcaaagataataaaaaattaaattccgggtcatgccagcctcatttcaaatgctccacagccacatgtggctaatggccataatgttgtatagtgcaggataaaacatttccatattgcagaaagttctgctgcacagtgctaacctagaaccttaaggaaggcattagcagtggtggtagggaatgcctaatgtatccgtcttatatctggaaagcatgtttgggtaacagtttgccttcattgctcaagagtgacaaatataattgtgtataaattccgctaggatatgaatgtaggtacctggaggtctgctttaaagcttgtgatcatacacatcgattaaagctaagagtgacttagcaccaggaagcatcaatatcagtgattaatttggcacccaggttttattgtatttcaattttgtcaagcgtctacaagaatgtggctatttttcatcttgctgttcatctagcaagtctaataaacatctgaatgaagatttctaagttgaactattcttctacttcatgttatctcaactgctctgtgccagaaaactataagaacaaaaccttttacatgtgctctttcttgctttctggaagaccctcctctcatgatgaatccgtaagtatacatctttatgatgaacagacttataacagaaggttttaggcacttcactcttgaaagcagatggttcatcaggtacccaacatctggccatttttgtagagcaaacccttgcctggcttagagaaacaagatcttggagaggtcagattgaaaaatgaaaatggcaatggcacactccactatttagttgattttctctggcactgcaaaaaccttgggaatgcctagtgatctgactcatcacccagaaaaggctgtctgattaatctgcagaaatgattccaaccaagtactcagaatagtttggttgggaacaaatccagcttcaattgcaaaattattggtggtcaaatgcacaaataaaaaatcttttaccaagatttggtgtggtaggaaagagtttcggtagaagcactccctaagttcctgatggaaactggacatcaaaaagaaatattttatcccaggccaaatgggaaaaatatccccttataataccctttcaacatgactggacaagggtgataaataacagtactgtgttcacttaacaatttgctcttaaaatggttccacatgtggaacaagcttcattaggacccttctctgaaatactttcttatgtagttgattgttgggaagaaagagaaaaataaaaaatcacagagagcttaatccaccatgaggccctgaatgcagtataaagaaaaactgtcttttgcaaaagtgccctgcgggctctgaatttacttgaacctaatgtgggagagtgatgggcatcctgcattggtagaggatcatcctgtacatgatgcctggggtctcttcgcagttgcaatctccctgtactatctagtgaataagaaggagctgcaggacataagcccagaggaaacggccactgatcacccatttatgagctttcaaggcaactgaatagctaaaggtaagaagatatccaccttatgctgctgcctggagtctttgaacacaataataagaactctcctgaaaaatgattccctagtgggggaaacatgatttatgaggtctattcaacagtaagaaaaatagtccagaattttagaaaatgcattgtgaacacacagatttttttgatagattgtattgctcctctttttgaggataaataagaatgatggtgttctctgcagacttattctacaatataaagatccttaaatttgttagtgctagcagagtaaaatgtttgcgtttgtctttctattttacttcataaatgcttcagtgttccggtatcaggggacttggagtttgatgctttatatttatatttatatttatatttatatttatatttatatttatatttatatatttgcacttgtttgcttactagtaggaaccaggcggccaggttgtaatttgggaaaaaaaactagtcatgttcaggactgaaaaagcggaattgaataaataggtcctattcattctgacctcagtgagtacaatcctataaaggagtaatgtgatacagaagttgtttagttggaactgaaatgggttgctttgttaatgagaattgtaagtgaataaataatctgaagtaatacttttttctaaggagtctgggatgccatccaaatcctcctatttaggactatataattattgctgaggtggtgctcacacagatggatgacggttccaagggttggttccaggagaggtgaatcagggggcacattaaggccactgcctggcccttcggagaacaagggttttgcaaccaagaaatgtaagatgaccggggctggccagaggcaaaaagacagcttccctacccctgacttgttagggtgctctctcatctgagtcttcattcaccaggccccaggctgactgctgaatcatttacccaggctgagaacaactgatggcaactctgtattctgggacattgctccggttctgctttattatcgtgtgatttctcactctggccaaggaccagctttcatgtaattcctcccctaagtgatcctctactgcatcgcccattgtcaaaaatatgtcacgctacctttgcgagatgaaacagctaggtttgggtgcggagtaacttaggacagagcaccagtcacagtcttccttttgatgaggattgcgctggatcactgtatgagaagcatacagccccatcgacataaatggcatgaaaatccttgaaaaaaacctatcaggaattgtgaaggatccaaagaaatgccaccatttcttgcccttaagcaactcacaacttttgtggggaaagcaaaacaaaaacacatgaaaagtgaaatgactataatagcaataacagacacaataaaagaagggaagtcaggaagcagtaagcaataggcgatgtttactgtttgggcaatagtctccacctcctaggggtgctgtgaagattaaatatggtgtaagattccaagcacagtgcctgggagaaaccttcatacaaaatattattgcataagagaagcataccaagtgacaacaggcaaaacatggcctctgggacagggtaaataactgaaccagctttgatggaatggaacctgtgaggagctgctggcaaaaacagatgccccagggtcttgaatggacaagagatgtgtttaagctttatcctgcagatatttgtatcaggagtgttatggtcaaggacttggtacaggaggactggattgtatgtagaaagtgtggtctttcttgatgtactttgtatcattagcaacgatctaccactccccccttagcccctggctacctcatggaacagaaattaagtcacaataataaatgtgaaaagacttacttgactgaaaacatattatatcagcatagatgatgaatacagtcttatctttgttgtatatgtaggctttcccagagattttgaggatatgtgcttatcttcggcttcaattagttatattagaagccagatacatgaggggaaaaccagtactttatataggttccccaccccactatttcttctgctatgaaagcactcacagtaatattgtgggtgacaccactgtgcctcctgagtgagccactctcagcataatcaaagcccacagtaaaagcatttgtgttgttgaaggaatccaaagcagggattcatttaaggaataagagaacattacatgttgagaagctggttaagaactctgaaagggaacttgtttgtgcaaaccagtgagaaatagagaaatgaatgagactcactttctaattcctatgttcaacagtgtgggtatttcagtagctctagcaatgactttcggagatggaacattgatgggtcaaagtttataatgacatagagaaggctaaggcactaggataagcaccagttgcatctattacctgtgtttttaaggcaatcaatgaacaaacctcactatggaggtttgaagaaaattcactgccacaacccaaatcccaataaaacctaaaatgaatggctaattggttgctatttggaggatttactgtaaggcagagctttgtaaacatgatgccactgaaaggggcgtgccttaaatgttacatgtgtgccaagacagttggggatggttgggtgagcttggtgaggaccaggcgtagagcctcctgggggactgcctcttgctgccatcagcctcattcgttttatctcagcttgttatacaaatgccatcaatttacaagtgtgccaagaagtgaaggaggttgaaaaaacactgccttatattgccttgaaaggggagctgggttagtgtatttaagtgattgtttaagataatttcttgacagaggttgagacgaacaaaagaactcaaagtgttaggagccattttcattatgtaatcaaaggtaaaagtaataaaagttaaaatgatagcttagctaatgaaaaatatgatctaggcctcaaacttacccaatacttttttacacaccaacaaaactaacttaataccttattttccatgctgattcctggcatcatgtaatttagagctggaagaggatgtaaagaccatcttcttttatattttaaatgacaaaaggacacaggaagaccaagtgacttgctcaagggatacaatatttggtggacaagctggagtgagccttgggctcattgtccaatgttcttttcatttagcttgaatctccttgttttgaggcaagagtagagagaccttggcttttgttttactttgtgcctcctctaatttcaatgattattcagtgtttgcatggttagtgaggtgagttttggtgggggaaatcctaactcacatcacttctatttcattttgatttcatcccttttaggaaccatactctaaaatgtcataaaagacctgttagtgaagttttaaaatctctaggataagttttaatctccaaagcctatggacatcatcaaggacttcgagaaactcaccagggtgctttatcaaagataactaattccttccctgagcatcagattgcagtggccttagggaaagtcaagaatgaccaggtccaaacttcaacccatgctggagaaagcacacatgtggaaacaaagattttcagcaccagtcctgagctggaggattgcgaggagccagcagcgtgctgaccagtgatgcacttgcggatagggacagaagatgaaatcaacaccactagaggaacaccaatgaagaaaggaaggattgaaaagtttgttcccctactgctgactgtttagattgatgctatgaccactgtcctgaatatgttctaacctgctgcttgttatcctatatctaagtttagaaattccctcaatagcctgtcaacctccaccaccgatacccaagctgccatgtgtgtctacctcatatattccggcataacctcctgacaagtgacagaaaaggtggagactttcaaattatagaaaagggccacttcattacttgtaccaaagcccttcttgggaacctctggtgggaaagtaggtttgttaaggaggtaggaagcacctataaggacaggtgctacagctggacaataaaacctggatgtcaggacttgggttttgagtagggaggaccaaggattggcctgacaacctcactgcacgtagcccctgggacattttacagagcaagcatctaatccattgagtcataggctacctgagtcttctctaacctgtgcatgcagacctcagtgagaatgaaaacagttagtcaatggcagaaaatgcttcaaacttcccaaatacaccaaagttatctgttttggtgaagtttctaacattatttccaattttctatgcttaacaataatatagcaatgaacattttgcatataagtctttgttcaaatctttttaagaatttaaagtgaaattgcctattacagtttatttttattcaaggctttgttctggaaaccactttagtttcccttgggcccaatgttaaggtctgaaacaaatacataatattttgcataatgggaccaacatgcccaggatgcttccctgttctcactggaagtcaagaaggataatctggctgggcacagtagctcatgcctgtaatccaagcactttgggaggccaaggtggacagatcacttgagcccaggagtttgagactagcccaggcaacatggcaaaacctcgtctctactaaaaatacaaaaattagctggacatggtggtgcatggtggtctaagctacccaggaggctgaggtgggaggaggatcacttgaacccaggaggtgaaggttgcagtgagcccagatcatgccactgcaccactgcactccagcctgggcaacagggtgagaccatggctcaaaaaacaacaaaaacaacaaaacaaacaaacaagcaaaaagatattcctgcactacagatagaaagcttctaagcttctaaaacctgtctactcctatgcaatggttggcctacttggtcactgacctcggaaggaagcagcttgctccttcattacattgattgatataaagttttttccttatttcctggggaaataatattttgaaaacaaatctgtcagcctttggtaaagagcattactaaatgccagcaaataagtaagaaaccctaactcccagtttcccaattagctgagcatcacctgtgcttggcaaagttgttgtcttggctgaagaagctatggacgtatctccatccatagggagggaaagtttacatttgggtccttcttctctcctctctcctctgataatatttaatagcaacatgtttgcaagggagattctaaaagacatccccttgagtctgaatttcgatgatttccattacttttatagcttattggcttgtgaactctggagagggaaaactgcaattctagcctgaagcctcagcaaaggcacctcagctggactgacttggccaccagtactccagttgcccccattgctgacctaggctgtaatttggtgggtagtgagaaagactgtgttcccagaagggccacatgtggggaaggggacagggaggggaagcttccctcagagatatgttcatctgtggcccagatttagctgccctgggagagtggtggctctgactaatggctaacagaacctatagccagagtaaactctgcactactcgacaagagtgagctggtggaatgaaagataattcctagaagggatgatatctagatagcagcaatgacatatttagtgcttactctgagccagtgctcttttgagcacttccacatattcatcgaactctcatggcaaccccatgattgaggtattaaagtgttcttttcttcacaccgaggaaactgaggcccaaagaggtcatgtaacttcctcaaggtcacatggttagtaagtgatagagccatgtttcaagtccagataggatgattgtagcacctgggctgttaaccatgcccttttcttgcttaaatgtaatgatgctcctatcaaaagcaaaacagcacttagtccaccaagaaaaagctcccgaagccacgaaaaaaaaaacaaacccaaaaaaaaaccccaaaaaacaaaaacaaaacaaaacaaaaaacagtgaatatgttaatgatccttgggctcgggtaagacctgaagagtaaaacaatgcaaactctgggaatgatcgtgattcttaagtacctgatagcataaacctcggtcagtctcagagagcccaaaacctttgatattttgaccagggatatgtggcacaaggatggctttttaccattcacgagacacttcgcatttctcttcaaaattagaattcaaaattatcacagatgttaagtatgaggtagcatcagctccaggaagcttttaggtgcatgttgcaaattacatactgtaaatgcaacgtgccatcagtgagtaagctgcttttgccacagagcacggggcaacttgcattttaaactccctaaattgaaaagaaataaacatgtgaagaaaagccatgaagcatcatgaactgtaggatatatttccactctccagggtgaagtaaaataatatcattttgaaagtggttagaattaaattttggaggtcagtctgatgccatttggtaggaagaaaaattcacatgttaattataagcatttgcacctattgttttccaaatctacttatgcatggattttatttgcaataggaaaagtgtttgtagtttctttacatagtaagtgcacatgtacacatacatacacacacacacacacattcccctatacatttagaaataaggctgttatacttcaaacaaagctgagactttaactacatgctaaacactttcattgtggccatatactttttatttttattctagtcctttaggtattctgccccaataaacaattggaaagactggaatggctgcaaaatctctctgtgaacaccttcctcaagtgtaaattattggaaggctgtttatataattcatgaaaatccttagttttgtatccttttaatcttggtgaatccatcgtactgacagaattctgcttttagtctatgcttaaagattggatttatttcttcagcttttcatgaagaaaaagggaaatgaaattgtactttcagatgtatgtaatttggcttctgcacatattcgctgaggtttaatgcttctgtagttttcactcctgaatttatcaaggcttaagccaaacagggcaattctctccatgaggttctggtggttttctttctttcttttatttttatttttttgataacattaactttatcacataaagttcttattcattctcaacaactttatttcttgagtattgcttaatactcacccctcccctatcccacatgtgctagaaactcccacagtttataagaattttaggactacaacgtacgtgcatttatttactttctcttagtgctcctttattttcgtgtttccatacccaacattttgggccaaatcacttcaacatgaaaaatgcacaaattttcctatcctctcttctgttctactgcttgcaggctgctgaatgagctctggaagactgtggtagaaaaggaaaaacaaccaaggaagcctgagaatctgaaaaggtggccagttggaagacaaatatgggctatgactgtcacctgttgtataggatcatagaaccttagagctggaggagcttcagaagttgcgttcatctacttctcctccctctactgctacccaggggagggtgaaactgcctttgccaaattgtaaccgaggaaactatgacagtggaagaaatcagacctaaccgactccatcttgcttctaatctttaagtcgtccttgttcattcctgggcataggccaagctaactttgagaaggaattcagttcatggtttgacttaaacaaaattgataacagctctttccctgaaagacccgcttcttgcctggggaccaatctgcctttgtaggactaacaaattagcctcaagattagaaattacagtttaggggtcatgcagcctctggctcctagagtctgaacctccccaaattgctcctggggataacatcactattgtaaaacctaagatcagtgcttgagatattttgcagaccttgcactcagtgtatcagctgacaccacccagaccagtaatctgctttaaccaggtctgccatcccacccaggaacagaagacagcaagaaaaccacacttcgaccccctatgattccatctccaacccaaccacatcagcactccccatttcccaagcccctacccaccaaattatctttaaaaactctgatccctgaatgctcggggagactgatttgagtaataataaaactctgtctccccgcacagccggctctacgtaaattactctttctccatcgcaattcccgtcttgataaattggctctgctaggcagcgggcaatgtgaagccattgggcagttacaaagtcaccagtgtctctgaacctacagggatgtttaaatggccttctgactatatctcatgcttccactcttgctttctcccccacccccaaccctttggtttcaatttccacaagcatttagactcatcttttacaaatataagtcagatttcagtccactgcttaaaaccctccaatggttcccatggacttagactacagttgagacttcctaccaagagcacatgaagccagcactgtctgcctcctgccactctcccttgctccccgtactacagctgcactgggcttctctatatttcttggatgccaagcttggcgtccaccttaagccttctgcctggactgatttttttctgcagatcctttgcatgtctggttctattctgttgaacagttctcaatcaagttacttacagaacattccctgaccaacccataaaaggaagcacccctcctttcaaggcaacattaccatatcactctgttttcctttcttcctaatttacaaatgaatgaagagcttttataggggtggaggagttgagggcattagttgtgttcttgccttcttcttgagccagaggtcagtaactgtctgctagtcagtggtatggatgccttatttgtgcccacagcctgtggctttcaggctatacagtatgtccgtgacagtcttctgatatacttgtccggtatctgtatcactggaacaaatcaaaacaagaccccttattcaaatgcaggcaaatttcagcacttacttatagtggatccagactcaggcctgttcagggagctgatgatgacaaagccgaagccctcattctctttgcggtgaatgaccacatcactggtctgcaggctgtgggaggcgaagccttcagggggagaggcattgctactgggggcagcgtggttgctgttggtgtaggttgcgtagtcactgcgtggagagctgtggtgggtggatacagagcctggacttctcccgttctctgggcagggctcccctgcaaaatataccacacacaggtaatcaattaccttacaagggtctcaatgaatgcttcctatgtactaggcactgttctagacagtggtattgttacaagactggttgaactgcttctctttctcccagatttgcagagcatttgaaaagctacagacctaggcgtggagctcccaaggtcttgctcagtcctagttttcatagcaaacagaggtgaaacccctcatcagcctcctctgtgctgttactgatttatatcttcatctcatgaggactgcaaacccctgggacaatgcctagttttagatattgaggttcttctttgcataagaataatttactgaagatggtcacaaaacaagtagaatcttacatgatatggtgcataagaatcacttaaataaattgtaaaaaaaagtacatcttcacgggccacccacagaatgttttctcagtaggtctgggcacaagaatctgcatcaagtttcaaggctacacttcgagaaatgctgctgtagatgtattataaggaaggctaacagcacaggtgccatccatgtaaagttaactatcatgcatttttctaaagagctatagttctattttataatattctgctagcctagaagtattgatttacttcatgtatgtggaaaatatacttcttaaaagtagtttgcacagctttttgtatatcagccatatcacaatgaagtggcttaaaagaataaataaataagttgagattttcatttaaaaaatagcttgcttgctctaggatcaaatctaatttcaggctctgaaattatgaagtttgaacctctaaggagctgttgaaggtcttttccatttttacagtccatcttaatataaaatacaccctattatcaaccagataaaccaaactaatactttcatgagaaaaagccagcatatttccatggagaaatgatagaaagttggcagccaaaagaagctagtttttgaaatgaaagtttatctgtcatccagaaagaatttcgtcattttaatttaatacctaggtattggcactctgatgaaaagaaccgaagcaggcacctagaataatgtaattagaaatagggttgctttcatttccatcttaaaatttgattagtgtactcaaaagatgtttatggaacagaggaataataagatggaaaataatcaccattaattattccattttgggtccctaggtatagcatcctatgtagaactctggaagttgttgcatatggcaaattaaaaataattttcaaaagttccaatgaaggctcttaaccttacaagctgcaattccattttgagatgaaaaagtcagggagaaaaaacaaagactgcaagagacgttttgttacatcgatacctaaaaaaaaaaaaaaaaaaaagaaaaaaaaaaagctgtatttgtttatatacttagattttaaaaaatggcctaaccaaaatatactaatttcttgtttgcaattacagaatgaatgagacccaggctgttgctcgttattatttggtaaatttgatttttctttaagatctaattaatcacgtttaaataaaggaaaagatggatgctttttgtaagaaatgtaccgaggtcataagagaacagaatgtcaatgtcaaagcctttctttctgttcaaatggaatttaaagcttcgcttgtaaaatgtaccctccctgctggacaagttgttattgtcttggtgcatcacatgtcctttatcagtccttgtacaagtgggaaataaagtgattagggatagtcaggaagaacaaaaacaaacaattattatgctgctacattaaattgaaaatctcctcgagttattggaccaaaccagtaactaaatgtcataggcagtgacaagagagatctcattttctggctgtcatattttaggaggttgagagctgtgattgtcagtaagtcagcaagaaagaagaagcgcggtggctcacgcctgtaatcccagcactttgggaggctgaggcgggcggatcacgaggtcaggagatcgagaccacggtgaaaccccgtctctactaaaaatacaaaaaaaaaaaaaaaaatttagctgggcgcagtggtgggctcctgtagtcccagctactcgggaggctgaggcaggagaattgcgtgaacccgggaggcagagcttgcagtgagccaaaatcacaccactgcactccagcctgggcgacagagcgagactctgcctcaaaaaaaaaaaacaaaaaacaaaaacgaaagaagaattatctgtctttgcagtaaaaggctgggagtggcaatgttacaggttctggagagagagaaaatcatcaactaagtcaatgtgaggattccctgggtaagtcaaagagtcatatacattaataggatacttttctattgcctttggacttctctttcaacttccagaacaaagttctttatctttagccaaatgagcatatttaaaatcaggaagttaagaagacttcgaaggtcttcctgggcttgttctgggcccttgacacttaaaaactggtcacatgattgtctttcagggattgaccccacatcatttttctactcatctggctctggacccaagtgagacggtcttctttccaatggtctttcctactgtagggcattaacagccttgttttataataatatagtaaaacatcctaaagtgactaaaattcatgtattatataatttttttaaagaaaattcactaatttctaggatccctgactcattcatctagctcatacacaagtggctgcatagaattcaatcacttagtatctactaaagtcaaataattagtttagtttgtttgtttgtttgttttgttttgagacagagtctcactctgtcgcccaggctggagtgcagtggcgcggtcttggctcactgcaagctctgcctcccgagttcatgccgttctcctgtcttagcctcccgagtagctgagactacaggcgtccgccaccacgcccggctaatttgttttgtacttttagtagagacagggtttcaccgtattagccaggatgttctcgatctcctgactttgtgatctgcctgccttggcctcccaaagtgctgggattacaggcgtgagccaccgtgcctggcctaaataattagtttttagggtaagctgtttcgtctccaccagtcacagtggaactcatcactgtgctaagagagggtctcccattgggaatgtgggagtcagtgacaatgcctgccaggtaagatggtgtagaccagtacatttaactattggccaagagctgtttctggtctgcacagtgctggcctatatttcattcgataattgttaaaactaattgccctttgggaggccgaggcgggcggatcacgaggtcaggagatagagatcatcctggctaacatggtgaaaccccatctctactaaaaatacaaaaaaattagctgggcgtggtggtggtcgcctgtagtcccagctacttgggaggctgaggcaggagaatggcaggaacccaggaggcagagcttgcagtgagctgagatcgcgccactgcactccagcctgggcaacagagcaagactccgtctcaaaaaaaaaaaaaaaaattaattgccaatgtttgtaaatagggagatttttatagaaatactgatttccagtttttcttgacacatttggcaccagttggctggagctcagtgatggctgctccttcaactgggtatggggtttgcaggtcaccacagtcctgcccactccccaagacctcttgcaaatacctcatttactcatttattcacacagtgaggaattctcagggctgaaggaacttgttcaactggacccttggtttctcttctagaccatatgctacataccaggactctagaattctgtaaccatatagaccttgcctgcttccaggatgtgcctgggtctcttctcaggactgtctttggaaggatgacagcattgcagacaggcatattttgccttgaagcatggctgaggcaatgggatgtatgtatggacagagcttggtcatgtgggctgtgatgtccacatgcatgtgtaccaggtccctcatggtccttatggggcaggagcagcctacaggctgtggccctgaaaatgttaggggctggcctgcctataggcatttgtgcagacattcccagtttatactcatcaaggcagacagcttatttaaatgggtgacatggttgcagacaaacaacaagggaatgcatttagaattggcaaaaagtgtagtcaccaggatcagggaacgtactggcaccttcaatactggctaaacttttcacccatctgccaagacaacctccccttttttggcattaggccaagaattagactttcccttaggtgttagagaaaagatgctgatagctttaagactgactctaacatgtttttatgaagtcataaaatgttctttcacatcaattctagatttacacttcaggaaattcctcagagacatggtgtgcatccaaaataatgtgccattagcttgaatgtctcaaagctgatctgctaaacatataaatatttatgcttttcagtataataattaaagccactcttctcatatccttgggaaaaaaaacaaccaaatactggagctggaggcatggataaggcatcttctctcaaaactaatgcaaggtgaaagtgtgtgctatgactatttggtaaataaaactggaggcaatttattatccatagttgcctactgaaacaataaaataaaaataaatgaataaaagaaaaattggaagcactacccgatagcctcttcctttactcaacaacttctcacttttgagaatctagtttatcttctgattggaaattctggctttctaggccaggcatggatcactgaggcagaaggatcacttgagcctgggaggttgaggctgcagtgagccatgattgtatcactgcactccagcttgggtgacagagtgagaccttttctcaaaaaaattttttgcctttctatccttagcatgtacatttaaaaataacttaatatttggggcaagtttttgtgttatcttagtttttgctcagtgtaactaacctttctgtatctctcataatgaacgtgttctctttcttgagcatcagttaaaaagccagtgccctctgtcttctgaggtggggcgggcatttgtataagctgaggcaaggagaaggcggaagcgtgtcatccctatgaccttgcttcttcctagcccttttcccacacacagcactgctcctctgtgcaagggggtggcgatgctgctcctcttcctgctgctatctcttccttagctaattgctcacttcccctcagcttggaaccatccactcctaagccaggcttgcacctcccactgcctttgcttaggaaagcataataataacaaaacgacaatgacagcaacagtccttgaaaaggcatctccattgtcatattcatttgtagttgtcccttctcactttgaagaaatggcagctatgaagaaaggtcacctttccatgcctgttttttaaatcttttccatcctatttcaaggcattactttgctatcaaagtatcctttgctgaacttaatattttcaatactgatgaagctttcaaggaagagtgggctgaataaacttggaaactctcctggtgtgaacgagcaatctgcagcataacattttcaaaaattaaatgcacttgaaatgcactcaaaagcctaactgagtaaagttggtaagagctgcagcaaagagcatctttacggaagtcacatgatccacaaattgcaggaatacatttttgcagcatttggtacacacttcaacagctcgggttgattaaaagaaaatttaatttgcaataatcagctggtgacaaggggagcatgaaattatgttggtgcattggttttgcactttgtggtatatttccttgtaaatcaggtatctttttaatttatctttaggttatagaacatacagcacagcaaactttttattaaaaattactctgcggggagagagacagttaaatgttaaccaagcaagcactgtcttcctcctggcatctagcccaaggataaggcataatttaagatgctttacttctttgggtcaagtgacatgccatgaatttctgaagacaaatggcacctcttagcaaaacctctataagatacaagatatatagcagtctctactggtgagggctaacaattcttttgacttgcccttttaaatgaccgcccttgctcatggtctagtttctagggggacttagaaagaaaaggatttttcgtcacatgaataagccttatcctctctactagtcattcacagcctgtcattagcctgtggtcctcttctagaatgcaactggtataacagcacatatgggaagactccctgtattagggagtgacatttgctaagttctggcctaacatcttctaattctctaggggagaggattgtggttgaatggggtaggggacaaagtaacataaagaaataagcactggccttagagagaagagtccctctctgcattgtcacagactcactgtggactgctgggcaagctaccaaacctctgggcgtcagtttcttcatctgtaacaagatgaagctcatatagctaaggtccttcctacttctagtattgatgattctgtatgagggctatcaaggggtcaagcagagaagccagcgggccgctggggcagaaggtgacagatgagcattattggagctgctgcccctgtgattcacagaacaaaggctgggtggttctgaggggaggtaatacaatcccaatgttattgaatgctcagattctaaaaaaactgtgatgcttgtaactgacatattccttaaaaatataaataattttttatagggttgatatggtaaagagagataagtggaatcatattataaatacaaaggctgactttgaaaagtatgtctttggtggattcctttatgaagctgagaaaatggttgtaaagggaatgattatttccaatttatctgttacataaatttggaactatatgaactgtgttttcttggagcgaggtacagctgtattttttctatatcaggagcaacagctttattgttaccttttatcaggctgtacaatgaaagctaattttccatcctggttgcctcattatggcatcaaaatgctgtggctcttggtttgcaaacacattttcaaatggcatattttccatgactatcatgttcttcttagaactagaaactaccagaaagcagagagcatacataccttaaattagccccaggctattctagaaatttttaatgaatacatttaaaatgcaggcctcaaagactggatttttgtccagtggggtgaaaatcagcactttcaaaatcatcattacttttggaatatctaggttgtttccttcctcatataatgtagaaatggatttaaaattttgtttcatgtggccttaccatgtctcacaaaagcatcttaccacctaaccctcgattcctgcagcaggctccaggtacatacctccacatagcacctttcttctcacagtgaggttgacctgcccattgcgggctgcgtggtgcatgaggtcgatgacatagcggtgggttttgccggctactggaatcccatcaacatacacaagctcatctcctgggtgaaggcggccatctctgtcggctgagcccatggcaatgacagctccaatcaaaatctagagaagcagtgagaaggaaaggacattcacatttcaatcctttttccttttttttttttttcgaaacagagtctcgcttcgttgcccaagctgaagtacagtggcccagtctcagctcactgcaagctctgcctcccaggttcacgccatctttttcctttttatatacagttatataacttgtggaagatttgattctcacattccatctcttgccctcaaatctgagcatgcacttgtaaagtaaaaaatgagatgttggaaagatgccctttcaactcttttaagttgtttagtgctagagataaatattttgaacatgctgcagactgccatgaagttttggggacacctgctttctggctcatcataaatgacgaatacccttaaggaaaattctaatcccaaataatctgatgctaattggctgaaacaaggtgaggattgaattctggctccgtttcacaatttgtgtggtcttgggtaaagcttcttaaactctgtgagcctcagtttcttcacttgcaaaataagaaaaataataatcagacctacttcatggagttattgggagaattggatgaaataactcatgtgaagcatttaacttttttcacggcacttaacgagggatcaaaaagactcaaggggaaactagctgttgcacatttttaaattctgacaaagattgaaagttttctttttctttgctttgaaaagctggagggtaaggagaaaacaaaacaaaacaaagcaaactcatagttggctttttctggccagttgacttactcaaaaaaatctcaaaccttctccagatttttgttctattcttttgaatacttcctcagagcactgtcctctacgcaaaggacattcccagttctgcctgttccctgaagtgcttctgctgtttgggtggctactgtgccaggaagtgagaaggtacccgtctaggaaatgtggttatttttataattccctgaaccagggactgtgatgaaaggcaacacataagttttcccatgtcccattagaggcactcagtttagtgtgcattagcagggcttttttctttctcagaggaaagaaaatagtattacatattttaattttgctgtttaacctataaacaatttttcaaactcatgaccaataggtcccccttttcttttgccagtggcttagccacacagcagctgatggcagtggttaccattagcctgatgatactacagaggctatgtttcattttaaatcccttgcttccagattgatttccttcaggcataataatttctttcaaatcccctatctgtgaattccagctaatttgcagagttgctccatcatgaccttcgggcttgcctttgtacttagtctcactgctcagtgtggcctgttaacatgatagccagatctgaacacccaggacttctcaggtatgtgcaaagttatagtctgaagggcatcacagacttagtccatggaatagctctctttctacataggaatgaaaatttcccacactacttctgctttccccttattcctggggagtgaggtagggtgagaaatagatttgcttctgtgtggaatattaagtgttctgacaaatgattcatgattgctgtcacaggacaggcctgacatctcctgccttagactggctgcacagtgcagttctttccctgcaactcactgtaaccattcactacagtccagaagttgggtatgctctgatattctccactttcccttcttgtcatgccaacctgaatttatgagtttctttataaagatgttccaatctattcttcaaaaggctcaacccactatggagcacttcaaagatttggtaagtgctttgtgcaaaagccagttaaaacaaatgtttctccactgtcccatgaaaaggtgcgtttagttggtttggccttaagaaaatgcttcaacctttagctttccgatacactttagtgagagactttacagctagtaatagagaaagaaaatggcttgtgaacttcttggctggttaataatcaattttaaggtatagctctgattctaactgatgaaagtaaaacacaaaatagtggttacaactgagagagccatagctgctactgggccctatacaaaaatagtaaagatgaaatttcacatcagaaaattcctctcttgctgtaggagaacagcaagatatacagcaacatttacagatactctcaacattacagtgtgtgccagcagtttaatatcatgtattgaaaaacagagcccagtaaaagatctgcttttctaccatattgctgtgatatgaagtactcccctcattaattcatttattcaacaaatattcattgagcccaggatacttttaggtgctggaaattcatcagtgaacaataaacaaaaatcactaccctatagagcttccattctagtggtcagacaatcataaatataataaatgtgtaaattatataggatgccagaaaggatgtactatggaagaaatacggtggtggagattggtgtcagtcatgtggtcaaggtagtgctagagttggttagagtaggcctcttatatatttatttctaaataggcagtatattcaattaccccttcaattgaatatctaataaatagcatattcactataacacaagtataaattatatagtattacataattattatatgtatatattattatatagttacattatataatgtgtccttagctgtgtttcaaaaaaaggttgccatactgttaaataaagttgaattgagctgagcatggtgtgccgtgtggttgctagtgctgcttgcccattagcggtattgtacagttacatttgctccatccatcaggagctgcagcctttgctgggcagaggctgaccacttgcaccgtcactgcttccagctctcctgccgctgtgctccttagcctttggcatttggcacctttgtgcattatatttcactgctgacacagagatagctcgatatatctctctattctgagaaaaaaacaacttttttcatttacttccaatatgatttgtacccttgacacattctattatttcccctttgccaccgtagggactggataatctatgattgtatcttgcactgtaactcatattggtttcccaatgcatacattctcatgttgcttaagcttttgcgaacatgcttcaggatatctgaccctttaagtcagtagttctcaaacttttggatgcataggaatcaccgggtgagcttattaaaacagttctggacccaccccatgagagtctgatgctgcaggcctgggaggggcctgagattctgcaggtttaacaagctcccaggagttgaatgctgctggtcctcagatcaatcaccctttgatagcaaggctctgattcttctcacttcccaatagccacaggatctgtggtctcactgatcacgtcccaagttggctgagcacaagacctgagctccctgacccatcacagtagctgctttgtagttctgctaagacacctattcccgttaccactggtcctgggatcaggatcccttacttaccaggtcacacccttttagtcttgctgacccctggcccactggccagtgaaccttccagccaactctagccttgccccattcattacctccctctagcccagggggactcttcagcctcagctgacccttcagttccactattcagttttctcttctctgcccccttggaggagggtttttttgtttgtttgtttgtttttttttccctatccccattgttttggccctgaagggagagctttgtggcaaaacagagcaagaaagaacttctccatgaacaactgatctgtggccctatcttttcaattgccttctctaaaaccccaaagaaacaaaacaattctactttatctctcgctgtgagggcacagaacaaaacagaacatttgatgtgaaataacagcaattcacattcaagtggctgcggtgccagtaagtcaggggaaaaactcacactaaaaagaaaaaaaaccaacaagtaagacacacacaaacccaaaaccacctttccaggccttttgatcgctttcattctttcctgcactgcccgatgttagcctaagcccagtagtatctgctctgtagtatctgtagcctgggacaacttgccactatggcgagcagatttcaggctctttccttctgaaactcctccaaccagtgtgcaccacactcctgtgccaaagactaggtctgtcatcgtctgtctttgaatggcttttctcccatgcagtgttttccagatctctccctcttgatgcctttccatctcctcagctcacagctggaaatcccatttttgttcctttctggcaacttttcacttctttctatttctattgttatttaactgtgaaaagtatttcctcttgcaggaaaaatgcccgtatgctttgtctgagcaggagtcctgctgttcattatttgctgaaagccgtgctgttgtgtttaatgtgcaccctgggatgtcaataccatttcgtatatacagaggcagaaacccatttgatgtactttatgagacctcctttagttgggaccaaatcaccttacatgcctctccctttgtagctcaccagcaactaaatgaggctagcacattttgtttgttatctctggacttagaatgtggaaaagctggaaggaaaggcttatgggagatctttacagtttcactctcccagacggggtcattctgagattcaatattctggttttcaggactaattttttggctttggttgttttggagagacttaggctgctactttatggcttaaatgtcaaaattgttaacttgcagcatgaatatgtcttaaatcattcaaatgaaggaataaaccggaataaatctaagtaaacacaacaggataaccagcaatccatgtaatctgaggaggcttatcataaatacttgatgactgcccactggaggggagaaaggattcaggaatgcaaagccaatattcagaagtgataggaacctgggaacttgtgtacaaaccaggcagaaagatgtcctgaggctgggtggtgatcatggctgcattcacgcatctgagcttcatttcgtacaggacatcttccattctggtaacaattctattgcttctgcaccaggcaaagtccagcaaggccactctcctcttgagccagccaagactattccctccctgtgactcagtcatgcaatcccttctgcttttggaggaggaggggagcggttgaagataatatctacagaatggggtgctggcttccccccaaagcagacaaagcatgagccaaggggtccaataaattcagaatttcattttgtaaagactctattaaagtaagtatcatagaaagaattagaaactttgttgctttgcctaatatttattttatagtttaatgttatttgtatttcttaatgggagaaaggacctgataatcttttccgtgcttaggttaggttttgtaattatctggccctggttgaaggctcaattggcataaaatattcatctttccaatgtcttttaattcagtcctctgggttgggtactgggatgggaatctcaaagacagtagctttaaagagtagcacaggcatacaggagttttgggaactgcagccaggctcagtctaaaaggggccattgcttagttccagccagttgttgtcatggagaaaggcaagctcaatgttgctaaatttaattttcaagagaagatgaaaatccgtttttcaaaagatgaaattaatcggcgctcaacaattgtaaaatactgggggaactaaaaaaaacatgctatagggccgccaggacgctatctctgtttctgggactaggccactttaattctacagagcctgtagaacttagaggcctcagaaaatataaactccagatccttacttgttctgagaagctcaggtgacagttttgacttggtggaaaaaatacagtcttcaattccatttaataaatatttactgtaccaggctaggcttggaacacataaacaccattaaattacagtccttgccttcgaggagctcagagattagtaaaagggggaaaaaagagcacatgagtcagtgtattccggaacaaacagagagctcatctttctggtggaaaccccttaggttggtaagtttgaagtattatgttagtataagtgcaatggattctagatgggtttacccttaaatgccctgtaattgtttcagcaagtgctcagtgtcccacagaagtgatacaaaaattgccttaaagttgtattttattttgagcatggtttcattttgtttcattcatttgatatcttttaagcacatggctttgccataaataatttggtctcagcccaaagtgaagtctggccattctccctggtttctgaaaggttaacccttggaattaggagtgtctttgtcattcatggtgagcccctttgaccatacctgatggtttatgctaaggagatgacccaggatggggccagcctcaccaataatcttagggtaggggctgaccatacccgaaagaccagcattgtaattagagggttgtgtctttgagccacatgatatcagcctggcctctgaggaagaaagggggctgaagattgaggtcatccttgtgggcaatggttcaatcaatcatgcccatgtaacaaaacactgggataaaaaccctggacaccaaagcttgggtgagcatccctggctggcaatcctctctgcatgaatgctggagggtaacaagtccttaagggtgatggaagtgtcacatttggaacccttccagactttatcctgtgcatctcttcttttggatggttctaatttttatcctttcactacaatcaaaccataatcataagtacagcactttcttgagttctgagttgttctagtgaattattggacctgaggaaagctgtgagcacaggacagttctctgggtggccttggactcacccaattttttccccttcttctcttgtagttgtcaagaataactatagaaggtgctaggaacacaacatcttgagataaagaggggctagctggaacagcctgtgttttgttccagtcccccctagaaacaggatgtccttcagtgcttgagtccagtgtgacatacttctccagggtagaaaacccacagtaggctgctttttggggcccctcagctgaggtgcaagtgtgagtggagactccatctgtcctaggcagctttcctgagccttggggaacttgctcttcatgaatccttggcttctactgtcacttgctgcctccctgtaagtgataaatccacttcacgtagcctggtgtgtgggtgggtgttctgtctcaacagacacagataagttggcaaccagtgcacggcgaacctactacatggtggggcccccagattcagagctagtgtttaaagttggggtggtctgtggagactgttcccttagactctgacatttggcaaacttatttcagcagacgccaggagtcttgggcagaggtggcagtctgaagactgtgaccttaacctcgagtttggctcactctggataatgacacgtttttcaattatggagtactcatgttggaaaaaaagggtaagacaaagtccttgcttaggagaaatttaaaatcctgctgattaaaacaaaatcggcagacacatgaacaatcctgaaggaagccaagctgtataaatatcctgcggaggtcaggaggttctgtagcataaatcagtgcgttaaatgcttacagatatgaagggacttgagaatgttttcagttctctctattataaaacaaggtaagttatagagggcagggaggctggagggctgactcggtcacctaggatccctggtaatctcagaatcggagatgggggagagtaaacaaagctgtgaatgggagtaaaacacagccaagagttccttttccttgtgacatgagattcttaatttagtctctgaataaatttaagtctgaagttacttgagccctgtattttacctcagcattttccctcctctcaaagcaccaagaaaaatctggccaatcctccttggcaaaagcaccttcatgtcttctttggcagctgggaagttagtgacgttctggttgactgttgccaaatttcatccccaggaattcggaaataagtctttttttcctggagagccctcatccttggagtataagctcagcttcctggggttttctgtagaaagggacctcatcaatcatctagttcaactcctcccgcagggcagaggaagcgcctcggggttcctgccaggttcccattggttgcttgaatacctcttgtgggaaggagcccactcttcacccaggcaatctactttactctgagacagttttaaccgtttcagattcctctcatttattagattaacttttttctcctgaagatttctgcccaggttttatttttattttaaattttattttctggggccaggcatggtggcacatgcctgtagtcccagctactcaggagactgaggcaggaggattgattgagtccaggaagttgagactgcagtgagctgtgatcacactactgcactccagcctgggtgacaggacaagactctgtctcaggaaaaccacatatatataatatttgtagtacatatagtatatttaaaaaccatatatagacacacacacacacacacacacacacacacacacacacacacatatatagtatatttcctgggagaatctagtaacaagagaaacaaaattgataatgataaacatttattcagcacttaatgtgatccagacataatgccaagacctttatatatatatatattatctcctttaatcctcaaatctactctacaatagagcactattgttatccccatcttgtagatgagaaagctgaggcttaagatttaactcccttacatgagctaggatggagttcaggtgccagagccggatgggatgtagatagctgactgcactgctcaggcccttcacttattcaaaactttcgtggacctaacttagtcacattgggtaccatttaagacacatcttttacaatgagtgttttatagcttatattttaacatatgctcataaatctagccttgctgtgttttctgtgtattagtgactactagtattttatgtttcactgtgaatacgcgcacacacacacacacacacacacacacagacacacacacacatacacacacacaaagtgttctacaaagcccttctagatttcccaatatatattaggccaactgcagttgactttatgaacaccttctggtaatcccttaattcaaatctggctgagattctgcagtgctgagcttgattttatttctgtttatccctgtgttttatctcctttgctgttttggttaaaaacatacataattctgctgttcccaggtgggtgttacctctactcataaactgttacccaaagataccaggggttcagtgcaattagataacgaaaatactcaagaggaattcaatcgattctaaaaaaagagcaatgtccctattgaatgtgatttctaaagagatatttgtcgtggagataactgcatgtcgtgagatctttttaaagaaaacagcaaggaaaaaaaaaatccaaagcttaaacttctttatgagagtcctaaaacatttccttttagatatcacactaaacactattttccctggtgtttactcatacaatacagccccaagcatggaaataaagaagattcaacttacaggctgtccaggctcatctcccccgaggattctgaagccaaatccagactccatcctccgaagatgaacatccaattccttataatctggacctggcataaaggagatcccattgagtaatgaatcctgcctctttcccagcccctgaggaactgaacataccaatgataaattaattttgtggatgcgattaatgagagtgctgttagggtcaatggaaaccatagaggatacaaaaaatatggcagcaaaaaagtaggtgttccaaatgtaggttgtccctggaataatagtgactagccgagggcactactgaggtattaccagaagcagaaagagtacatgaattttctgagtaaaaaaattgatgcctttataattcttgattttcctgagagcattcagattgccctcaagaagctagactgtcactttgaggatgtttactctgattagaacaattattgcgcaagtaagagagaacagatggcaaaaccctggaactgtccagtaaagcactgcctggtaatttattaatatctgtttatgacatgatgcatccagtttaggagtgtgtgtgtgtgtgtgtgtgtgtgtgtagggtataaacgtatgcccaatagaagttgtctcttttaaaattgcaaaaattagaagatatagaatttaaactttcttgtattgaggttcaagaagcatttattttctgacaaactcctttagggtttttataacttacaggtagaaattcatctgggtctaaggtggacttttatcaccgaaacattttagaatgtgcaagccatagattgacttttgacttcatgagagtactcaaaataaatagaagatacttttctgaagtcagctgaaagaacacagttgtatttcaaaataagatgaaaaactctcctgaatgtcattttttcagccttagaagaaactaaaactattaaatataaaaagttttgactttttaagtagaatctgatttatgcttagcctgtccccttgccccttggcaccttcctcagggggaaatacttcagttgtgaccaagctgcgcatactttcatgtccactgctggggtgccagcagatgatcagcaatttaaagaactatttattatgctgtctcttgcttaagaaatgtttagtggtttctggacctgaatggtttaaaggaggtattagaactgatagaagcaggtattaagtaaaattccccttgcttaaacaggatagttgtagaaattaagacgagatttcagagaattctcatgggacaaaaatctatgtctgagccacatgattatacagtagcactcgttgtagagagaggctcattgaatgctggccaggcaaatattttccaggctctgcagtaggtgggactgctggagtgatacagtgtacaaagcacaattatacaggcttgccttggtgcccaacaacctgggctattcccagggatatatgaaaggcatcattcacttctgagacgtgggcaaatgccgattatttatctggtgctcttttaaataaagatgaatcaggcgcttaagtacatatgtttatatgcattgtacaagattcaatgagcattcatacccttttatgaccaaatgcacacatgaccaagaccttttccattcaatgaataatattaaactctgcaagaagaataaccagttagacctccacatcctttagaaattatataatcagtcatattttaaagatgggagaacttaaaaaattccattcctattaaatagaggtggtggcagaggaaagatgaaaattttgccttacattctatgagacacaaccggcttttgaactcagtttcttctgaagtctgtatatcatatatgaaatcacatattggggtgtgtgctaagcctttgggagtctggaggcagatggagtagagctctacaaaatcatagcaggtatctgtactcctcccaagagaaggagaaagacaaggggagatcggagatgacagatattgctcaatcactgttcaaacttctacaagttgaggataatacaactgctcatggcaatctcttctgtaagtcactttaagctgggaggaactctagaccacatacacattaaaaatacaaatagaaggtgctgtatttgtgacacttaaaatgatagagccagcatatgtttaactagaacttttcatctcctgtattcttctcacttttgcatcaccactgaatatgctaagtgggaacttgttcttccagtgacttcagcacccatccatattgcacaaggagctttacaagacctttattgtgtgatccatcttatttgctacgtaaaacttttcccctaaagaaatgccgaaattatgaccatctcaggaatggaactttcagaggtgtcaaggcacaagaagtttgtcttttgtcagagaatctgtgattcctggaggaattaaggggcttttctttaatgaataacttatgacttctttttaggagaaaaatctagattttagcaagtaaattttattgaactctgaagaacagagacacgaataaggcattttttctcctcttcctgctcttcttgcacattttggtgacaataccgatcctgttgctctgacccaccctgatttcaaacatagggtggtatgtgccagccatttatttcatcttcactcttccattcttcccagcaggggtggccagcttcatggttcatgagcaggaaacagaggcaaagagagaccccttagagaagaatgctggtagatgtgatttattttttatttctttgttaattttgaacacagattcagaggctgcagggtctggactattttacagaaatagtcaactggaaaaaaagttcatatgatagattgtgccttgaggcagcagtattttttttttttttttttttttttttagggaaaataagaacattttaggaagataatttttctttggtttctttttttccttggagtctggctttacaaaataactaaaattatatgtacaaagctgggagacatcattctttttccttcctgctttgttagctctcttcgcagattgtgatgtttctgactttcccctagttgctcttctggcccgacgacatgtttcaattactgtatcaggttttgtctctttccttattaatgcaagaacttaaagtgaagaaatccaagggccatctctttacctcactgcaacagagttaacaatcactattcctttctcttgtttcaagaaactatgcaccagggaggttgttagatgagggtgtctggtagacacctatttggacctgagttgctttgcatgttgtttaactgtgccccatccttttactcttctgttcccttctttattttttctgtgctctttttaaaaaaatcttctttttcctcagcactttttgcagaactgtcagagacactctcaggtgtcgcttaatgcagctcaagaggaggcagtggttgtaaagaaatggactaagaggacacaaagcattctttggatattagtgttcagtggccagctgtggctagtgttgcttcttagaagttgggtcctcggatcctcaggcattatggaacaaagcatctcatgatcctcttcctagatggaattttacatgaccactgtggcaagttactgaaatgaaatttagaagtcttaatttattctgggctcacaccaatattgcaaaaacgaactttaaaaagtagcaaatggtgagcacatccaggtatcaggacaacctctctcataataaagaaaagcagatttcaaaagttgattcctacttcacatgaagactctaggggcttcacatgctgtatgtttccttagtcttgcttttgaaagaagtagctctgtgcacagttagggaaaaggctgggtaactgaacacaactgattaattttatgaatggattcaatcttcagaaatgcaaagaacaacatttttatgaattaatttggcatatgggatgctgctgtaaacatgtcaattaaaatttggtacttgaatcccctttcatgttttaattaaaacataagtaccatggcttatcatcacagtttggcacagaggatacatttattcaatttttcctgctggaaagagcatcactttttgggcttttccttgtaaagagatctaggaaagttagcatgaggaagatatcaggaatcaaaaaaggttattaaacatggtcttgacttctggatttctatgcactccagatatagaaagagttaaacaggaattatatagtttctgttgctcaaatctaacattacctagtaagtagctaatactccatcctttaaaatatcccttctctttagttgtttgctttatccctgtgggtatgtgaatgtgaccaagcacgtgttagccatagtagaagccatctcccagtttctatttggttctctcctcagccttcacatgagctcagatttttccatcctaaatatgactttgctccttccttccatctctttctaggaaaagtagtctctaggggagccttcattctacctctgattcattcctgccagtctggtttatgctctctcttagcactactgcactctttaaggtcactatgcatgctagtgaccaaattaaatggcctctttttctttcctcatactgattgatttcagtgccttatttgatatcgttgatgcactgtttatgacttcagatttcttttgatcctaaacaaggaaagatctcctttggaagtcgtttctgtgacaccccatttcctggctctcttatttttgggtggagttgcccattcaaagttcctggccatagattccattgtttctcactaatattctccttaggtgatggcataattatcattggccatctatagtgttccattatgcacagtctgtaggagttgctaaataaacattacctgaacttagttgccttaaggcactctctagtctcctagtcccaatgaaccacagcattattccactatggagttatcacttagtttcataaatatgtattatttagaacttcctactatcaattttgcctctgtacctaaggatcttatgcaggtaaagttaataatataccttataattatgataaacgtatctgagtcagaatcataacataatttgatgagacattttataaatgtgacaaaaaacatggggcatctacttattttatcttatttttgtatttttgtattttttttttttttttgagatggagtctcgctctgttgccagactggagtgcagtggtgtgatcttggctcactgcaacctccacttcccaggttcaagcgattctcctgcctcagcttcccgagtagctgggactacaggcaagcaccaccacgcccagctaatttttgtgtttttagtagagacggggtttcaccatgttggccaggatggtctcgatctcttgaactcgtgatctgccagactcggcctcccaaagtgctgggattgcaggcatgcaccaccgcaatcggccatttttgtattttttattagagatgaggtcttgctttgctgcccaagctagagtgcagtggtgtgatcacagctcactaccacctcacattcctgggttcaagccattttcccgtcttgtctcggtctcccaagtagctgggactacaggcatgcgccacagcgcccagctgtttaaattttttgtagagatggaggtcttgccatcttgtctaggttggttttgaactcctgggctcaagctgttttcccaccttggcttcccaaatgctgagattataggcatgagccacagcgccaagcaagatatatttattttaaatgcagtcatgattttccagaatattctgataacttgtgtggacattcaaccaactatttggattggttcttttcttcaaaatgtgaattgcacagtaacgtaatataccccaactatattataacttttgtcttctaagtaatgtattttttaaaaaggtaaaaactattactttgcatatatgtcaaagtaatctaaactactgggccattctccttctcttgtttttaaatgaagtgcattcagaatctgagatttttaagacatgtgctttttgtgaccagtaagctgagatttaaaattccaaattaaatcttgatttcattttgcaactgtaattactaggtcccattttctctctgggcataagataatgttttaaaaaaattgcaaagatttagcagccagtatagaggaataatcatgctgtaaaatttttagacaaagctaaacaaatactttagacattattttaggagaaaacactaaataatatcttccatattttctacatatccccccaaaaatgacatggaaacttacagaatgaaatgatctcaggcacatatattcttcaaggggtgttagaacatgctgagatggataatgagctgtcatcatggaaacactctggagatgtgtgctgtgagcccacagccctgaaatagtgctactattataaaacactattttccgcaattgtttgagtattctggctttcaatctggtggtctgattagctgtttaaagcattttcatcaccaattctaagagcaaaaaaaaattaaatcttctttttcctccaacatttgtacaataatgttaaatattttagcctaaaccaaaattagtgttttcgaaatggttaagtaaaaaataaaatttccttttaagcaaattaattggtgtattactgaaagctcttaaaattaaaatatgatattttagcctaatttaaaatcttattgaaatatagtattttataattggcatggtttaaaaaaattaagttgatatagatatttacttgatttgaaaagaatttcattctatgttagcaacatttctaatccgttctttggaaatgtctaaattgcaaatctcttgagaccttctagcttcttatttgtatctagtctagtgttattcaatgcaaataaaatgtaagccacataagtaatttaacattttctagtagccacattttagaaaacaaaacagatgaaataaattttcataatatattttgtttaacttagtatatgcaaaatattgtttcaacataaatcaatataaaataattaatgaaatctttcttttttgtttgggtactgtctttgaaatccagtgtggattttacacatatattacagcatatctaactttagaacagccacatttcaagtgctcaatagccacatgtagctagtggctactgtattacacagcacggacctagtcagtctgatggctctctttggcagctgtttttaatccagccttttactagagtattttatgaaagaaattcatgaatatgactgttttcctttgtcttttgttggcaggcatttaggctcaccatgatgagacttgctgtctaccttgaatacatgttttatgtaggtgactaaagtagcacagcgattatatactaggaaactgatactatcagaagaatgatttgttacacaaaatggaagacgttttgttcacagaactgtgagtactgaacaatacttgccagaggaatccattcgaaaactggtcctgggtggcacttgttctggatgggaaaatggggaattaaagttgaaattcatttatggcattttaaaattcatctttactttctttttgttgctatcataactcccccaaccacaatctcatacttatgtttaagactttttttttcctctaagatccaagttagtggacaaatttaccctgctttacgtatgagcatgtatgtaaatatgtttcttttacatgcatccaaaatagaaaaatctgaatttctttttagatcagggtggaataagattaccatttctaaatattaagttttgattttcattataagaatacttatttgaaagtaaagtcaatctagaacctgaaaggtatacagaaaatataggtcctttaaaattaggttataattttgtgtcataaaacgttgaaatgaaaagtggaaaatccaatcaatgattgtattgatttatgtacactagtccaaatatattgatatttccaattatctgggtagttgaaattatgtataagtagttgagttaaattggtttattttagcaatagagatcctttataagaattatgatataatctatgctacttctaataacataaaaattcaaaaaagtgagtgtaaaacacctttaaaatgtaggcatagcccacatttagaattctagaacctagaacaacctggttgcatactgggttctggaagtattgggagacatgttgctctcatacatgaacatttttcaggggtaggcaaggctccaattgattgacatgcttcctcctactctacatggtggagatgtgcaactccttactgcatgtttgagaaatgcagactttcaccatgtctttatctggaactgctaaatgtgaagaagaacataattaaattgtcccttgattttcattctgccttctaaatccctggtcttactatcatagaggcattaatagagtgacagagatgcaaggcacctttcattccacagatggttaagacccaaaatgctaagtgacttgcataaggtattctatactatctcacaagaaactcttcaagatcctttttcgaaaacatacttattatatctaagttttaaacttaattagaatgcattatccaataaaacactttcttatttcattttagtattattatgaataaataatacactcttttctgaacatgctatacattttttcctaatatctccagaaattcttcctattccttcatggttctgtcagtagagaatttcctaaaccacacaactgggtttaataagagatgggcagaagacacatgtatgcaaacctctggtcaagaaatactcaagaagctaaagatctacgttaagatatgctgagttacttctatctgagagaatggcaggatatttttgcccctgtgatgaatttcatgttaagtttaccatattgttttgctttagaatcatgtaaggaattacagataaaaattaactaaacattactaaacgtctctaaaacataaattcacattgtaggtagaagaactgtaagatattcttgcaagaaccactcctcccacacatttaggcttcaatatgtaaattagttgttgcttggaagaaatttcataccattattattattttggtctataaaattatatatttatgatatataatcatcaatcatatgcgattattccttaagagcatttacagaggaggcaacttacagttttgaaaggcagagaataagaatatagtacaatagaacctcccccattctgaatgttttaagatgacataattttataagatagttgtaccatataaggctcacataataccaaaaaaatgagtattttatccttaaattttaaaaattaaaataagaccaaagtctggttgctttttcattgagttttgtttcaaataaagagccagttggctcatggagagcataacaatcattcctgccaggtaagctgtgttttcccagtaaaggcaaattagctttctggcacaattgttattttttaagaactttcatgtttggtgtggctgcttaggattatgacttgagaaatgtccttttgtctgtatgagggatggaagactgctaccttcgaaacgcttccattaggtataaaactgacattttatgttatactctcacgaggacctacttgccatctagcacttaaactctatagccctgatggtctcatattaattcatgaatatacattgggttacattgtcaacttgtgcaaccaacaaaatgctttgatatattaaataactttcaatcaagagctgatttttagagtttactttttactcctccccctgcctttatcccttaattccaggatcttttagttttaaattactaaatgaaataaatttatcagctctaggattggatctaatttctaaaatacatgggaaaaatatgtgtcctaccacaacttttattttgctatctctatattacttagctcataccatggtaatttcctgtttcaaaaggaacttgttggaaatataaacgttaccacagtttcttagaaagctatctgaggatacctttttaaaattagatttccaaattaattaaaatctacatattaaaatggcagacacagcttaaccggatttactgatcttcatatcaatataacggcaaagtaatgcacaatgtgatatattagaaaatccagctgaaaggcaaatttttttcacagatcaaatcataacatacattatactaaggataacaataatgcttttcccatgagaaaaggttgcagaaaatctctcagtacaattgaggacatttaaaatgataacattgttacatctttttctatccttttatttttctaatgctagagtcactggtaaaagtgttttaacatttatttatcaccttattttaatatttcactaaagtaagattgtgttccagagaacatacgtggggggtactttaatgccatcggacaccagcagtgttcaagcaaatcaggctggggcttgatctagcacagtgttcacatgtgagggtgttttctgggaaggcatgatggcctttcatgatcacctaatagctgcctgtagctatggcatccatgaatttatttaaacctttgtgaaactttttgatatttccagcttggctcaactgggtatttaattacgtgggaaaaggagacttggagtcaggaaggcttgagctgaaagatttccacaggcttcagagctctggttttgagcaccctagacagatactaccatatatgatgcggcttcccccatcacttttcatttagagattcaagcggtgttctgtggtgaataatacgattacagtaccccatcctttcaagtggctctgctgttaggatgggagacagtgcaaactacaactcttgctcactaataacaaggaaagagcagcagaaaacctggtagtttagaaatacaaccacccgtttgtgatcagccatgaattacatgtgtattacaatactgaacaacgaaagaattcaataatcaaagaacaacaaaagagcaggacaacagccatagatgtgaaaaacataactgtccgtttttgatctgccacaaatgataatttcatttcatatatagtactaaaaaacagtttgcttctccattatactcttgaactggcgtgtgatcacttttgattgctacctttgctatgatactcatcgcttattattctaattctggaaaggaaaattgattgtgtgagctcttttgaagacatttcagagaaatttctgttctaaagaggttataccataaggcacattacaccatacggatccttgacatttttatgattctacatttgagtgatgtcttaccacaaaggagtgtggacatggtgtacctcataaattgtttacttataataaccaaagttcaatgtgaagagaaaaaagtttgaacaacttcagtcataattcaacttgggtttaaaccaagggacagaaccctgagggaagagtttcaggaaataagaatttttcttttccattcctggttgtatctgcttattgctccagctttcaaggctgcagtgtggaacaggcccaagaaatgtccccatgagctgaatgataagacaagcccttagagtaagactagcttaaagaaaagtgaagcaacaggacaaggccctctatcctgtatcaacacacccatcagaatgatcaagactgaatttcataagattccaaagtgagcaacattcattttctttgggaagcaccttatactgccttgcctatcacagttcctctttttagtaccagtatctagctgtagttatctaactataatctttcccagaagaagaagacagatgagattaactaactttcagtttggtgattattgtgatgttgaacctgacttattttctatattaagaaagaagactccatggcatagtacttaaatgtgggaaaccttactacctatttttttctacttcatttgccatgcactagatttgtacatatgtctaactttctgggtttggaaggagtttactgggagtttggctactaacacaagtcactaataagcctttacctcaaattagggataaaatatgtataggcaaacattgtatcagccaaataaattagcttgaaaaaattatttatctgagtaggtattacactttttattcataatgtgtacatttagagatatgcttttcttgaacagtaatgatgattattccttgaatagagtatataaaaaaggaaaattttataatttatcattcaaatgatgagagtctagggtggtgaaaagtgaactattgataatcacgccaggacagcacagacaaggattgtccaggaaacttccatgtgtagtcaccctagatagtcttataagtaactagaccagtaatagaagatttcctatcaaatcagaaataagtggtggacgcaaggatgcagtcacacatagagaaagaagggcaggaggagatgagggggagaaaacactaagggcccttagaactacttttctccaaggttagaaatggcatatgtagtccagcattaggaatattagcatacaaacaagaacattcaagccattcctgttgtgactgtaaaacaaattcaagtccttcctttatgagattctcgggaaaaagacagagaaaagagaagtaaaacatagcacggcttgtcccactatggaaaggtattttcttttgttttcaattttcaaaattgcaagtagtggggacatcaagaagtctgttatcaacagagactattatcacatacagaatagtcacgtttgtctaaaaatctttggtagagatggaagttggggagatttttgttcttttctgggaattggtagtaatgacttagggtcaatgtttaaataattaatatgaagatccagaaggcccattgattaaaacttttttagggattttttgggcagagttatacttttatatatgtaagtttaagcttatatggaattaagttagtggggaaataattctttttttttttgcacagagttctccagcaaggattaatgaaattttgataatgtaaaggtacttaacacataatattgtcttgattgaatatgaattttcacatggaagttgagaaactctcagtatttagttatttttactgcacaatttcacacattaaaatattgatattatttgctgtgttgtgtaatggagccttgttcagaaatcgtttttctatgtgttgtgtgtttgtttgtgtcctcaacttcattgtaagcttctaatgagcagaggttatttttcataacttctcttgtggagtgccttgcagagttctagacacatagcgagtgtttcatatattcttgttgattgatgtggagcctggagttgccacctctgggcactgagcctaatgctctgaaatcagaggcgctgccagcctgctgggtgggagaatcttcctgtctctgtcctgctccattcccagctcatcttgagatctcatgaagataggaggtgtttcctatcacagcatgtacctgtcatgttctgtttcacgtggccgtagtatcctatgatcatcttcatttgtttaaaatcacagctttttttttcaggaatacgtctttattaagatgtcctgtgcatgcacattaaaatgtcagcataatcgaattataagtcaaatgaggcacggcagcatttacatcatttgataaatttccatcatttgtaggggactggtgacttgaatccaaatatttcttgacagccttgacagaacaaacgttctgtagctctgtacagctcaggcttgtgggtggaggggcgtctttttatttggcaactgcaacccagttttgaaagtgaatgcaaaaatctctttagctttagacctggttgtaaggaaggacaccatgagatcactataggctaggggaaatgtcaaaggacttagtttaaacagctctggttaggattcttttccacaccttccctggttgcactgatttttccccccccaggaaaagacacaagaataaatagagccaaacctaaatgttatgcatgtgattcaaaggaataagaataggaatggttcataatcacgaattttgaaatattgatcttttgtttcggtatgtacattttatgatcattgcattaaaaaaacctatttgaagatgatgagaaacagactgagctttccaatcattaattaaaatctttttcttttagtactgctttaaacatttacatgagaaaataaaacttggaaatggaaacgtacaggagggcaaaaggctgtcttttttttttttttttaagacactcacatatccacaagcagagcgaactgatcagctattcagagagactagagaaagtggcgccatgctctcctggtttccttaatcttcagtggtagagcttttcttaccttgacatagtttctatgtttcatttacactccatttagtgttatgaagaaatgtgatagaaaagagaaggataggaaaggaaatgagcttgtcctcttttggctttctgagatttttgaccctgaaaacattactgtgaccttagaaacattagagagagctgatgaaagcaggaaggggttgtgatgaggcagcagcagcagcggcacagggagagcaccgatgaggggcccacggtggggtgaggtggggagtcaggatgtttgctgtccctgcggctgtagagggaaagggcgatgaagagctaccagaggagaactgaaaaagaaagctctggaggttaaggtggactggtttgcttggtttgttacaggtgaggaggggaaaggcaaggaacagaaacagtattgcaggggctggataaagaaataattgttttagagttgagagagcatcatgtacaagaaactgagggcacaatggtatcagacaaccataaagagaaaactggagataaataccaacattgtttttgtcctgaatcacaaagctttgcattggctaggaaattgcaaaaaagatggaagtgaatgatgaaggaagaggcaaaaagcaggaggaagcatctcttaatgctccctaaatgcaaccacaaaattaagccaaggaggtgaggatgatattttaatcctatgcacttccaacttgcatcttagaactgttaactttatcttactctctatttgtttacattcattattcttatttccccagttaaatgtgtgagagcagggcatattactcatctttggtatctcctcacagtgctgacagcaaaatgggcattccatcaatacttggttatcaaagcagaaaaggtattagaaactgggctgaaatcttttcaattttttttcagtttaatgaacattaataccctgaattcatactctatattatgtagctaagaatgcctaatttgttcttactctgctacagcaaagacattctaatgatacaacctaaaaatatttcatttgttcatccagaaggagaggaatgaaatacagtagctctgatgtagccgcttctttaaaaaaaaaaagtatatgtgggtttcaggttgggggatgtttcattttgacattaatgatttctcaatggcttgccatcctaactatttttcaaccaaaattagttctacaaagagttgtagaggatagggaaaaggtattatgtctgctttcccctttaccagctgggtgcataattctcagcccctgagctcatcaaaagagtaagcagatttgagatcctctgagatcacacacaatttaaaacttgctattcatgctacggatgataaagttggaaacaagacattgatggaacactgaagcaaaggaaatcagcagaccgtaatgggagcgccagggaccaaactcttctacgaggctgggtttcctgatcatttaatacacagattcttctgatactgtgagattcctgtcctctaacatgtggagatgacttgcaagatggtagaaagaagcacaacaatggtgcaagcaatatcaaaagccttgttttctaatgtttataaagtacaacaattttaaaagaccttcagatagggtgacaagtgcatacacgatattttaagactgaatgttcaaatgtgcctgactgcactgaaggagaagcagaaaactgtggcagagatgattggcacctagatcagtactgcattcgaaaccaattgatttcatgcttgtgagctgggaaggcttggctgacaatttactcaaggtcctaactttttaaatggctatattcaaggctctaagaaagatctatgctttaggctcaagatcagattaaacagattaaaaaaaaagccaaacacttcttttctgtatttggtaacctaaacaaaaccagcaacctcaccccccaacccccaaaaatatattcccgattttcttcaggagattaggggaagaaaagtaggagataaaatataaggcaaaagatataataaaccgacttttagagtcaacaggctttctaagataattttagaccagctggctctgctcttgaaacacttttgaaactcagaatataaaaccatgccagatcattcagcctcaatatatctcctggcagggcctcagctattattaatgtacccttgtttcatgtggctttcacttacgcctactttcataaatggccctagatttctcgtagagctcatatggatcaggcttccgtgggtcaaaggcctctgttgagtcaggaaaggagctcctgtgaagggcaggtgggaagggcaggttctgcggtatggccggagcagataaactcgtttgaggactgccttgattctcccatcggtccattatctgaaaagtgacagaggacagagaaaatgactgacaaattcttcctggctatttctcttgtcacctttaggttaaccttttttgccttgtggacttttcttccaggggatgggtaaaactttggcataaattccttgaaagaaaagattttatgtctatgtaagacaacatcataaactgttataaatacaagtggtgcctgacttttgaatgcaaacttatctataacttacataaccttgtcaacaattagccagtaatctttggcaaaccacttaatttctctgtttttttccccctataagataaagataatgtgtctcaagacgattcatgtgtaggtgcttagaaatgtatggtattagttgttccttttctaagatggtttcaacatattacatcactttcactggagcagaagatacagtcgtctgcatatactcatttgacacctatgcatatcgcaacaacttcctacgcttgagcattcagtcgctttcctctcagtttagacgtaattatgcaaccatctaggattcagggattgttcaaagtcttctaggaagcctcatttactgtggatctggtggttcctcccccagaatgctgctactgatgttgctactgctataatttaaagacctgcagagtacttcccagtttatcatgttctttcacatacgtgatcttcttggatcctcaccatagcaccataagatagagaaggcagagattaataccattttttatcaaggaggaagccagactccctgagaccacctattggcactgccaacttcaccttcattcatcaactgatgcctcattcaaactcaatttttccttcctgctttgaattgaccggcagcgtatgtaagatttagactagtttgccctcctgctgaaactctgctctgagtatgcatggtcctcaggacaaaggccaaacttcctagagggtcatggcgggctccttttgagcctgggtctgctcaccttcctcatattggctgatgggctggcttctcattcccgaggacccacccagttctcttctgcttctgaaactttgcatacttcatttctctttctacatgtattttccactcttccttcccctctctcatttcacctagctactagattcagaggaggtgtctcctttcctagagggctcttgctgaccgccctgtccctcctgcccctcgcaccacttcctcacatccaactgtgattaccacgagtctacccagccatgtctcaaacagatcagacgcaaacagggctgcgtctttctacttgttgtattaccagtgcatagttagtactcagaaaaagtacatttagtgagtgaataaaatatggccacttaaaaaaaacagttttgatatacactacattgaacttggcaggattgtaactttctgtcccctatggcaccgtcctgctttagttttcacactagctatatttttgtcggggctctgattccacctctggtctgtccatcatcaatattttcaagctggaagggatgtgaggtgccatatactccagtgttttttaaactgtgcacatgtgctgtgtaacaccagagacaccaggggcctgccctgcccacctgggactgggactgtggcaggggttcatgttgagccagcaaactggaaaagaaatgggtcactgacccttccttcaataagactggcttcgttttaatttgttttctatgtgggctattgcccaagatctcatttgaacaaagtttctataactgtcaaggatggaaaacctctagtctagttcaatttcctcctgtgaaacataatctctagaagcatagagagggtaagtggcttgtctgaggtccagcagttgccagtggcagatcctgggtcagaaccaccctgtaactctaacagaagtaattgtttatataatatcacactggggggaataactgttaaatatggtttgagttttagtgaattttagtgaattttctgctcagaagggcttgtgctcccatttgtaaaaatctttaactatgtacttcataattcatttgatcgcaaaattcatacagaaagctattctgggtttccttggtcatccattctgggtgaacttgccatgatgtggaaggccacatttgtgggtaaaggcatatcctcggtaatttttcactttagctgactttaggcagcatgtggatgcattctagctgtgactttatcccttctgttttcaaatataagatactaaatactaaaaagtaaataaattagaaatatggtctggggagctgtagtactctcccacttgtcatcacaaggcttcagcaaatgtctatttctttctcccatattccattgagggttacttcatacccaaatgtgtcttgctggtatatgtattgttcatgtagtcattggacatgcttcacatgaaatattggtatttctaaaaaacaatcttaaaactacagaacaagtaatgctttgggcactgtttgggaaggctgccatggcagattgacaaattctacaatttctgtagcacagagattggggaattagtcaagagtccagttcatgcttagtaaagcattcacaacttcctgttgtgacattcattaactcttgagtcactctgtcagggtttcctaaaaggctgtaaagcagaaaatcactgcacccaagaaaaagcagacatattattctgttccccaccacctcctgccctgctccctcctaaacggagttacctggtggctcctacccagaagaccatgggacaaaccacctgccctggggtcagaggtcatccccttacctggggctggtgtgctggcctgactgcaccttctgaggggtggattccattgactcttccctccttccttagacactttggtctctggacttttgctttctacctgggatactcactgtgtgctcctttctaccttcatgaaccccctggattctgatcctgtcgccttactgaggtcgatgggcctcacttgctctggctagcatcttcttggcctttccctgtttagagtttttgttacctgccaggtgtttatttctcaacaagcttctttttgggcccctcttgtccagtcccagtggtgtccacacccaggccaatgtttataaacatctcactagaataagcacaaatggaaataaagttgttttctatagctgagagaagtctgtatctcttggtgaatgaatggatgtctgtgcaactttatgaacggacagccactgaaatatcagtgagcagcctggatgtacagtccacacccaggcatcaaatagtaaaacagaacactctgttcatggctgtggccgttttttttttttttttttttcgagacatggtctcactctgtcgcccaggctggagtgcaagggcatgatcttggcttactgcaacctccgcctcccgggctcaagtgatcctccccgctcagtctcccgagtagctgggactacaggcatatgccaccatgcccagctagtttttgtatttttagtagagacaggatttcgccatgttggccatgcttgtggctgatttttcaacctcagcttctgattctagggtgcatacagggagtagagagattatgaatgaggcaggcccctctcccctactcccatgaaatgctctgtccagaaactgttttcttactgtagaaagtggggtagtttaaatcatccccctcactattttgggcagggttggaagatgatggcatttatcttgattctgtatttgaagaatgcacttgatcctttccagatggagagaatgagaactcactattttagcatattacttgttcaacaggaagtgactatcttgacatggaatagcataagatgtgaatcagtaggacagaaaagagtcaggaggtaacacaggactaggaggaagctagagctcaccccatataacatttccttattctgacccaagatatcatcaatactctacttagcgtcttcctggccttcacctatttagagtttgtgttaccggccacgtggtcatttctcaacaagcttcttattgggcctctcttgtccagtcccaaggtgtccatgcccagtaaagtgggactgaataagagaggcccaataagggccacactcagaggacaggtgtataaacctacatactgtgggtatattgttatatacttgttttgattaatagtttagtcaactatgttcatttcatacagtgacttggtaaaggctcatgaatggagggtctgcttcctgtggtgatggtagttaatgttttcaagctcaacatgtagaggcaacatgttttaagcaccttacatggattaactcatagaattcctcacaataaccatgtgagaggggtgttactatctccattttacagatatagaacttgagactgatagcttacgtagctagctcaagtcatctgttaggaaaagaagcaaaacttgagtccaggtagaatgcctttagtaccagcaccctaaacaagtacattaatgccacgcttcctctcattatagtcctcaagagtttctggtagatacatggaagacatcaaatctacagccttctaccttcctttgtctatgccgtggaagtccaagccctagcttttgtagaaatacatggattcaagattaattgtacattgagttctataaaacaatttttggaattactgactatgcatgtaattacaataatgacagcaaatgctgcaattataccaaatgacataattttgtataaatgtggtacgtataaggaaatcactagattgtataattgtagcaccatgatgaggtcgcaaggttccttgttgaattagataaagatgtgtataaccacagagcacagatttaagtttggtggtgaaaggaaggaactatttagacattggttaagataaaccaaatttcattttaaacatttaaaagtatctcttttcaaaatcacatgcatccttaagtgatttgctaagcttaaataggactggttttcccatctaatgttctttgtggaccagatgagtcaaatcctaaatgaggtcctgcttagtgagagtgttctgctttgctgcagcctcttccagtcatgggtttcacatatcccagttagggccgagtattctaacacataaaatgggatgccagaaaaccagtcccagctcttgggacttgggcaattaatagtttcaatctatctgcaagtgaagaccacctctaactgctaagccaacttggctagcctagctctgcaaaaagattattaaaacccaccagcttcctatactggcgcagacattttagcatgtttcgtaggcctatagtggtcagatgatggtagagatctccagtatctgaagaagattcagaagcaccattttgagtgcttgtcaggtttggcagaatatatatacagtatacagagcttaaatatacgtgtgtgtgtatgtgtgtgtgtatatgtatatacatatatatatacacaaagacacatacacacattatatgtatacatacacatacctattttatatatacacatatatacaaagctaacatatatatacacatgacacatacacacatgtagctctgcatacattaaaatgtaaatataaatatatacagagttaaattttttgtggactagatttaatttgcaggtcaagacttctggacctatagtttgtattgttcctaaaaattccatgttatgaagactacattgtattgtggacaggagaaaaacaaaaggtttctaaagtattttcattacattaggctgcatagtgttaatgttcattttgtaagtatatattttttaaaagggcagaattgtttttataggaaggtaaggtgagtgactcatgtacttgtgggacagatacaagacaaaaggacacagaggatttattttttttacatcacagactcctagagttgaaagagattttgaggtcacccaattcaacttttattaaatgaaattgcaatagtaagtagaaataaagaaagaagcataataattccaacttacaggctttggagttttccatggagaaaagaaacctgtaataaagaaaacaatatttgaactttgaaaatattaccgactgccacttatgggtggcacgatattaagataattgtaattgattttaaattagttaacagcgaacaataacaaaaacttctgcctggctgtatcgttttcttcaaggagctcaaaatcaaataatttcattggaattgtattaatgattctaagaacattccttatttggcaactgaagatgctaaggcacagagaaggcaagtgaacatgtatcaaatcctcagagcttgacaaggctcaaaactcagtcacccttagggatttctattgcacagccttagtgggaaagagagagaggatattgacatacattttgatttcaaaggtaaatatctttgcttggtataagaaatggttgttttatttacctgctttatgtggttaaaaatcaattaataagccttcattattcctaactttaaaaataacgtatatgcctacattatgaattaggttccactataaatttttgtgagtgtttctccactgagatggggcagatttctatctttgtgccccggtgctagcagacattttgtgtgaagagctcaaaatgtttgttacttgaatgaatcatgtatcatggaagccttttttacccaatgtattgatctctttgtattatcacaaaatataatgattcgagtaaccctgttgtgatccaaatgattaagataattaaaagtaaaggatagattaactcccttttaaaaaatattattttagcatatgaaatcaattttttaaaaggtgataaaacaagcttaaaatagagggagagggcactgccacatgctgatcctaacaatccaaaacttaattgagcacatagaacaaaatcatatcttttcatatatcttccttctttcaacaattttcacttaagttagtataaggtagtttctgataaaatccctaataaaaatgaatattgaaaacatgccacatactatgtttatcatctttaaaacagacttgttcaaaatgggcatagttgacaactattcctatttccatttgtaggaaatatctatagaaatcgggacacatagttacctacacacattagggaatccaactcagcatgtcaaaaatactaattgcaccacaatgcactgttgtgaataagtgatgattaattttatgaaaagaattaaactgggccgggtgcagtggctcacacctgtaattccagcactttgggaggccgaggcgggcggattacccaaggtcgggagtttgaggtcagcctggccaacatggtgaaaccctgtctctgctaaaaatacaaaaattagccaggtgtggaggcatgcacctgtaatcccagctacttgggaggctgaggcaggagaatcgctggaactcgggaggcggagagtgcagtgagccaagatcccgccactgtactccagcctgggcaacagagtgagactctgtctcaaaaaaaaaaaaaaaaaaaaaaaattaagctatataatccatcatgtttcttagctttccttagaacctagagttacacttaatgtttaggggtaataaccatcttacccaagaagttggtaaaattagctctctttctgtcttacatatgctgttcactatttctctttccaattaataaaaaaattctgttcaatgtgtggttcataaggatttaatcgcatcctttttggaaagagttgacagtaaaaattacatataaataaatacatttatctccttgactcattctataaaataccaatgaaaacaatttgaccatgagtttaaaagtgaaacagattttaacctattggctgattgaccattgtcttcagtgaagtataaaatttatttgctgttttacggaattgccagcaatagcacttttgcgaaaagatgtcatttatatattttcaccatgtcaaaatattcaatgatttcctctactttctttgtgtcatcaccttcttcctgcaatgcccaaacagactttgagtatttgctatttcacatctgacaggtgctgggattcttagactttgatacagaggtattgaaaatagttcctcttaatggtgctctcatctccacatgagacgttatcttgaaagatgattttccctcctatagaaaatgtataatcatctaccgtctcaggagttatggtgtcagaactaaaatggtgtaagcaggagcctggtggagaagagacaaggagagggggcgtttaatttgactgcctttcatcatgggtacttgggctcctcattcttctaaggctgattcattcagtctgacctcagaccattggtgcaacccagggctcctttactgctcacgtgatggcagtttctggaatatttctaatgctgagttgtgctgcagaagcttcagtctttgaagcaatagtagtcctttctgaattattgttaaaaagaagttgcgtgctgcagagtaaggaattttatatggtaagagagagcatcagaataatttccttaaaaataaatgctatttttgtgtatctgtcaaattattaatcatgttacaaacatttaaattaagatgaatgaaaaacatttattttggatatactcaatttggtcctgatgaagacagaaggtcaaattttctatgtgattcaactccaactttccgctcaacttcatgggaagttgtgggtcaaactactacacatttcttactttttttgtggggatggcccctctaggaaatctagtctatttcaattaaaattaaaaagcactaaaaaccaaatcaaaactgtcaagtccttgaagagacatgctggttattatattgagcttatttctgaaattattctggtaggacatagatcacaaaagcaagataagacttctgagatctaggaagttttgcatatgcatgtattgtgtggtgaatttccacactccatgtgaatggaataatttctaataataattatggaataatttctattgggcatgattatttaaaaactgcttgctaaatttcgcctttgctgcttgcctcacagatcataggacactattcccctcatcacccagaaactattacacctcgcttggcgtcctagcctttctcaattctaagcattttgctaggcttggttctcctgaaaatattaattttggggcatctcttcacccattttcatagggaaacaggaacagagatacagaaaaccttttcttcagcctttctgagttgaggtagtcttcactataaaaccaagtttatagaaaaagagccatattctttaaaataatagtaatagtaatagtttgttttagtttctggtctttatttcccctacttctgtagaaagctgtatattagaattctctggtgggattaaaattttttttataatgatctgactcatgtttttcgtactgatcatgtattgatttttatccttagcaacttgttgtgtgtttgagtgtgcatttgtgtgtgtacaaatgcaaatgtatttatttaatcttgcgtcttatgataaaagcaaaagagctcaagatatagttgtaagttaaatgaaatatggataagaacataaaacaaaagagaataaatggaaaaatttagatgtagctaatatagaaactagatgcatttttaaaatttatttttaaatagatgcgttttaatataaagcacaaaactgattacacctgtaaaatctgtcttctttggaaccagaaataaaactagaatatatttgtaactctgcatctaagagcatagtgagatgggcagagaaacagacacacattgcaaattgtttaggcaggaaatcctggtacttgaaaatgacagaagaaaaaagacaacactgatttcattattgaaatgtaaattaaatctacatgtcaactaaacacgatttatttttttcttgagacagggtctcacttggtcaccccacgctgaagtgcagtggcgtgatcttagcccactgcaacctctacctcccaggctaaagcgatcctccctcctcagcctcctgagtagctgggaccacaggcatctgccaccacacccagctaatttttgtatttttagtagagatggggtttccccatggtggtcaggctggtctcaaactcctggcttaaagtgatctgcccacctcagcctcccaaagtgctgggattacagatgtgagccactgcgcctggcccaaaatacaacttttaatgaactgcagaaatatggttgccagataaaatatatacccagccaaatttgaattttggagaaaacaatgaataatttttttggatgtaagtatgttccatatatagcatgagacatatactacatgggacatactgctattaaaaattatttgatacttctggaacctattcatattaaaattattcattgtttgaaattcaatttaattaggaattctatatttttatttgcgaaatctggtcatcctatatagagaacaatttatatatgtccctggtaaccattttaaaataaaaacacaatagtaacatctactgcaggtaatatttatttcattcagaaaaaaaagccctgaaaatatttactatttcctttattgtcaggaatcttgattttgagaaaccttagaacattccatttgctatacagatcattgcattgtgctgactgccttctcattgggatcctggactgagggcacctcatgtgatacaggatgctgtggccaatgctagtgccacaaaaggccattttcaaactgcttgatgcaaattagagtggctcttttcagaacttacttttcctgacacatgataaccaaaatgaaagaacatcaatgtctttacagtagatctgaagtggagatcccctctctgggtgtgcatttgtgtggtaacagttttattattatttattttcacagggcaaaaagattatgaactttcttaaaatcaccccaattcaaataagagttcaaaatacaatgaagagcaactttaatctatcatgatatcgtcaatttggcataacaccaagacaacttttctttttccttttcctttctttttttttttttttgagatggagtcttgctctgttgcctaggctggagtgcagtggcgtgatcttggctcactgcaacctccgcctcccgggttccagcgattctcttgcctcagcctcctgaatagctgggactacaggtgtgtgccaccatgcccagctaatttttgtattttttagtagagatggggtttcaccatattggccaggctggtctcaaactcctgatctcatgatccacccgactcggcctcccaaagtggtggaattacaggcgtgagccaccgcgcctggccgccaagacaacttttcaagattttcaggaattttcccaaacagaactaagtctttcaacatccttctgtattccagtcgatacactgaactcccatttgcagaatgtgaaatagtttctcctttagctgaaatatttgctagaacatatgattctacttttgaagattactgttacaacgtcatgtatttcataggggattctgcagttactaaatatgatggagatgctggggaaacactttctagttctcttttttttaagcacagaagaggagtaggaacgacttttaaacaaagatatgtttcactactgatttccatgccctaaagctgtgtgttctgttttacataagaaaaggagacaaaataatttgaatacacttaacattgttgagctgtacactgagatgtaagataagttttatgttatgtgtattttaccacaattaaatttttttcaagcaataaaagaaaaaagtgaaaagagagaacaaaagtgtgcacatatcacatgtgtaagagagaaaaaagagaaagtaataaatggagagagtttttttttcacagtccctgtgatgccctgctggaagacaggaaactcacctgaacacccacacagacctttctacctcttaaattatccttttttatgaaggattgtagggaataaactgaattcacattctcactacatttctgaaaatatttcagggattatggagaaactctttcaatacaagaaactgttttttaaaagtttcccaaagaggaaaaaaagccccagggcttttataatctccatttagggttaattggatggagaaaaataccactaataaaattaatgtttaatttaaagatcctcccattctcccacagcctggaaaacagacctaagctttccatcaaaaatttagcctttggtaaatgtaagccagcagagtcatgagctaatttccatgagaactagttcaatgttattcactttttttctggtttttgactgattcatgtattccttattaaaattcattaaatgggttaagccctgcagttctttgagataatttgtttaagctgctcgaagtgggtaaaagggcaatttttcctaatgaaactgacctaggctaagaaaagacctgtcccttagcaagagtggaagacacactactgccagtactcaaacatcacatcaccatgtgttagccaagcaatacgttcaatttgcaaagaaaatttcacataactaccatctttgacctgcagaatccatttttgttgttgttgttgttttttgttttgttaagatggagtctcactctgtcactcagtgcagtggcctgatctcggctcactgtaacctccgcctcccaggttcaagcagttctctgcctcagcctcccaagtagctgggattacaggcgcccaccaccatgcccggctaatttttgtatttttagtagagaaggggtttcactatcttggccaggctggtctcgaactcctgacctcgtgatccatccacctcggcctcccaaagtggcttttttttttttttttttttaatatggggagctgaggctttctctgcaatgctttaaaaacgatcctttctgtaccttttaaataaaagtgtttttcttagaaacactgtaaaattgttttcaaacagccatttctcccctggctttgttccttatggagagagccatccaaccatttcaagtaatcccaatgactatcaaaaggataaatctgcacatattgtcttctgataaactcagctatataaaggataggttcaaaataatgcaggcaaggtgaaaagccttaaacaggaataaaggaatggactggaagaggaagaattgtgctaggaaggctaaaactcagagtgaggtgagtctggaagaaaatattaacaactacaaagggctttttatttatgttctgagcaagataaggggaataaagagagaaacctgctctgggtttatggcacactgtaaaaaattggcaaagaaaatgtggaaggcaatcaatacttgcaaatggaaaaatccagttctgacattttttaaaaaatggtgaatgtatagcatttttttttttttttgggaaatccatctagaaagattttaaagtaatttaagatggattacatgtctgtttggtattttacaccaacattaaatacatctttattgagttgttggtgtcttacaagcatcataaattcaatacagaaatggaatcttttatctttcctcccaaatccactcttcactctttagtgttccttattttgggaaatttcacctgccctctgaggttttaagacaggaacctggccgggcgcggtggctcacgcctgtaatcccagcactttgggaggccgaggcaggtggatcacgaggtcaggagatcgagaccatctgggctaacacggtgaaaccctgtctctactaaaaatacaaaaaattagccgggcgtggtggcgggcgcctgtagtcccagctacttgggaggctgaggcaggagaatggcgtgaacccgggaggcggagcttgcagtgagctgagatcgcgccactgcactccaccctgggcgacagagcaagactctgtctcaaaaaaaaaaaaaaaaaaaaaaaagacaggaacctaaaagtcattcttttttttttttgagacggagtctcgctctgttgcccaggctggagagcagtggcgcgatctcggctcactgcaagctccgccttacgggttcaggccattctcctgtctcagcctcccgagtagctgggactacaggcgtgcaccatcacgccccactaaaatttgtatttttagtagagatgggggtttcaccatgttggccaggatggtcttgatctcctgacctcatgatctgcccaccatggcttcccaaagtgctgggattacaggtgtgagtcaccgtgcctggcctgaaagtcattcttaacactttcctttcctttccttccataccaccaaatttccgtcttttctgtctccgaaatctatttcaaatctccttctatttacctccatggccaccattgtaattcacgccctattttctcttgcttgagctgaaacaacagcaaatttgacgatgtcactgaatttgattatgcttgaaaatccttcagtgaattcctgttacagttgagacgaaacgcaaaacctacaaggctctgaagaaattggctgctacctattccttggccagagcatgcgtcactcctcttcaattgttgaagttccttaagccaggtgtttttaaccacagggcctttgcaccaactcctttatttgtccactctttcttactctttacatagctatctctgacccttttttatgtgtcagcttaagtatcattttctcagagatgtctctgacctttcattgttaatcaagtttccttattatagtttttcattgtatcctgcatttttcctttatatggttctatttgtaattatatttattagatcatatttattaatgtcataattttaaaattattagtttaatgtccatctcccccattagagcataaattccattagtggagatattatacctattttcttcatcatgtatccccagtacttagcaaatacctgacacacagtggatacttcagtagacctaattgaatggctcagtaatggtagtgaagggtgaggaatgtaggatacagagacatagtcaaaagatactcgggagaactgatgagtcccggagatttgctggggatggagaagtactataaaggagaagatgaaatctgtgatgacttctagcttgggaacttgagtgtatgatggtgttgttggctgagataaaaaaagaggcttgtttgagtggagtctcatgagttagattatgggcaaaataagtcggaggtgcctttgggagtatgggttcaaatgtagtttgaactacattttgaagtttgcaccaaaatgagtttgagtttaggtgtttaagttctatagtaattggctctactgtgtggtgctcagagatatgtgtcaggtaaaacttaaaataatgcagcaaaattgtgttgcatgaaaagtgaaatccttggatttgtagaagaatgagtgaagtgtttgaaaagtaacagagatccaagtagaaagaaagcttcaagaagtagtagatgtaaatattcataatacaagactttttattggtttgtcagagaggagggtcactggtgacctcagtggaagcagttcaattgccaagacaaaggcagaaatcagattgcagtgggtttgaagaaatggaaggtgaggaagtgggactgagaaatggttatggggttgaagaagcagtgtcatagtggctacaggggaataaagccctccataaagagatttctttttggtgggataagcatgctaacatccagatgagaaggaacctgagtagagacagtgtgaagattcagtaggaaagaggctaactggtgaaatcatttcatgagacaagagagggtgtgatctagagcaccaggggagacattcaccttaattgggagaggaggcacccaaatccttatcaagaggctggagcagatctctcagtgggtgaaccccccaggatctgccccatggggagggatgggactagacaggagaattcacttacagtggcagagattggtaagatcaatgggaatcttaggggtcctggttatgaggcaaagatagaaacaggaacacaatttctgaggtggtggagtgagagttatgcacacagaatatggggtaaaactgacttgggttctagtcccagctccacctctcactagctatgtggtctcacatatatgggtgggcacatgctatcaggatggactcctgggctgtgagggagaccctggatttgctttgtggctcacagatgcatgactgtgattgagtcccctaacctctcagaggctcagattcttttttctggaacaaagtaaagataataacaaactattttaatagtaatgcactttacattctatcaatataaagtggaatgtttgttcatttaatgcttttgatggatttcaaattctatttctacaaagtagaggtctgcttttcagcaaggtgttcaacaatttattgccacaacagatgcatgttatttttccttcactgttttccactttttgttcttttaagcttacttttaaatgcttttgagctgccttatgctgtatggactacgacttgttttgatttgctttatctttttcaatcactgttttcatcccattggagttttccagttcctcctgatcctggttaggtgagaaggtttaacctcactccagtctctgtgctctagtatagactgtgcctccagcttcaatgattatgctaccattattcttttatgaattgcttctaactttgcattttcctgtaagtatttatacgattatttacatttacgcaacttaactagttttagtgcttgctacagttcgttttataccagtacttctctatttgaggattttgaattttgattcctctcttaatgtatctcctcaaataattgtttggtgtgataggtggaacagtggcccccacaaagatatccacatgcttatcctcaaaacctgcgtgtaggctactttacaaggcaaaagataatttgcagatgtgattaaggctaaaggccttcagatgcaaagagtatctttgattatacaggtgggcccaacctactacacgagtcctttcaagagaggaaacgttcctggctgcagctagagagagatggcagcgtgaggaggctctgacttgctgcagctgccctgaagatacgggaagggtgtcaccggctatggggtgctggaggcctctggaagtggattctcttctaacaactacagaaaagaatgctgttgtgctgacattttgattttagcccagtgacatctgtgctggatttctgacctacagtactataaggtcagtttatattgttttaagccactaagtttgtaaggaatgtattatggtagcagtagcaaatccatatagctggcatctttcctaagcacttccatgtgaattctagtttcaaatgaaactagatctcaactgcttactgcagccttgacttactgggctcagatgattcttgcacctcagcctctcaagtagccagtgggattacaggcatgtactgccacacccggttaactttttgtatttttagatggggtttcaccatgttgcccacactggtctcaaattcctgggctcaagtgatcccctgccttggcctcctaaagtgttgggattacagcgtgagccaccacacccagccaagacttttctattgtcctctgatatttagtgatggaaggagaagcctggatctgctcaatttttattggtaagtcacctttcattttcctcccagaaaaattgcactttaaaatcctttctagtgctttataaattaccagaatatgcctaagtgttaatttgttttcatcaattcttcctggactatagcaagagcatttgctttgggatttctctgaagtctttctactcaagatgtggtttgagacctgcagcatcagcctcacctgggagtttgttaggaatctcagacctaagatttatactgaatcagatttgcatcttgacagggtccccaggtgactaatgcacattccagaagtcctgataaaggttattctatttgtagatttgatcttgactcttttattagagtcctgaatttttttgtcctttgactccctacgatcaatatttatcaaaagagagacatgcttcttcctctcctccaagaggtcatagtcaaagctcttggttcacacttctgttaagtttagcctaaagctgcctccttacctattttaagttcagcctaagagtttctctgtacatggtgaactactaatctaactggatgtgtaaacagaccataacctgctcttgtgccagagtttcggccaaaggcagccaactgttcgaatcgtgttcaaatcagggaaatgtcaagctgtaaccaatctgagctgtacctcaattccatttttgtaggttactttgcttctgtccataaatctttgtcgatcatgcgacagtgttggggtgtctatgaacctattctggtttgagggctgcctgattcacgaatcattctttgctcaaactctgtcaaatttaatctaaggttttccttctaacacttctttcccttcctctggtaactcaggcatactactcccccaacctccccagcctaggtttggtctcctatttgaaacacccaatccaaaccagaattacctgggagagtgatgtgcatgtgattgctgttgagttggaataaaacgtgagacctactgctccataattggagacctcctcatgttgacctctacatcattaacttcttgcagcatcaggtctggttctcactgatgttaatgaatgttttcacctgctgaggtaatccgaagcccactgatttgtctatttcagacttctttatcaagcattactttgtgtggtctttgcattttgagcggccgtgcccatttctcctttttaaatattacatcttctagcatctgaggatcccaagtatgttttctgagtttcttgttttctgtagtaaatctttttcagtgtcatgctcttctaatcttcaaggctaaacattcctttttaaaatacttacctattttgttatagatgccatcctccatttaaaaatcaattattgctagaatctgtgaatccctgatactatctttttgatgtcttggcactttactgggatgttgggagatatgagatatgagatatcaatatgagactttggcctgatgtcattttaagatttcttagcataatctattaatgttaagagcaatttatttctatctctactttggtctacaaatctagatcttttactttttaaaagtaagatctggaatataggtagaactgatgtttatttcttgttttgactaaccagctaagacttgaaatcaatcttcccttaagactatggcttccctgattaacaatagttgttactacttgtggagataaagcacaaaaatcatcagaggattacccctgcaatgtattttctcataactacaatagcaagaaatagggattaagaacaaacttgtttgctttacagtggggattcttggtgcaactgacttctctttctccctgtttatttttcgtatccccaggttctcctgtagaacttcccaggcagaagaaaagataattctaatggttctgctgtggagcagagagtcacagcttgcatcacagtccacggatcaccaagaggaaccttactgactactggtgagtcaatgttttacatcacatgaagacaaaagaggatcacggatgtcattttagtttgggttctcacaaaagcagaccctgagaggaggacttgggtgactctacgaagcataaagcgaagaatggggaaagtgattcagggaagggaaacgttaatgaatagattattgtgttgagcagctggggcttagtctcatcgtggatcttctgaaaaaccacgagaacatggggggataaggattgttctcctatggtgttaactctcctgcattctcggttgtgcctgctttaaggctgaggaagtatctgtggtgccacagaaagttcttcattacagaataagaggctggtgcttgaggtagaactatcagtttgctagaagcatcccagccatctgtggacttgggtcagctgagaggatatgagtaagacatcaacaccacctgttgtagatgctgttgatgaaaacaggcaaaccatacctgtggtaggaggaaaatgtaactatgcacttagagtgatgattttttgggaagaagggatttacatagcattaaaatggagatggaaaacgagtccattcttttgccaactctgatcaactgctgcctggagtgctgtggtggggattctcaacggcctcagcaggaaatcatctttattgattagcaaccccagccatgggaatggaggaaaagggggtagcaagtgggcactgttttgccactctgttttaaagtggaggctaatttttattaatgagttgagtgaacatatctctaatgaaataaaatcttccacagatttggccttttaaaaatgcacagatgtaaagtgcctttggttaatgggagaattctccaattgttgcaagactggggtagacttatgaggcatagcagttaaataagcattagctttgttattttggcacaatttttctggtaaacatgctaatctctttcccactgatacataaaaaatgaaatagtcatagtatgaactgaaagtatgaagagatcaaggtggagaaaatgtaagagtgtcaatacctagtcctagcatcaatgctgagacaggcgtaatctgccatcatgttttaaggaaatatcaccattcaccctgggacatatttaaactgttatctgagtccaacaataacaacctgtgccatagcaattcaagttgatttcaggtcctgtggttattttctaaatagtcctcaattctcatgtcccatgctgcatctgagtaattcactgtcaggtcctgcctggcctactgcagccaacctacctgcctcctgctcgtaccttcatccatctgctcttcacagtgtagtcacaacagtcttttcaaagaataaatctgatcatgtcactcatctacttgaaaccttgtaattggcttccccatgcttgtaagaacaaagtgaaaatcctttgtaggaccctagtctgttccccatccgtttttctagcctcacctcgctctggtgctcagctcctatgtgctttgctttctctcctccggccacagggaccttctttcagactcttcagtctccctcttaccacaaggtcattgagcctgcttctctgccctgctgacccagctaactcctgtttctcctttagatcttggtttgctccagggtcacttcagaggtaacttcccagacttgtctaaaccaaacccgatagaggctctcatagctgcataaacctcaatgctacttcccatttccatggttgagaccactaattcgtaaaggtatttcccctctttgggtctaaataatagaagtttgctatattacacttcttggggctagaagtctgagatcaaggtgttggtagggttggttcctgctaagggttgctggggaaagatctgttcagtcctcactcctggcctctggagttggctggaaatctttgccattccttggcttttcagatctctgccttcatcttcacagacatgcacacaggggatggcatctccaatgttctcctttttaataaggacacaagttctattggactagtggctcaccctactccagtatgactttgttttaattaacgacctctggaatggccctatgtcaaataagttcacattctgaggtactgggggtaagaacttcaatatataaatttgagggtgggaacacaattcaacctttaacaaccccttacattaacctccctgggccaaagtttttgcatctgttacaattggaattcaggtgcatgtttctgggataacttttctctcccctatgggtttaatttcctgagggcagggatcttacgtgtatgtattcattctccagttcctagcacagtacctagtgtagggtaggtgctcaataaatacttgttgcgtgaaaggaaacatcaaaatgtatttttaccaatactcaatttttatttctctgtggtgtatctctcatgtagcagtttgtcattgaaatggcaattttggatatattgtcacattctttatgaaatctgtgtgaaggaggcaggaaagggatgactacacatatcttacagaaggaagtagagttctgatggcatcccaggcatgcaacagggagatggcagaactgagacttggcccacaccctctctgactccaggtctagagttcttttcccacaccaatttgccatagcaagatggcagggcattatgcaattagcagactagttacttgccatgatcttgtcctaaaatctttcaggtcagcacaaagacctgtaataattatttggatgttgcttgttggttttatattcaatggaacagaagaggccagcaatagtgaccacttggtagcctgggggctgtagtggcagagaatgaggttcttggcacatcataatctcctgtgtatttacttagatgcatgactataaggggcatcatttcaagctgccgttttacttaggaaaaaaagttggagaccctctgatgtcccacatgggcagaactagggttggaaagagaatagacacagatatatggcactgagggagccagatatggttaggccaagagccttctacaactctgaagttttcaagaatattttattgctctattgcatagatgagagactgaaggaagttctcctgggctgccagcaatgtgccttggttgagtcatgatgtatgtattacaagtctgtggcatgttggaaccataggggaccttccagccaatggattctgcctttgcagatgtacatacgagggcttcccactgaatcatcatggagctgatgacaatcactagaagtgatgtaaatctttcagagaaggggaaaatcagcacttaaactcactagtagttgacttctaaactaaataacaccatgttttattttggttttaatcttagaaaaacagtgaaggcaggggccatgcttgttaataattgtattgttaacaagcatattgttaacaattaacttttagtgataccacaatatttttcagctgaattgaattcaattaagttgacagcttatttttgaacaatttcccatcttcaagtcacttaacaaagaagcctgcaaacaatgttggctttcaggtttctaaagagaaacagggtttgaaaaagtatgagccacctctgtcacctgcatatgacaaaggaagtgtgtttgtgtcacctggacccacctagggactctgtgggtctgttttgctttctgaagctgcattagtagcgtggggctcattctcagcttggattcttcacacagcgtcagtggggactaatctaggttttttcctaatggaattaacaagtcgagaaccacactttacagcccaacagcgcctcttcacagctggcacctgctcataccgaacctggtgcttcatcatagccgacattttgtgcctcttctgtcctcgtctacctcccacgtgaaggggaactggaacattatcttctttgctatggatgaaggtcaaattgtgtctctaatggctgctctggctgactgggctgctctgattaatgatgactaatgttttacagaggatcgtggagaacgtgcctcgtctaccttcctaatgagataagggttcactcctgagtccttattttctcactttatacacgttcccttggggtctccctctctctcatggttttagcttctgtctgcaggagaggaattggtagtgctgtgtttctaagcctgacctctgctacttacactaagtgcccctcacttctctctcaacgattccctcactcattcatttacttattcatcattaaatgcatattgattgaatggctactgcaggcccagcactgtctatctggacagcttaccaagacaaaggtatgacttcattttgctgaatctgctacacctgcttcctccatctgcacccacttttctcttctcactgaggcattctcctgggttgagttcattttatcctcagggcctctcgtactactgaaaacatctaatctccttctaaatcagccttgtccttcccccccaccgatgtcaagaccaactgttcagctgtatttacactgactattctacagggcccacagactcacatccaataatgaatgtaatctcttcccccacaacttgcccttctccaacagtcatggtgctatagcaaaccattctccaatccagaaacctggggctcattgcaaatttgtccattccatcctccctttcacattctgtcattccttgatgtcgctggtattgacctcttctctcgactcttgcttcctactatttgattcagagccccagtacctcagaacttcttgcctatagtactgtaaatgacttctaactattccttcctttcctctattcctgtcctgcccaatccattctttccattgctgctagaggaatctttgtaaggcacaaatttgagcatagtacttctcttttcttctatagtggtgtcctatttgctgcagaatggagtccaaactccttattatacaacctactccatgacctggccctgcctgcagctccagccccactgcttacaaagttccacctcagagccctctgtctgtctgccccactccatttgcagctctcagaacacctgggctgtgtgacaactctatctttgccctgctgggcccatttctacctagaactcctaccccatcctgattgcctggcacgaagttacctctttataattcttatctcatgcaccacctctgaaatgctgtcaccactctttctcttcctggtagaactgaccaatcttgccgtgtccccccacccatggtaccctggctgcactctcatcacagcacctggaacacaccaggacacttcattgttatgtgccttgggctaagtagattataagcttcttgagggcaggggcaacatcctgtttgtctttgcatccccagtgcctaccaaagtgacatgtatgtaaagaatgcttgctaagtaaataacagggctatttatcctgaaagggaattctgtagtttgatactttggttttttaaaaattatttttgttagtttgatcagtatattctatttccctttaacggaagataaaaccagcttatattttagcataagacacacattaagtaacttgaccatgagaaaaataatagagtggactggagcaaacatttgcccaaacgcatccatttttacagaggtggaagcggagcaatttaatgatgtaccatgaaatcacgtcaataattaatggcagaattgggacaatattcctgttcagtaccttattgtcctgctgtgttaggaaaacaaactttattgagctttgactgtgtgccaggcactgctttggtcatttgtagacattttatgccataatctcagcagataggtgcagctgccgggtttacaacccatatgttgtgtttacccctcccacctctctaaggctaccgtacctgtactgagcacacacgtttcttccttggctcactatgccatgttgccaggtcacttttctgatctttagcatgtcatgaatttcctcctgagccttcctggattcttgagcttgactatgctaactcccctctaaagtctcctctttcccatctatggctttgtcagatttaaattcccaggacaggttcaacagtctatttttcctttgctagtgtattctggcctctcttgtggctttctcatcaggatgactgctccccacatggcagacccttagttctcttccgcctgttgtccaacttttccatttactcatgaagcagcattgtgccccagacacctctttctcactatgtgaaaaccatcaaagggtttattgtctcaaattaacttaggttgtgagatctcagaactgtttagagaactagactaactttattgtttagaatgaaaagataattatttagcatgatgctgtgggaagctgagagtggccaaaactatgaccaaaaggtgaagaacagagtaaaagtacagacagagtaaaagaggacattaaagcaatggccaatttgatatttacaaagatttggggaaatccatatcgctcatattatttgcatattcacatattcagaaaatgtggacaatagaatattattaatgacagttagataaaaacttaatttaaaaataccaaggccaggtgcagtggctcacacctataatcccagcattttgagaggctgaggtgaaaggatcgtttaaagccaagagttcaggaccagcctaggcaactaggcaacacaaggagaccttgtctctatattgcctaggctggtcttgaactcttggccttaaacgatccttttgtttaaaaaataagaacattagctgggcattgtggtgtgtgcttatagtcctagctatttaggaggctaaggtgggaggatcgcttgagcccaggagtttcaggctgtagtgagctatgattgcatgactgtacttcagcctgggcgacagagcaagatcttgtctcttaaaaaatcaaatatgcaaaacatagctctttgaaaagcgctggacattcaggagagatgagaggtttatgctgggtttaatatgttgggaatgcacatcattctgtgtcttcttacacaagaatgtgcctgaaatatgccccattcctcgagggtttcagtttagtaaaccacgtgttttatgggatagcaaaaaattgatgttgatttttctcttcagcagctgtttcaactcctgtacacaatctatcagtaagttctctagcttgccagcttcatgagctctatggagaaaaataacacagaacaaggaaaaatgaaaaactgcaaacaataagtcacatttcctgggtccttattctggcaggcacttcacatcatgccatttaatcctcacaacaaccacgtgaagtaggttctcttagcatcccattttacaaatgaagtaactgcagatttagagatgaaaagtaacttacccccagtcacacagtcactaggtggcagagctaggattttaaaactacttttgaacctaaggttcttaatcattgtttgttttactgcccccaaacacagtagggtttgaaaatggccaagtgtgaatctatgaaggccccatctctgattgctaagaaaactaacagtcactttatgtagagtccaagctttgccatctgatgcttcttaacacataggtcctgtactgttgcaggaaacttcatgagctaacaaatgaaaagccagaaaagagaatttccttagattaagagggaatttatacccagaacatggatatttctcaagccaaaaggaaaaccaaataattaacactgagtgaaaagtgtaatgaaaagcaaaaatcaaatcaaaccacacccataaaagttacccagggctgaagagataaatcagaaaataaacagaagaaaaattgtctccctcatgaaacatggttatggggggatactctgaacaacacagctgtcaatatttctgtggatcataaatagcctctcaattgtctgggcagtcaaaggtgaactgctcctgtctctgtctgttcataccacagtttctaggtgtgcgggtatcacacctgggctttcatcttttaagacttttgagttctaagcctgtatgtttcttcctttacatcagtcttccttttaggaagattagaaaaacatgtatgttttctcactttgttccccagaccatttgttctttcatttttcttaaaatgctctccacttttaagagctttctgtactaaaaaaaaagtgctctcacatacttgacctacaggtttgaagaaccacccagagatatatttaagagttagctttgagatttctgaaaatagaaattatattcttaaagtacttgtaaagagggaagacataaatagtggtgacagcaatccaatttaggggagaggataactacctcaaaagttctgaaactttaaagaaatattaacaagttatgttatcaaatagttcaaagaaatagtaaccaataaactgaaaatttcaaaatattaatatactaaataatcaaaaataaccattaaaaatgttgataaggacttaacaagataatttacctcaccaaaaccatttactgtaatgccacaagcctccctattttatgatttatggccaatattttatactgccccttttttttcacaatgaaaacagatttatggtataaaagctagtagaaacccagaagagaatttatgcatttttgaatccaaaactaaaaagggaacagatgagtataaaatatcactattatattcatcatcattattgtctatttttattaaagccactgcttttcccaggcatgtagggcacttttaaaataaaattgctccatgtttaagcttaccgacttggtacaattgacttgcagaagcaattgctctcctgaacatttattatcccttggaccaaaatcatgtaaagccttggactgcttgattcaaaggcaaatgttagggtaacgctttctcattctcaattctacagagtacgtagatttcattgtgaaatagaatggtttgttcagttggcatttttggagttttggattgatttgcctcatctgggaattggagtacaggagcaatgaacaatgtagaatttatgcagaaaccaaacattttatttattttattttctttaggatgattaaaagtaaagtttttacctatgtgacttgtgaggtgagttatcaggttgtgtgggaaaaaagctctccactcgttagtcttcgtactcacttagttttacacagtgagttataagtgctctttttttgaccaggcgcggtggctcatgcctataatcccagcactttgggaggctgcggtggacagatcacttgaggtcaggagtttgagactagcctggccaccatggggaaaccctgtctctgctgaaaacacaaagattagccgggcatggtggcgtgtgcctgtggtcccaactacttgggaggctgacgcagggggatggcttgagcccaggaggtggaggtcgcagtgagccaagatcaagccaccacattccagcctgggcaacagagtgagactctgtctcaacaacaacaacagcaacaacaacgtaaatttttttttttttttttcaccaaatagttcccctttttgttttggaggaagtgtatcaggtaaataacagacagttttccacctttgtcctatttcaacagtctccattcccaccaaggaaaagcctcacggtgaatggcatttttggaagtccatgtctctaccgtcactcagcatcaagtcactgaagatgctgggcattcctccatgttctcaggaccccagactgtcattcccagcagagaaataggtcctgaggtctggctgctacccccgccttccctctgctcacctcacctccaacttacacagaattggctctgctggcccagtccctgcagatatcctggaagcaaactacctgccggcctggcttctgcacactgcttccctggagtctttctttgggatactgcacaaactgctgtaagacccaaggctgattactcatcagagatcacttgtcagctgcagcagcctttcagcttgaattcttacccccttattttctgagattccaagtttttgtttatccccgtgagcaggttgcctctcagaccattgctagaaacactatgccttggtttatcgtcagtagagccaaccaagatgattgtctagtgaagacccttcccacatttaatttttttatttatagataatttttttttttgagacagggtcttgctctattgattagactggagggcagtggcacagtcaccattcactgcagccttggcctcctggtcttaggtgatcctcctacctcagcctcccgagtagccaggactacaggcatatgccaacatgcacctgtatttgtgttttttgtaaagatggggttttaccagaaaaatgttttgagcacttactatgtatctggctccatgtgttcacatttctgcacctcagagttttagaaatagaactgctttaggcacagttccaaaagcaaaatagcctgaatatttgttggggtgagagtgcttcaaaaccaagtccatatttggcaaggactgaccagagagaggtcaatttctttctaaacagtccagtccagacagcattctgcgcatgggcttcttttcgccctagtccacttcttgctgagtgattaaaatatttctagataaattaaaattcttcttttagtcctttgagtgtccaaggcagatcttgttttctgcaattctttgctcctgcagccacattgtacaacgccgagggtgctgttcacatgatagataagtctaagacagggagtgcttctcaaacaatctctggcaaagaccagtttttaaaaaaattcaaatccaaaagccaaatgtttgtaaagaaaattattagaaaattaaaagagaaaaatataagcccctgttttaaaaattgattcaactgatataaaattactcatgtcaatttgccatatgagtttttaatgcttaatttcaattttttatgtctttctttgagcactggtgacaggtttctggaccactcccagtcaatatgccaccctcacaggtctaggtcatagattctgtgcgaatggtgccccctaccggtgtgcagtgcagtttaactgaatgtcagagagtgactgcagaaagtatacaaatgtttaaaaaaaaaaaaaaaaaagtggccagcaggaacttctctcaaatgaggctttggcatgataggcaaattaatggattatagacaaaatacaggcattactctccttatttcaactttatagctgagccttgagaccaatttggagttgggactttacattcatgctcgttagtgattcagtgccactggcagcgaatgagacctttttcagttaattcagatattctggctgaagtccaaccctggtaattgcctcggcctacgtgaatgtctcccaccaccgaaattatatttcctctcttaaactaccgtgtaatatcacggtctgcctttgaatagctgccattgtaagctttagaggtaactaccttttcctgccaggtaaaacaattttaaaatgcactgtgcgtgtgtatgtatatatgtacgtatttctctgtgaggcttatgaacatataaatggcttctcaaggaagaaactgttaggtaaatgtacagtcagattgacacttttaacagaactagagtttcactggacatttgcacaacaaggctgaggggaccatggaaatgagttttctgtaaatcagatgtgaatgccaataattgcagggttgggacatgcatgattaaatgcatgggttttaaaatcagattttagtttgattatagatattttgtgggacagcatcattaaaaagagagacttaaaagagctttaagaaaagtttagggcataaatctattcaaggcttccaccctctccacaattttggtgtttctattcttttcttgtacagttggtgtaaaaagggctgtaaaagtataactctctgaatattcatttaaaaatagtttcttagatatatttttcctttttgagtctgattccacattgttgtcagtcatttttctaacacatgttcttgatatgttgataaaacacctacactggtcatcatcattgctcattagagtaagtctggactctcttgctgggcattcaaggccctaccggaggatctgtccctatttcaattacccaacagtatcttgattacatcccagtatgaactttcaccagagttctgctcatcaaagaacttctctaactggacctagtccatctcacctctaaggtctcatgactcacagagctactcaaagtgggaagtccttttcccccttctctgtccatttaaccttaaatccttgtccacctttaatctcaccttcaggcgattcttttcctaagttcctctcacttttatttgcatcataggatttagactttaagtatatttctcttttaatatttattggatatttcatgtgcatgaactccaccttcctaatgaaatgatgttctcttcacaggcatgagtgaaatagaaaaatataatttccccccttcttgttgtgcagaaagcctgggtaatcctcccctccacttctcatttgtcactcttgtcttctctgtcacctgaggaagttgtgtcatagaaataccatactgccttcttactcagttgtgtgtgtgtgtgtgtgtgtgtgtgtgtgtgttttaaacccttagaagcatcattggttattgtgaatgcctagacaacagactggcaaaatttttctgtaaagagccagacagtaaatatgttaggctttgcaggctacatgatctctgttgcaactactcaactctgccctcacaatgcaaaagcagccattgagaatgctcaaaccaatgagtgtggctgtgttccaataacattttatggacattgaaatttgaattttgtacaactcctacctgttacaaaagagtattcttcttttaacattttaagacatttaaaaatgtaaaaaccatccttagctcaagagccatacaaaagcagatggtggactgaatttggcaagagccatggtttgctgatctctgacctagatcactgtttcctaagttgcggtccctaaaccatctgcatcagaatcacttagggttacgagtttatagaaaatataaattatggaaccagtgaaggagaatttctgaagaaatgaaggctattaaccaatagttgtggctcaccacatctagaatggttatgatgggttggccttttgagttagtatttgggaatcagtaagcaaggttctaacaggaaggggcaatgatagagcaggttccttagagacccattttacaagactcacaacccaagaggggcaacatcaacagcagagactccatgctttaaatcagcattttagaaattttttagatgctgaaaatacaaaactcagggtttccgagtgtttatatttaaaatacttgttattgagaatatcagtagatgtggcaaatctttatttaactaaaagtcagtaaaagtagaaatatatttatggggaaggaaaaaaacactcattaaatataatgtatatgagactaaaatgtaaataagaaaagatctttatgatcctgcccacattgaaaacctttgtagctgaggccgttgttacctatggtgaattccagagtaattatttcattatgaggaaacagttttgaagggaagatgtaacatatttcttggataacttcatttacctaatacactagattataacataaacatcttctaggaaggtggagaccatctagaatctcgtgcccacaggggcctttcggccaatgcaaatcaattgaggctggaatatggctctgcctgagcagagtagatttgatggtttctgatctatagaccatcatgacacacattttgcaacttattcccaaactcaaaagaaatggatgaggggagagaatgggaatggtctgttaactggggactctaactgccaacaccagccaagatttattgagcacagcttttgcaccaggcactgtgctaagtgctctatgtggattttcttgtttagtccttgtaattagcacactgatagctccattagaggtaaggaaactgaagtttggagatcctaagatacatgtggcagatcacacaggccaagtgaacaccaagatttgaactcagggcctgtgtcctaacaaccatgctgggctgcctcccaacaccttcactttgcaaggaaatcaggctttggtgggttttctttcactctagctgaggaagaaaccacatactgggctctgtgtggattctggacaaatggggcgagcttcacgtcaaaaaggccagcactatggtgtggcactgtgctaggtcaggaggagacagcccgtggtcctgcaaggacactgagcctgtgtgacagctctggatcactctgccaaggagggataggctgttttggccttttacagtaatatttgttttggaaccagtaagccaggttcctaaataggaagggacgatgacagagaagggtccttgtgatctatcttacaagacctccaacccaagtgggagacaccaatagaagtcactgcaggtgtcataagagagagctcctggattctggcagaagtggtcaagcatgtcagatgaaaactgagactccagacacagattcggaggatccccagccattcttggccaagaggtccaccaatatctagtaaacagggattagtgacccacagaaaaatgacgattagaacatggttctaataaacgttcagttaacagtgcctacgttaactgttagtaaactgcatatatttgaatcgacacattgtccttttttttgtccttattaatttctcaagttaaagaatgccttcaagtatcgctcaggggaatagcactagaactaattagaccaaacactgtgctcatctcatcatgcctgataaggcagagcagaaaaattctccctaacactcgagggcactgttttgaattgcattaaagtgttttcagacattttggagtcaagagtataatgctacttttatatgacattgataatttaaagttacatagggtgtacagagttatttttatagcataatatagtatttctaaaggatgagagtgataagcccaatttcaaatcccttcctttagaacgtgattttatttctctattacaattcattttgttaagcattttaccataggtgtatacaagttttaaaaactttgttgctagtactttttagtgaatatgcaatttttttttagagaataactttcgtcttacacatgtgaaactaagttcacatttttcatctatcattctgatacctgtttttaatgattttccaaatttctgaaggagtcaattgaaattctaggctcacaaactacaatatcaaaaaagacctccttatttattgagactttgaggggcagcttgggtaattaattcttctgaggaaaaaagagaaacaattggaaggcccctatttcattagcctgacgccagctcagattctgggcatcttttggtttctgtaaaaaccctggaagtgtgacttccttccatgtgactggctgtctcagaagttgacttgttcacagtttcctgatgtgccttcctcaggcagttttttagtgtgttcaaaagcatcactgactgactttcacaaactcctgcaatttagagacgtttgttgaagtaagctttctcaagagccttggggaggatggtctttagtaatttcatagaaatctcttccactaaattaggggattctgtcactggaccaggatcaatcattcaagggtcaggcttcatgctggaatatggaaactttaattggaatataaatcacttgggagatgatgttaaaatgtagataatgattcaatagggtctaaagtgggatgcaaaatgacctggtctcccaggtactgaggaccacaccttaaggagccaggtgctgccgtaaggttaagtgagaaggctcagcaaagcttgcgtgcagcagaaagaaaagatctgaggcaacaagactagagaagctacctggtggtgagaaagggtcagagtattcctccatggagaggaatactctttggaattctggatgggatgggttttgggattgcgtgcctgttccccacagctgggtgtttttgcattcctggcccctgcgctctaaatgccagtaagaatccaatcagtacaacaattgatgataaacagcttcaacgaaaaacaaattccattcatgctttcttgaaattaaaatgatatctgacagattcttaatgtgttatttcaccatacaagcactgtaacacttctatgcgtccctaaaggtttttttaaactggacaaatatggcgacttcttccactgtatgttactggcaccatcttcaaatagccttcctcaagtttgctaacataaatgaaaaggtcctccctccttccctacacctgaagtaaacaagctctcttttccctcacttgatccttttccctttgttggacacaaagggaagtctttgaagggactttaggctgaagaaaggatgtaatttggatgtgttgggaacttagggtatggtagaagtccagtcgttgactgaatagctggacttgtctccttaagcctgcagtgtagttcttacaagtatatttttaaggatttttacttccaagtctaaccaagagggttttttttcccataatacaaccccaaaatgaccctgggtagttacaaacccacccctggtgtttgggggagggtgggatggccttgactcaggaaccattgctaagaggtattccacaagaaaaaaaaaaccacacaggcaaaaaagcaaggcatccacatattttaaggtatactgttggaaagtaggtagcttcaaacaaaattggcaggcaaactcattaatttaatagtcttttctgacaagggcaaatagctaaacactgtttgctagacactaaaatataatgcaggtaggaacaatgtaatcttgcttgtatcctctgctaataggatgatccttagtttatgaacaaatagaatttgaaagtcatatatgactgttgctgggtttataacaatttttaaagctgtagtataattaggctaaataacatggttttataacataaaaacataatactaaatttattcatgttttacaatacatgtgagcaaggctatttggggaaacaaattgtccgctcaattaccagataattgtcgtatggactcttaacaatcggagattcggtgatcatttggtgtgtgcgggtaaggtgaaattacttgatctagcactccatttacaatttattaaaggactaggcatcttccagtccagaaagcacaatgtgtctttctgggattttcctgagaaattctgaagaaaaatggtaaccccaatgttatgacttaacaacaaacctggacctgaagaaatgataaagattcttatagggctggtgggaaaatgtgaggtgctgggacagtctttctggaagaagtaatgtctgacctgaattcacaaggataaatagaaatttgccaaaacacacagatttttaagataggaagaaatactttgcaatgacaaagagatataaaacaacagctctgtgctactaggagaatatgaatgccatgaaggcagaggtttttacatgttttgttcactgctacattaaggagcttcaagtggtatctgaaacacagtagaggatcagtgaatatttatggaatgaagaatgagttaattgcgatgagtcatgtgagatgaggctaaagagactggtgtggactagaggatgaaaaatttggatgtaagagaaaagttctgatctttgccttctagaggccatggagaaccatggaggggtattaagatggggaaataaaattgtaaaagtagatacaatcatgtgggtggtcatgattgtggtggtgaggttacagagtgataaaacaaaaaggttaacaagcaacacaagctgggaaatctcagtttttgaggagtagacaaagaattcattaaaggagtctgaaaagaagcagagaaccaggaagacctctagaagatatgagcgtcccggaagccacgggaggaaagattctggaagaaatgagaaatattcattcgacaaatagaaagtcaacagagagagcattttcaatagtgggatggggactgaaaccagacagcagtaggatgagaggtgcaaggcagaaaaggaagtcagatgttaagtaaaggctattcctacaagaatcactatctttatgatttatggtggggtaaatgtaggcccatacttggataatctttcaagaaatttggcccaggatgaaagaaaagagaaaaatccatggctggaggggaaagcagaatcaagaaaaagttcttaaagaatgggataaattagagcaggtttataggctaaaggtaaggtgcctgaagaaaaaggaagttataacagggtccatgataaagggaatgttgatgaagtggttccctgagtgactaagagtgacttccttccagagcaaggtgaagttagtgtctttgattatgggacctataaattttcttttgaagccagagggaaagaaggaaggatgcgcctaggtagaaggtagtttccttagcatgagggagagaaaattatctgtaagtacttgggatgatggcatattagattagcttcagctaaatgtggatctaatgcatgtattttagtggtcatgaatgttttcattttatgttctttatataagtgtgcagatttacatgccaagtggcaagtgggatacagcaggccctgcaaatcactttagatcactggcaagtgtggtatggggagttttttgacaaataaaaaaatacatagctaaaatgcagtattaatcccaaatttatagccatttaagtataatggattcatccatgcttcccttgttaaattgtattccagatttttagtggaagtatcactttggtgcaacattttccaatctactagcagaagatgctttgtaacataaaactgcttctgaactgaaatgcattgtaatgctcattacaacccactctcctggaaatacaaaactgatttatctaatgcactaaaaaattctccataaatgtaccacacaatatgaaataacgttaattaggaggagaggcacaacataatacattttctttaaattttagggcaatctgcataactttcattaatgtggtataataactgcaattatttccatttgcacttttcgttagaatttatattcattataatataatgaatatttttcatattcattatatttcatataatataatgaatatatttcatattcattatatttcatataatataatgaatatatttcatattccacagtatgaaaaatgaacatgactttataaggctttatagcaagatactgctataggtgatttcgttcatttattcaaaaagtaagagccaactcatgcaggcactgtgattcaacaggcttcacggcaagattttcagttcaccatctggaattctcttgtacataactttaattgcacccagtccatttaaatttctgctctcatgcataagcaacgaacactccaacagcagagcacatttttgacatgacaagcataatttctaaaataaaatttattacagtatagtggcagagagtgaggaatgtgatttttttttaatttaagttttaaaatttatagaaccaggggaatttgagacttacttggcaaatttattgtatactggttatttttagatttgagttttgctttttaaaaaagtctccaatgaaagattccctccctccacttaaaaataatttgaataaactgattgaacatattttacataatagtaaatttgaccatcctcctgtagctttagaattgttggctgtaaccattactactactttttcttcttccctctgacatttgttgaaatcccaaattttgctactgccatgttttatctaaggttagtaaattttgggctgcatgctcaaggaaattactactgttgattagaagggggcaggaaataggtttatagaaaaatacatagtaaacaaactgtttgatgtggtttggctgtgtccccacccaagtctcatcttgaactgtagttcccataatctccacgtgtcgtgggaggaacccagtgggaagtaatttaatcatggggactgttacccccatgctgttcttgtgatagtgagttctcacgagatctgatggttttatgagggacttttccccctttgcttggcacttctctctcctgctgccatgtgaagaaggacatgtttgctcccgcttctgccatgattgtaagtttcctgaggcatctccagccctgcagaaccgtgagtcaattaaacctctttcctttataaattacccagtcttgggcagttctttatagcagcgtgagaacagactaatactctattttttttacaactcctttcttctggatcccccaactcataaaatagacgattgtaactaagcctgtgaatccagaaacattgagaaccctggggttttttttacatagtatggacattgcaggttatcttcaatttaacaaagggtagttggtggccagaaaagtgacatactcaaagtaaccatgtgaattagcagcacatattatactagaaatctagtattatgattccagttaaaagagtttttccttatctaattcaggtaagactgtatgtttttttttttttttttctgagtgagggcactgtcgtatggaaggatttacagtcataaaactagcacaatttgtgggttaatgtatagggttaatctgttcttacccattagtgttaaactccataagaacaagaacttatcttgttaactggatgttcccatatttataacagcacctggcacatttatggaatgaacaaagaggaggaagatagacaaattaaacaaagacttggtacatgaccaaagagaatcgaatgatgataggttgcttgaaaagcccagacagaagacagtcagtagaaaaatagttttgttcatttttatacactcagctgcattatttgactcacacatgcatcttcctgattttgttttgtgactgttcttctctccctggtgtcataacagaataaaataattcaacaaatatgcacgccaagctcgaggaaaaaactggtatgagagatacagtccttgttcttgagggaaattagctactttaaataaggtatttaaaagacagtagtttctctgaattggcatttctgtatatatccactagaacaattacttacatttatactgataactgatgaaggtaaatgttaacatgttccttatgcatttaggtgtgcatttaaggtgttagaaactggggtaaataacattagaaactgaggtaaataacaggttaatacaaaattgataattaacaattatatcctgtgtattagtctgttctcatgctgctaataaagacatacctgagactgggtaatttataaagaaaaagaggtttaatggactcaaagtttcacatggctggggagctctcacaatcatggtggaaggagaaaggcatgtcttacatggcaataggcaagaaagaaaaagaaacaagggaaagcagaaaccccttataaaaacatcagatctcgtgagacttactatcacaagaacagcatgggggaaaccaccccatgattcagttatctctcaccaggtccctcccacaacacatgggaattatgggagctacaattcaagatgagatttgggtggggacacagccaaaccatatcatcctgttatacacatagatttaccatctgtaaacacacttctactgtccctctttcaccagtatttagaaatggccaacagacatatttttaaataaaacaaatagatatattcatccaaatacttaagtgatatgtgtttgcagggtggggttagaatggcacaatgtactttttgttgctttatgttattttatttttacattttagatttgagggtacatgtgcaggtttgtcatatggatatattgtgtaatggtgagctttgggcttctagtcctggttctttttgtattaaagagggactgtagtttaaaattttttatttttatggtatttgagctttatgataatctaaacaagtaatttgtctccaagaatctcctcgatacaatgaatgcaatttccctgcctctaagctccaaatgaatgaggtctaaaatattaagaacaatagctccttctattgaaacttaccacaaacaacaacatttcatcacttaacattggcacaaataggaatattagttctttttattttttttatggatttctcagtgcatggaattttggtgataagaagttgatctcatatgagttgaatgggagaaaataaagatcacccaggataataatgaagagacaatgtgtattccgcctcatccctgaatatatataaaaacatagtacatgcaaataaatgtactctaccaatttgaacatgaaagaagctttgttttcaagtgaccaaaacactaatattgacttcttgccaattagtcaatcattttttaaaaaattgagtttacttacaactgacttgagtggtcacgttagctcaaaatatttgatcctgttgccaaatccaaagctaccttctccgtcctattttactcagcacttggcacaactgctcacaccttccatcttgaaatgctttccttcataaggctactaggacatggtttttcttcttcctcacaagttatgtgtttttggccttttgctggtcactcttccccttcctgacatttaaaattggaggttcctagtcctcagaatgtttctcttctttatttgcactcatttcctagatgttcttattcagtccccagctttaggcatactccccacataccagccatctctacgtggatggcttaaaggcatctcaagcttgacatgtcccagactggattctcggttccccatcctgtctcctgtgaccatatgcatctatcatagtcattatataaataaagggcaactttgttctggttttttaggttaaaatttttgtagtcctctgggtgtggtggtacatgcccgtagtaccagctactggggagactgaggtgggaggattacttgagcccaggagttcgaggctagcctgggcaaaataacgagaacctgtctcaaaaaaaaaatctttgatttttctctttttcttatatcccccatcatgtccatcagtaaatcctgtggctctgcttttaaaatatatttacaatccatttcttacctcatccactcctaaccaacctcctccaagctttcttcatctagtttggactgcagtggaagccagcttgcctgcctgcctgtttccatccttgctcaccaacagtctattctcaacacagcagctagcacgagcctttaaaaatgttatgtcctatcactcctctgctcagacactcagaaactcgtttcattcaaaagtgaaacccaaagtcctttctctggcccatggctacacaagattccacattacttgcctccctccacctccaacaatctcttggacctcttctaccattccatctcttcctcacttagctttagccaacttagctccttgtcatggcttgtctgcatcaagcacagccctgcctcaaaatcttctgcttgcatgggcaattctatcctggatatctctacagcttgctcactcactttctttagatttctacacagatgtctttccctggccactctttctaaaggagaactgtctgacaaagtttccaggaaaatacaatggagaaaggaaagttcagtaaatggtgttggtaaaactgaatatccccatgcagaaggatgaaattagattatatctctcaccatatacaaatatcaactcaaaatggctcaaagacttaaatgtaaaacctgaaactataaaactaatagaagaaaacataggggaaaagctttatgacattggtctgggcagtgatttttcaacatgacctcaaaaacccaagtaacagaagcaaaactagacaaatagggttatatcaaactaacaaacttctgtgcagaagaggaaacaattgacacaatgaagtgacaacatgaagaatggaagaaaatatttgtaaactgtacatggataaagggttaatatctaaaatatataaggaactcaaataactcaatagcaagaaaaaaataacctgatcaaaaaataggcaaatgcctgagtaggtatttatcacaaaaagatatacaaatggccaacaagtatatggaaattgctcaacatcactaatcatcagggaaatgcaaatcaaaaccacaaggcagtatcgcctcgctcctgttagaatagttattaggaaaaagacaaaagataacaggtgttggagaggatgtggagaaaagggaacccttgcacactgttgatggcaatgtaaattagtatagccattatggaaaacagcatggaggtttctcaaaatatcaaagatagatctatatgatcagtaattccaccactaggtatatatctgaaggaaatgaaacaaatatgttgaagagatgcgtgcactcccatgtttatttttttttctatttgtttcctagaacttttttttttaatactttaagttctagggtacatgtgcacaacgtgcaggtttgttacataggtgtacatgtgccatgttggtttgctgcacccatcaactcgtcatttacgttaggtatttctcctaatgctatccctccttcagcctcctgccccctgataggccccagtgtgtgatgttccctgccctgtgtccaagtgatctccttgttcagttcccacctatgagtgagaacatgtggtgtttggttttctgtctttgtgatagtttgctgagaatgatggtttccagcttcatccatgtccctgcaaaggacatgaactcatccttttttatggctgcatagtattccatggtgtatgtggtgcactcccatgtttattgaagcactactcataatagccaaggcagggaatcaatggataaagaaaatgtgttatatctatataatggaatggtattcagccataaaaaagaataaagtcctgtcatttgcaacagcgtgggtgaactaaagcatattttggtaagtgaaataagccaggcatagaaaggcaaatactgcatgatcttactcatgtggaatctaaaaaagttgatttcatagaagtagaaagtagaatggtggttcccagaggctgggatggttgtggggctgggaggagttggggagatgttagctaaaggataaaaccatcacaggaagaataagttcaagagatctattgtgcagcatggtgattatagttgatgatgatataccatattcttgaaaaatgctaagagtggacattaaatgttctcatcacaaaaataattatgtgagataatgcatatattagctagatttaacattagtacatatattagctaggtattcaaaacatcatgtacacaataaacacatataattttatgtcaattttaaaaataaatttggaaaaaaaagaactgtcttccttgcccatcactttcctttgtctgaccctgtttctcagtttttcttcattctcatccctagtatgtattactgtgtttattgtctaatttcctcctaggaggcaaacttcttgaggcagggactttgttttgctcattgccgtatttccagcacctagactagtgctgggcacacagttagccctaagtaaatacttattaaatgaatgaataagtcctgcagagccaagcagaagccatcaaaatcaaagtctttttttaaaagataaaattttgggaaactgacaaaatataaaaactcgctacaattacagtcagaagattcaggtgtgagttctgtttctgctacttctaaatggtgtgacaataactctacaagattcccagaattctgtctctttcatgctaagtgttgtttgtgcatcaatatccccatttggtgtatgtcttgtaaaatgcatggcattttctatgcttaggatggggtatcttgtcattgatatttactcagatttctcacatttggggggcccccaaattgctaatctctttgcatagacacactgaaattgggtcaattattaactctcagtctgttaggataccttgtgaattttaatacatataccagtggcttgagtatacctcacaaagctagaataaatcacatcactatatcatgttagaaaaaagatttcatggccaggtgcagtggctcacgcctgtaatccctacactttgggagggtgaggtgggtgaatcacttgaggtcaggagttcgagaccagcctggccaacatggtgaaaccctgtctctactactaataaaaaaaattagcagggtgtggtggtgtgcacctgtaatcccagcttctcgggaggctgaggcaggagaatcacttgaacccaggaggtggaggctgcagtgagccgagatcatgccactgcactccagcctggacgacagagcgagaacccgtctcaaaaaaaaaaaaagatttcacctgatcacctgatgacgtgacatgatcaatagttatatatccttgatgtgcaggtcagggtatagacagcacataaggaatagcaagggcagaatgtctaccacatgtttgaccacaaaccattttttaattcctggacacacaagaacgtgtactacctttcccagtctcttatgaccagtgggaactagaactgagttctggccaattgaatgtggcagaaagtgaggtacaccaccccttcctgggctggctcctaaagcctcttgcatgacactttgcacttttggtcttattttagctgtgagttagagagaggacccagagagggatgcgaaggtcctagggcatgaatcttcaccagaagaaagcctggttccctgagccactgcatggaggggaggtgctcaggagatctgccattcaggaacacatgcactgcaacttatgtgagtgagaaataaacttttattaagtcgctaagacttcatggtgtatttgttaatacagtagccagtatgtcatgtcattcacaactcatgctgtggatttgtgacttagtttgctctgtcatatatgcttttttgctgctgacttcaaatggaaagttggattatataataattgaatgtggaatatccactttgattttctcctaatctccctggatacaaatcttttcaaatacctggtgcttttctctctcagtaacgtttctatattagatctttatcagtgatagctattctctttcatagcttaaatctgttttgataacttcttaagtcttttgttgttgtggtcatggtggtttttaaattgtaagtgattctttatctttggccaggtatggtagctcatgcctgtaatcccagcactttgggaggctgaggaaggtggactgcttgagctaaggagttcaagaccaacctgagcaacatgttgtaatgttacaaaaaatacaaaaattagccaggcatggtgccatatgcctgtggtcccagctacttgaaaggctgaggtggggggatcgcttgagcccaggaggtcaaggcagcagtgaactgtgattgtgccactgcattccagcctgggtgacagagtgagaccctgtctcaaaataaataaataaatataaggtatcttttatagcattacctaactagctgcttaagtatttctccaaacaagtagcaacatgaaacaacctctaaaatatttgggggtaaaggaacatgatatatgcaacctaccctcaaatggttcagatacacacacacacacacacacacacacacacacacacacacacacactctctctctctctctcttataaaacaaatggggcaaaatgttaatagcaatgtgggtaaaccgtatatggtgttatgtatattatacttgcacattttttctgtaaattcaaagcaacttgtgaatattttttagaaaaaagtattagcactgttatattaatacttctagctttacttttaatgttttatctgtgcagtttaaaaatcgtggtacagtagttttctctattatgctttttaaaattttaaagcaaaaacacaattctctgggttcttaattttctgcttttcactcaaagctatgatatagtctatgatacctcttaaatactctgaattctctttgaatgtaaaaaaaagatgtgtattatccatactagttaatatattgtcagcataagagaatatactgatctagtgaaaactttgggggatcatgttttatagaactaggaagaaaagttttcaaaaacgggtcaactgaaattaacaggaagctcacaaattaagcagaagactttgttgcattttaatataaatatgaataaaatatataataaggcttgattatggcaatcactctgggtttgtcatattccagaccccaaacaacagtgtccttgagcaaagtgtaattattccctcctctacactaggctgggcatcagccaataaattatttataaataaattagtatgtttcttgagccattaaaatagaaaaactaccagccaacctaattaagaaaaagcactaataagaaataagggccaggcatggtggctcacacctggaatcacagcacttttggaggccaagatgggaggatcgcttgaggccaggagtttgagaccagcctggtcaacatagcaagacctcatctctatttaaattaaaaaaaaaaaaaaaaaaaaaaaaaagaaaaagaaatgggagtaatagaactactctcaggtaaagtggaaactggaagaaaaatggagaatatttgattttaattctatttaaatacttttgaaaacctgaataaaagagacaatttgtaggataacatgcattgtaaaaactgagccctggcaagacagaaactctaaaaaaaattaattactatggaagaaattgaaaagttctaaaagggtacccttcctcccaccaaaccaaaccaaattaaacaaaaaacaaaacctaacacaccagaactagataattgcaaagatgtatattatatctgcaaggaatagataactttgaagataattaaattatttctcagcagagaaagtatattgattgcttttaagacatcagcataactttaatagtaaaatgtgatggtaaaaaatataacaaaaaggaaattttaggccaatgtcatttaaagttgatgcaaaattatatgtaaacaaatagaatttaggagtgtattataagcataatatgattgaacatagtttattccaggaatgaaaggatagcttaatgctaatgagtcccttaatgcaactcatcatagtgataagtcaaaggagaaaataataatcatctccaaagatggcaaaaaaaaaagctttgtataaaatttattacccatttttgatgcagattctgaatgaaatgggaattgaggggtatttccttagcatggcaaatattaatcttaaatggaaggccagtattgtatttaagagtgtaaaatgagactttccatttaagtcaggaaatggatagaaatttccataatcctcactattaacagtgacatgtatataataacacaaatcaaaggtatgcaaataagaaaggaggaggcaaagcgattgttatttgtaggtggtacgcgtgtatgcccccaaatacaacaccatgaaatgaactgaaaaaattacgagaaacactaagataactcagtaaaggagctgggcagaagatagatattcaaggataaaactccagggggataggagatataaatgtaaaaaacaaactaaggacatatttatgttatttattttttggtctgtctctaataatatcaattccatgaggaaaaggacatgattggctttgtttattgctttatctctagtgctaaaaaagcgcctagcacattgtgggcattcaaaaagtatttgttgaaactgagaaaggggcaagatggccaactagaaacccttagcacttgtccctaccccacaaggacagtccaaacaacagataagtaattacattttgatgaaaataactaaaggagagcactagtgcacatcaaaggagtggcagaaaccctgtagagcacagaaatctaggatggccccagagaggatggaaggaaacccctggcctccaccacctcacctcccagctgggctcagctcagaaccaggagggacttctccctgtgaggaaaaggtaagcaggtggaccccagcatccccccatcaacaccttggacacctgcagtcctcaccactggggactcctgcagtcctcacagacactgaacccagctgaaggaggtgtcaggagtccacacagccatgctccctccagaaaagaagccgacacggtgccttgccccctgtgacccacacggctactgtgctttgccatcttggaatcagaactactgctaggttatgtcctgctctcggggtgagtggccatggcaccctcccatgcctaagggcttagccaccatggagccacccctgttcagtggttcaccatccctgagcggagctgctaccataccctaccctgtgaggccaagctgctgtagagctgctctatctacccctcccagtggttgctgcatcttgtcaatcagggcccaaaataaagctgtgcactgcctcccaaggaaacagtggattaacaacacagcttcatctacacctcccagtaactgctacatccagctcccccatgtctgagctgaaatagtgcccagcatcctggggaaacagtgtcttggctgtccagaggagtcatgtcccaccagtgcctgagttgaagatgtgccctgcctcctgggaaatgatgtcttggccactgagagcagtcacacctcctgggactgagctgaagcagcacattgcctccaaaggaattagtgccctggtgaagctgagcagccatgcatccctgggctgagctgatagaaaccctgcatcccagagaaacagcattggttgggctgagacaccctggcccgcacgcaaaacaactagtaccctccttccctggagtcaaaccagccccttagagtctgagctgctgagacaaacccttcactggggagtaaagtcatctctgtgctgctccctgtcccaccagagcctaagcaattgctgcactctgctattctagggttctggctgctgcacctgaccaagtctgggatgctgctgtgttccaccacctcagggtccaaagtcaccactaaatagtgtctcatcccccacgatctgacttgacgctatgtcgtattggctctggttcacaaattgcagctgtatcctgctcaccaggcccaaatctccatagcaccccttcttttctggagccaggccagtgccgtgccctgccctcagggtcagagacatagctacaagctggccccctgggcctaagctcctggaggttgcctcagagtcacagatcctggctctgtgggcaatctctatccaactctgcctcagagagtaaacctatagcacaagacccagttgttacaataggttggcaagatcttgaaccccggacctcagtttcacagctgctctgacacctgtgtcctggagcccagtgctgctgcagctgcatatgctgcagctgcatattgaccatgttagacccaacaccaagagggattcattcagctaagtctgcccattgtggagaaaacatgatcaggacagtctcaaaactcttgccaccaagaaccccagcaatctatgctgccactgctgttgccacaaactcctatagcctaggctgctgagacatcatcgcaaatgttaattgcagctgaagaatctgtgcaaagactataccactgaatatacttggaaccagccactacatctttttcagccggcatactaagacttgtttggaggtgaaaatatgaccctaccaaaggaacacaataactctgtaactaacctccagaaaaagggaaatttataaattgtctgaaaaggaattaaaaataatgggctttaagcaaactcagtgagatacaagagaatacagatagacagttgaaaaaaatcagagaaacagttcatgatctcaaagagaaatttaacaaagagatggatatctaaaaaagaaccaatagaaatcttggagctgaagaatttcatgaatgaaattaaaaacatacaatacagagcttcagtagcagactagattaagcagaagaaagaatctctgaacttgaagatagatctagatcttttgaaattacccaatcagaggggaaaacaaaaacaaaaacccaaaacaataaaaaagtgaaaacagcctatgggagtcctgggataccattaaatgagaaaacatttgtattatgagagtttcagaaaaagaagtgacaaagatagggacagaaagcttatctgtaattataaaatagttggtgaaaacttcccaagtcttggaagagataaaaacatccagattaatgaagcttacaggttcccaaacaaactcaacctagagaggtcctcactgagacaaagtgcaattaaatggtcaaaagtcaaaagaaaaagtaagaatttaaaaagcagcaatgagaaaaatgtcaagtcatacacaagggaactaccattagactatgaacagatgtctcagcagaaaccctggagtctaagaaagaaggggatgatattgaaagtgctgaaagtctttcctgaacaagcaaaagttgagggaaatcattcccctacatctgccttacatcaaatgcttaagggagttcttcaagtagaaatgaaagcatatgaaagtacaacattcactgataagggcaaatatatcaaatccagaataattcaatactgttatgttgctctgtaaatcatagatatctctactatgaaccattaacaaaacatcagtagtaagtccttatctatcaataaatactttgaatgtaaatggattgaaatctccaatcaaaagacacagatttgctgaatagtttaaaaaacaagatccaactatatgctgcttacaagagactcacattaaccttaaggacacacagaggctgaaaataaagggatagaagaagatattccaggcaaacagtaaacaaaagagtaggagtggctatacttagataaaatagattcattggggaaagcatagctttataaatggtgctgtgaaaattggaaataaaactagacttctgtctctctcaaaaatcaaatcaaaatgcattaaaaacttaaacgtaagatccaaaactataaaggtactatagtaaaacatgtggagatacttcatgatattggcttggacaatggttttttggatatgcctcaaaagcacaggcaataaaaaagcagacaaatgggattacatccaattaaaaagattccatactgaaaaagaacaatcaacaacctccaaaataggagaaaacctacaaaataggagaaaatatttgcaaactactcatctgacaagaagttaatatccaaaatatacaaggaactcaaacagcttaacagctaaaaaaaaataataaaaaaaaagtgcgaaagagctgagtagacattcctcaaaagacatacgaatggctaacagttatatgaaaaattgctcaccatcactaattatcagggaaatacaaatcaaaaccacagtgtgatatcacctcaatgtgttaagatagctattagcaaaaagacaaaagataacaagtgtcggcgaggatgtggagaaaagggaacccttgcacactgtggatggcaatgtaaattagtatagccattacagaaaacagtatggaagttcctcaaaatattaaaaatagaactactacatgatcagtaattctactgggtatatatctgaagaaaataaaatgaatatgtcacaaagttatcttcactcctatatttattgaagtactattcgcaatagccaagatatggagccaacccaagtgtccatcaatggatgaatggttaaagaaaatgtggtaaatctacacaatggaatactattcagccacaaaagagaatgaaatcctgtcatttgcaacaacatgaataaacctggaggacattacattaagtatgccaggcccagaaagacaaatactgcacgatctcacttatatgcagaatataaaagagttcatctcatagaaatagagaataaaatagtggatagcagtggctggggagggtagtgggaaggaggggtagggggaaattgtacaaaggatacgaagttactgttaggagaaaatagttcctgtgtcctattgcacattaggttgactatagttaccaataatgtatagtatatttcaaagtagatagaggattttgaatgttttcaccacaaagaaatgataaatgcttgaggtgatggatttacttaccctgatttgatacttatacagcatatacatgtgttgaaacatcatataccccataaatatgtataattattgtcaattaaaaatagacttaaaagatacactgtttttctaatagaaaaagcctgaaagcaacaatatccattagctttagtgggaatctgattaagtattaaaaacaagatgtatttctgaactaatatataaaaccctccaaaataaatgaatattaaaaaacagcaaggcactaggacatatacaactgtaatgtactcaacaggaccaaaatcatacaaaacatgttctcttcgacaatgaaattattagaaatcaacaatagaaaaagatttgggaaattccaaatgttgggataatacacagttttctaagtaacctataggtcaaaaaagaaattacaagggaaataaatatcttagacggagtgaaaaagggaaacacaacatagtaaaatttatggaatttagctaaagaagtagttggagtgaaatttatagttttaagtgatttcgttagaaagaaatggaatcattaatcctctaagcttccacctcaagaagacagaaaaggaaaagtaaatcaaacacgaagtaagctggagagaaaaaactattaactaccagtgtgtaaaatgttgaaacggaaaacagaaaatcagcaatttcaaaagttagttcttaaaaaggaattacataaaattttattaaaaactttatgctaattcaacaacttagatgaattataaaaatttctagaaatacataaattaccaaaactgatttaagaagaaaacattaaatcaagaaaagaaatggaattaataactaaaaaccttcctacaaataaaagctcagactagatgacttcactggtgaattctatcagacttttaaggaagaaataatatcaatcctacacaaactgtttcagaagttagaggagagggaacactttcctactcattttatgaagccactattatcctgacaccaaagccagagaaatatatcacatgaaaagaaaacaacagaaaaatcttcccccaaacagattaaaaaatctttaacaaaatatgagcaaacaaaattcagcaacatacaaaaagagttatataccatgatcaagtagggttgttatcccaggaacattaaattagttcaataactaaaaatcgtgttatgtaatataccattattaataaaggacaaaaactaccagatcatcccaatagctgcagcaaaaacatttgataaaaaccaagacctattgattatttaaatttccagcaaaccaagaatagaagacaactttctcaacctgataaagggcatataaaaatcctgtcctaaaatcagatgtaatgatgcaagactaacagtttctaaaactggtaacaaggtagggatgtctgctcacctctcttgcactcaatattattctgggaagttcaagctagtgtaataaggcaaggaaaagaagtcaaaggcatacaaattggaaaggaagaagtaaaactgtctttattaccagatggtataataactacatagaatatattatggagtctacaaaaagcctccagacttaaagagtcagtttaataaaattgcagtgtacgaaataaaaaatgaaaaacaaatgcatttctatatattagcaataaacaacctgaaaagacataaaacaattccattgacaataacatcaacaagaataaaatagctagaaataaattgaacaaaagtacaagatctgtacattgaaaactacaaactgtttctgagagaaattaaagatccaaataagtgaagagatatactatctttatgaattaaaaggttcaatgttggcaattttccacaaatagctctatagatgcaatgaaacacccaaatctcagcaggccttttatgtaacaaaataattaaaaaggcaatcctaggccaggcacagtgactcattcctgtaatcccaactttggcgggtagaggcaggaggattgcgtgagcccaggagctctagacacccctgggaaacacagtgaggcttcatcactaaaagaaaatttaaaaagccaggtacagtggcatgtgcctgtagtcctacctactggagaagctgaggtgaaggatcacttgagcccaggagtttgaggctgcagtgagctatgattgcaccactgtactgtagcttatgcaacagagtgagaccctgtctattaaaaaaaaaaaaaaaaaaaggaacaatgcaatcctagaatgtctatggaaatgcaaaggacctagaatagccacattattttgaaaaagcagaaaaagttggaggactaacactctctggtttcaagacttaatagaaagctaaagtaacctagagggtgtggtagtagcacaagaatagacaaacagatcaatggaacagaatagggcatctagaaataaacctccacatttatgctaattcatttttgacaaaagtgtcaagggaattcaataaaaaattagctttttcaacaaatggtgctagaatgattggatgtacataagcaaaaaaaaaaaaaatgaagttaggcccttaattcacagtatacacaaaaattatcttgacatgtttacagacctaaataaaagagctaaaggtatacaatttttagaagaaaacacaagaaatctcaggtcaggcaaagatttcttagatataacaccaaaagaatgatccatataagaaaaaaaaaaacttgggccaggcacggtggctcacgcccgtaatcccagcacttcgggaggctgaggtgggtggatcacgaggtcaggatactgagaccatcctggctaacacagtgaaaccctgtctctaccaaaaatataaaaaattagccagatgtggtggcacgtgcctgtaatcccagctactcaggaggctgaggcaggagaattgcttgaacccaggaggtggaggttgcagtgagccaagatcgtgccactgcactccagcctgggcaacagagtgagactctgtctccaaaaaaaaaaaaaaaaaaacaatgggcagctattggaaaccttgtacaacagccattttagaaaacattctacttcttaacaatttaaatatatattcttcttacagctgagcaatactactcctaggtatctacccaagaaaaatgaaaacataagcaacacaaacatgtgtatccaaatgttcataacaacatgattcataaatgtcaaaaactgaaaacaactcaaatgtccatacactaatgaatggacaggaaaatggagtgtatctgtacaatggaatactatgcagccataaaagaaacaaacacttaaacctcaccgacataggtaactctcaccagcattaagctaagtaaaatattatatactgtatgattccatttatgaaaaaattatagaaagacaaaacgattcagaaagcatattagtggttacctggggtttgggagaattcgggatgatggatgttctaaggattatgatgattgttgcacaactatatcattttagcaacttactgagcatacacttacattggtgagtgttgtggtatgtaaattatatcacatggtgtatgtaaaacaccaaataacctaggtattttaaagtagcacacacttatcccatctatattaaacatactatatatattcatacacgtgctagtagaccataaactttctgtgactatacatacaaacaatatatttgcttctgggagaaaggactgaaagtctgggataggacagacaattactttcattttatacttgttgacattatttgctttaaaaaagttaaaccatgtacattattactttataaattaaaaactctagtaaataattaaaaacagccgaccacccatggtcctgatataaggacccaggcctgcgactcagctcttgagtctgcttatctcaaagaggtcataggcacttctggtagcccataataagataaagtgaatttcaccacataagcatggtgctagttcctattaatttcagagagatgagtataaattgtgggaattagggtaaactcaagaggttttcgactagaagtactttaagcatcacagcattctgcattttgctatgctaggcaaaaaacaaaaaccaattccctcatccccaaacacaaaccaaatgcaaagaccactttgattacttgtggagtaaatggggggcaaaggaaaagtgagaatggggtagccaagctgatagcaggcacacaacgaatattttcagaaaagtacaaattaccataatgtaaattagggatttcaaagtaccttttttctgctatgtcatgcttttagaagaagctgtatataaaaaatgcatccaaatttgtttctatgaatcatacagtggatactgcacagtgagtttgtgataccatttaatatcaagaacttggtccaaatatttgattttcatttggacactatgaagatatggctatttaattagcaatgtttattttaatcttaagcaatgcaagaaattaaaataccttgccaacatttaattatgagaattcaagtgctattttgtaacaatgccttgagaaggtcaaatttaagattgtttggctatcatatgaatttcccttttagtaccgggaacctaagactttgtagagtgctgctcacaaatgcctggtgtttgctgtccgtttccaaacaaggaatcaacaatgtgatacttccttgaaggaaaaacacctgcagacagggccaaataaatcataaaaggtgcttctttctttcagctttgacagccttcacttgcatttcaaactgagagtttcaggctgttttgagtgctttgaataggcaaccacatgtttgtcacacgtgtgtccttcatgcatgagttcctcattgtcctgttccttctgacccacccatgctgaagcttcgatgtttacactcgccagacatttagtgagcagatgttgggctacaacactaccactgggttaggtagtagtattatcccattgtaacagatgacatggctgaggctcattgactttcagtgtcctaagtccacaaattggcaaatgggaaaaccagggcttagcctgatccttttcctttacactcttttttcgagatagtatcctctttatctatggccccttccctcccttctctctctaggttcactggtcatccagagcaaagcagcagaggtgtggagaaggggccctgtgctttaccccattcccttccccacagaaaaggtagaggggaagaaacattcagggctcagagcttctaccacacttggcactgttcctatttccatactttgcccgggacactcaggccagaacttcagccctcaccctgttctgtaactttcttcccagatcatgggaggcactatgggtaattgttgctagtgcagttcctgtagtagcagaagtgtcctgaacagcatcattccaaactgtgaaaagatttttctacagcagcacagctcccacagctctcacagttcatggtccttctgagtattgtcaagactgtgcttgggcttagtaggggttgaactggcttccacctgctagcctggaaacctaagcacgattaaaagcgttgcttccatcgtaaaagcaggtttcttaattaaatcaatgggaaaccagtttgagttctccatgaccgatacatgaatgaatttttgaaacaaaatacattcatagttggggatttaatctttaccctccaactttctatcaatatgtctgtaagactgaaagaactattattattgtgtttaatacaaaatagaaaaagacatattctgaattcaaaaacaaagtttcctttaattcatgtttttctctctcactctttaagctttattttttaaagtataatttcattcaactccaaggaaatctgcattttaacaatattattaaatgatcctactattttacccacatattttattgctgagccagtgtttgtcttacctcctcgatggataatcaaagaagtttcacttccaatgggacagtccttaagtatatccactacttctgtatggctcaggttctgtacattctgctggttgatctcaacaatgaggtcgccttcacacaggccagggcatccctgaatgtcaagtatttgtttcacccgctgtcctgtaggactgtcggcaatagtgaagccgaagccctgggcacctttcacaatggttaaggtcataagttcagcttgggtggccccagatgaagccatagacacattgtcatcatggacgggcggtggatacgtgccgtctagctgaccatcagttggcatggagtgcagagaatgaggcggccgatctgttatatctggaactgactgtgaggtccgagaaatgtactccaaatatgtttcatagttgtgtcttccattgaccatcactggaggtggcctctccattattgcaaggggtggcaccatgctgttagcagggtcttcaggatcaaagggcaaagggtagccacgacacaacaccaggttgacactctgaccaataggaacagactggaaaagtttgacaacatctgcatgagtgtgtccaaggacacaaacttcattaatatagacaatgacatcacctgtaagaaaaaaagagattgacaacatgaggtaagttcaattaacattgacatagagaaatggaattatttacgagactagtgagaggtgttgtttcttagtaagcagtgagaaatcaattagaataatacttaaaatcactgtgggtgactcaaggttacaacaggactgccagcaaatacaatgatgaagtgctgaaaaaaagctatttggttattcttgaagttcagaaacaacttcatattcagaaacaaaggctctgaaagaaaaggttagaggaatgtgtaccttgaagaagcacattctctatgcttctttttcatcttatattccatcttcagtgtaattcagttaatataattttcgaactattgagaagtagtggtcatgagttttagacgaaaaacaaagccctagcatatttttttttgtataagttgaataagtcaattgccttttttcttttttatggaacagaaaaatatttgcccatttatttttttccatctatagcaggtaattacaaagcttccatgtatatgcgagcaaaggtcaagggtgcaggttttgggattagggagctgggttgacaccttggctctactatttaacagatacatgatattgaccaagttccctgctttgagccacagttcctcatttgtaaagttgtgagaatgaaatgacataatgtaggaaaagtacttggcatagtgtatgacacacagtgctcaataaatgtggactattattaatatgattgttgttaaaataggatggaggagatttgggtcccttggtttcaaacagaaagttgccacagttcatcctctgatcttagataaactaatatttctgtggatcagtttcaataaaggcacttgtcctttctccccagtgaactatcacagattttcagaggtctactggttagaggctaactttatgattagaaatgctctgaatgcaaattatccattataaaatatattcagagaaatattttttcctgcttaaaatgcagaaaatcatggctgtttgagataaatgtttttttaaaaatttcaattatgtatgaataacaattttatttttggagaactattttatcatggattggtatttttatcttcacaaaccataatacttgaaaattgagcttgcaaattgagattgtgcctgactatgctgaggagtatattagggatgaagagacatgttttcacagatcttgaaataagcaactcaacagacatcagtttatcagaataattctggaatgggaggtacaaatggctagggatttcattctgagacatccttgcccagcaagcttgcaaacgttaaaaatgaaaaacagagttgaacttttagagttgacaacttttctggtcttttgtaggtgtataacataaaatgaataaaacaattaacagcattgtcttaattaacagtccctcttcccaaattgacagagaggccaagcagacattttcagggatccaggttaggtctgcctctagaaaatgtcacaacctatgtgattggtcagatggaacttcacttttccataatgtctatcagagagggtactgatgtggtggctggaacgtgggtccacggctcagaactgaattggagtggacattccctcactgttattataattcctcttcagactgtggcagctggggatgctttgggaatcgtttttaattgattccattcatctcagtgtcccagagaagtgtctgattcagatagactatttttctctcctgtttcttttagttttaatgttatattttctacatttaaaaggttgaaagaacaacaaatacttgtatactaacatccaacttaatgattggaacattgctcatattagttgaatcccccttggctagcacctctcccccaacttgcactcctttacagccctttccaaggtaaccattgccctatttgaggtttgttatttacatatacctttataatttatatcatatctaggtgtccgtaaaaacaatatctctaaatagtatctaatctctaaataataataatccctggaaagtattttacatattttaagccttttgtaaatggtatatattttaatattctgtaacttttcttaaaatatgtttgtgatatttatctattttgatacttgtgcctctagttgattagttttcattgtaatacagtatttagtgatggctatattactacttaataacattcatccattcttttgttaatggacaccggagttatgacaaatctgtggctattgaaaataactctgctatgaaccccatgctggcacagaccatgtgcatcttcaactttgttagatagtggcaaatggctgacaaaagaggtcacattgatttacactctgatcggtagtgtgttgaaattttcattgctttacatctgacacagtacttcgtattctcagacttaatttttaccaatctaatggatgtgatcatagttttgatttgcatttcccagactgccagtgaaggtgagcatcttttcatgtttattggccttttggattttctcttgggtatgcctcatttcctcaatttcctattcagtgagttttttttaactcattgactattttttatgtctactttcattcttgctccaacattcttcttaggttcaggaggctgcaaggtatagtagagatcacatgggatatgaggtcaaaagactttggtctgagttctagtttcatcacttattagctgtataactttcccaaactggcttcaatcctctgtgactcagattttttagaagtaatgatgaacaatagtaatagcaacttattgttccatgggaaataacgaatgagatcatacaggtgaaagggtttctaagctgtaaattgttatgcaaaagatgattgctatttcagtaattactctttgtcctttgttatattcttctataaaatcaggacagttctacccagatattcccaccacagttacagtcaaggatgacttgagtatgattgtggaaacaatgggtttctgaatggccaagtaaaagtcagagaggtaacaaatgccacttcctctaaggctctccctaactttaatcactgttaacagactccccagtccccaagcacgctctctccttccctctgctctgccagaatttcacgggaaagaactaagggttatgttgaaagctctcaagtttccctgccaggtctagagagtagtagtttgaattgtagtgattaatgttacctatttttgagttttaatgtgatcttgctatttagaaacagagtgagaactatttgtgtttcttagtaagactgccttttacaatttatggatattttccactaacagcaatttttcaagtcatcaggcaaggataaagaacactgcaacaatatctttatgaagatacgtagaagatttctgaatgtaaaagatgagtggtcagttatcacaggataaaactatataacaacttgatggtactcaactgcccactttaaaaaaatatatagatgtctagataataagtcatgcccaaaactcttatagacggggatgtcagcaaacatttgcttgttcagatagaacttattggatagaatattaatagactgtgctgtatgaatgtcatttacatgtcgtgaaataaaaatataagacacctggtatatgtcatctgacggtgccatgccaagtcctcagacagattgggtttaagagcacagaaagggacatcatcaggaagactggctctggctctaacctgttggcctacttaagacggagaattggaagagtcacttgatctccccatctctcaatttcttcttttataaaatgggaataaaaatatctcttacatttcctcttttgcagagctactgtgaaaatgagatcatccttgtgaaaatacttataattttatcaaattttttctccataaaaataagaagatacatttcttttgaaagctaagcatatattttcattactacattgctggaaaatttactttgtttgctaaatggtcattcacttcaggccatatttaggttagttctagggctactgacctcaggcctgttggtcagattgagtgtgagtgatgagttaggtgtcccacaggtctggtctcacactaacctgattgccaattatggaatttcaaagtgcaagtgaggtagagtgagtttgatgaagcaggagctttaaaactgctgtcctgtatgaaaaaaatgttctaagataattttttctttcttagtcatgggaatcaaaatacagaataggatacctcatcattttggataaaatagggcactctacataaagcattgctttaattagagttatttttatacctctttcctctacccccgcattctttgagtcactgtggcctacagaatcttccttttcaacatctctcacttaccactccctgtctgccttccttaaacacaaccttggaccagactagaataatttacttcctagtcaattctcatcttacagtctactccattaagttcaaactacttgatctcttgatcagctgtttaagtctttccaacttatctttgtcttcaccaccaaataagttattattgtgaagctggtatctttactactcacaacttacaacttgttacttgcctctagttaaattctgctatccctttaccctcaagagcacttcctttctatgtatggaatcatgcctaccaattcatttccttcctcacctcttcaaaggtatcttccatcactcttcctgacattgctcctatctcatgtctgaggcttgcaaatgcatctcagactttgttcctttgtgtgagttctacccgttccaagatttctctacactatatacagagcatcattactatgttgagaattcttcagatatttaggatagattctcactgaataaaggatggaaagatttagtcagaggaaaccagaaaagatttcacagctaaatgtactacctccagtttagtgtttctaacttctgtttttgccaggttatccagattttcgataaaagaaaaataaaaaaacctgacaactcccatcctaccaattacatgcactctacattaaaaaggattatttttaaagtttcctctcggttaataagatttgactgagctttattttctgcagcttatattaatttgtgttttaaatcataatacataattttattataatattgtacatctattctgagtctactcaacccccacaaacataataaattctgacatgtacttttgggggtgtgctactcaccacatcagttaaatggaaaataactgctctcaacacagtttattccccaaagtgaaacactgtggtatgtcataccagtagagttgaagttgggtctcccttaaaataatttgaagcagtttctaaaaattcccagatggtctccttagagtgacagttataaaaacagccatcaattggagaagaattcaattttggaggttctggatcttaccatggttctactgactttacacatcagtcttgcaggtagcattattatatatacccatcaaattatgtattaatagaaatgcaaaaacagatacttaggcatgaaaggtgtaacagatgataaaaaattccttcgttagaagaatctttttgtttattcttatgtgttactttataaatgacactgtgaataaaaattaggttcagacaacgtctttctcaataattttctatgtattatgagcccaaatgtggcttaatggctgcaaaacactagatattgccttctatctgcttcgctgtcaactcatcttccataccatacactctgttgtccttttcacctaacatcctttagtgcccactcatagagacagagctcagtccaaactttctagcatgacatatgaggctctcagagcactgacttagaagtcagggggtttatgttgttaggccaggtatgccaataactagtggtatcaacacttcctaggtcttattcctcacttattcattaatttattcagcaaagatttacacatattcaactactatgagccgggcatcatgttataaaaagagaggattgaaccagatgatcttgaaagtatcttcactttaaaattctaagacaaaggcccttagattctagctcttggataacttttattttttaaaatttcaacttttaaatttcagattcagaggatacatgcgtaggtttgttacatgggtatactgctcaaggctgaggtttggagtatgactgatcccatcgcccaggtagtaagcatagtgcccaatagggaggttttttcagtccttactcccgtctctccctcctctgtctagtagtccccagtgtctatcgttgccatctttatgtccatgaatatccagcatttagctcccacttataagtgagaacatgtaatatttgattttctgttcttgtgttaactcagttagggttacagtctctagctgcattcatgttgctgtaaagagcattttttatgtctgtgtagtattccatggcattatatgtaccacattttctttatccaatccaccattggtaggcacctagattgattccatgcctttgctattgtgaagagcactgcaatgaacatatgagtgcatgtgtctttttggcagaacgatttattttcttttggatatatacccagtaatgggatttagacagcttttcaactggttccttgctttcttttttctactactactacccaagatgagattcttaccatctattgtatgaacttctgcaatagtctcttagctgggctccctgatgtcacagagggaatgactagggaaatagcaaagagaagcccaacatatggcatgaccaagtgagcttgtggggtaatggggttctaaagtctcaccccattttgacctctaggaatacataagacattgctaaatctccacttctggtcgggattggctcaagaatcaggagggtgtgaatagtcttcatattctccatatccagcggctgcaaagcactagatactgccttctacctgcttccctgtcagctcatctcccataccatacactctaatgcccttttcacttaacatcctttagtgcctgctgacagggacagagttcagtccaaactttctagcatgacatacgaggctctcagttcacattttcattgtctcctgctttttccaacctactctatgcttcagttggccccagctttaggacatgcccccaacactatattttctttccagtctctgtgctcttgtttctccttctctccttgctttgtccccactaacaagctgctcgttaccctttaaggccagcctcaccttttaaaccacctttctgaccgcctcctttagctgaatgttaattacttcttcctgtgtgttactcttcctgatagcgtgattcttcaatccatttaaccacactaacagcattgactaccattttaatatacttaatatttatctggcatttacaaactccatcttacctaatccttacaaaacccatataagatagccattgttatctgtacttgatacatgggaaactgaacctagaagaagttaagtcacttctctaaagtcacattgataattaggttagattgaggaagtgaatccaagacttcaacacaaatgctaagaatttcaagcagcccaggatgtattttgagttgaggactcttttgtgtccctcagcttattatcggtcagaatgctgggtaaaatatctttaattcctgaaggtgaaaattgagagatgaactgcaatattcttttgattagctaagttaatggaggcatgcagtgaagcagataattgcaaacaggggaatcggggaatccactgtatttgctaggtccattttctgcagtcctccaaaataagctgcttggaagagagctaggagaatgctgaggtgggaggtgacagggcattataactcacagaacttataaccatcacaaaacataagctctagtataaattgtttcaatagctgtgtgatcttgggcgaagtatttaacttttcttggtctactttattttcacgtaaaatgcagaagtcagaaaagacaacttctaaggtgcagctttaagagttcctacatctgatgaaaatgtggaaagctgtcctactgaattcatataaggcactgggaaatttcagtggtgcagttaaacaggtaagtgataagcctatcggggcttaccttgaacttctctgattttctacaaaagtagccagtgactccaacactcttatctataggcagaaggatactaagatactggagtagccacttatttctcaaaagaatgaaaggcttcttaatcacattttataatttcatctgtgtgacccagtgcagatgcttaattaaaagcttgttttttttttttaaattatgattaagcagcacacatccaacaattactccctaccagatgtgaattagtccaacgatgtatttacatttcctttgtgtttggcattgagtggtaagatatatttaaatacttgcattttactttgttgaaaaggaaacagaaaatacattctaagagaatctaaagcactgattatttgctgatctggcaaagatgaaacaacacttcagattaaaaactataagtaaagccacaaaaaagaaagcacaaaagactgtttcttgcaaagctccaaaaagcactggctttctaaatagcttgctcacgttgggaattcaatagcataaaatggtcaatgaatctgtcatttctctaaagaatgtagtgaattttaaacaaaaagtagcaaacattttatcagaggggttgtataagataaaaataggttactagaaaagaacccaaaagattttcaagaagaaatcttaaaaccctaaaagtttatgaaagcaagataaaaatgtagcattcccctgtactcttctgtgggttatggacacacctgtggactcaaccacatattaaccgcccccaacccccactccaaaaaccaaaactctagttacaaaaataccttgcaggaaagagtcataattttatgtggacattgaacaacatgcatgcttattttcaaacagctgtaattgtattcctgaacaagcatgattcgtttttgcagaaatggctcctagaggccagcatggcatgacctgtcgccatcttttgaccttactccaacatagcgtagcaagtagctatcaaacctcccctgaaatgaagggactgctggctggggtggagctgggaactgtctctggtcacactttccaacagtttattctactctacccgcaactgtcaatagcctgcagttctgactgagcaagaaaaaggaataacaaggagagagagtgagagggatgaaaaaaggatggatgcatccatttcatttcaaactgctacctcccgccaaatggttgaaggtttttgtaattgtgtgtgtatgtgtgtgtttactacctgacctaggcacgtacacacacttttaagacacgtagagcagtgtttttatgtttatttgagacaaggtttccctgtcacccaggctaaagtgtagtggcactatcccggctcactgcagtcttgaccttcagggttcaactgatcctcccacctcagctccccgaggagctggggctacaggctcatgccaccatgtctggctaatttttgtatattttggtagagatgggagttttgtcatgttgcccaggctggtcttgaactcctggactcaagcaatctgcccaccttggcctcccaaaattgtgcgattgcagtcgtgagccaacacactcagccagagcagtgtttttagccagaggaaagtagaatttagtttctgataccatgaaattgacgtagaagagggggaaaaaatccctttttttttttgagacagagtcttgctctgtcacccaggctggagtgcagtggcatgatctcagcttactgcaacctccacctcccgggttcaagcaattctcctgtctcagcctcccgagtagctgggactacaggatcacgccactacaccaggctaatttttttgtatttttagtagagacggggtttcaccatgatggccaggctggtctcgtgacctcgtgatccgcccaccttggcctcctaaagtgctgggattacaggtgtgagccaccatgcctggccaaaaaaccctcttttatgactccaactgcagacaaccttctgagaagttgctttcttgaattgcttttgaaaaaaggtactgtttgctgcattgtgagctggttgctagtcctgaatacccacactgggtgttgcaggatgtctactggtggagctgcttggtcggagaagtgctcaaccctaggtctctatcaacctacatggtaattctgggaagtgttctgactagtgcttcaattgcaagccagtcaacatgccttaactggtagtataacatattctattatgttgatctactctttcactcccttcatttgtgagaaattacagggcccctgctgccttgctgaaatgagggctgccagaatatttctcccatatggatttcagaagtgctgcagcattaagttgctgagcttcataaaatggctggcagaaagaacaaatgtgccatgctaaaaatgtgactgtatattgcatgcacatgggtccagggtttgacgagagagcccttctaacttgttaaaagggaaatagacttggcagatgtgaatcttcattgacagactttgattgttcaaacttggacccttttatttccaatttcagtttcagaaagagcaatattttatacaagtatcaaggagtcagcctgttcattgggccatatacaccaaggattgccaattaaaactccctcaaacacatggcaaaaaggaagaacaaaatttgtcttggcttcactgaaattttggaatccagagaaagatagttattatctctctgatttatgtgaagagaaagggaaagcaatatggtaccttattttatcagacatctactactttctccatagggcatatacccaccactaccctctccgtgttagacactgcacacagattcttaaggggatgaataacctagcctaggggtttcagggaaatataaagcaatttcactgcagacaatggaagattattttattctcagacacaacagacaaatggcacggaggaaaacaatctaatcccctgctgtttccaatgttacaattattatatgatactgaagctgactgggataagttagcagagaatcatcaccaaagattttaagttgccccctccctctgtacgactattgaacatgtatctacgtaaatatacatgtagataggtccacatgtttgtatgttaatttgttcacttctgtgttatactttccattccagcaaaataaggttaacaacagagtcagaaacaatgaaaatttcttgctttttaaactaaatctagtatgagttttataattatagcactagcactttattttatatcaagttccttcaaattattgtacaatgcaaaaatcttaaccatgtggtggcatattaattgaaaagcaaaattttggatattttaaatttgatatttttggtataggtaatgcaaaacagctaattaaatcctttctactgaataaatatattgttggagatcagggagaaatggctaataataactatagctactactatgtgctaagaacaataaccgtatgccaagaagtcagtcaagcattccagagacttcattttattttaatccttgaagtagcgtgatgaagaatatagtgtccccattacatagaagaggcaattgtggcttagaggagtcaagtccaacaattataaatgactgagctgccatacccctagtgggtttggggttacattcagacttgtcttccaactatgtggatgtttgtttatataagcttataaaatttcaaggttcatttcatctatttatttggcatttcttaagacaggctaaaattaatcacttcaaattttgtgtatctaatttacatttgactgcttgaactgaaaagtattacataatgtaaacatagattattttttattatactttaagttctggggtacatgtgcagaatgtgcaggtttgttacataggtatacacgtgccatggtggtttgctgtacccttcaacccatcatctacattaggtatttctcctaatgctatccctcaaccagccccccacccactgacaagccccggtgtgtgatgttcccctccctatgtccatgtgctctcattgttcacctcacacttatgagtgagaacatgtggtgtttcgttttctgttcttgtgttaatttgctgagaatgatgttttctagttcatccacgtccctgcaaaggacatgaactcactcttttataatggctgcatagtattctatggtgtatatatgccacattttctttatccagtctatcactgatgggcatttgggttggttccaagtctttgctattgtgaacagtgccacaataaacatatttgtgcatgagtccttatagtagaatgatatatgatcctttggatatacaaccagtaatgggattgttgagtcaaatggtatttctagttctagatccttgagggattgccacactgtcttccacaatagttgaactaattaaactcccaccaacagtgtaaaagcattcatgttctccacatcctctccagcatctgttgtttactaactttttaatgattgccattctaactggcatgagatagtatctcatggtggttttgatttgcatttctctaatgaccagtgatgatgagcttttttttcatgtttgttggctgcataaatgtcttcttttgagaagtggctattcatatccttcgcccactttttgatggggttgtttgatttttcttacacatttgtttaagtctggatattagccctttgtcagatggatagattgcaaaaattttctcccattctttaggttgcctgttcaccctgatgatagttccttttgctgtgcagaaggcctttaattagatcccatttgtcaattttggcttttgttgccattgcttttggtgttttagtcataaagtctttgcccatgactatgtcctgaatggtattgcctaggttttcttctagggtttctatggttttaggtctaacatttaagtctttaatccatcttgaattaatttttgtataaggtgtaaggaaggggtccagtttcagctttctgcatatggctagccagttttcccaacaccatttattaaatagggaatcctttccccattgcttgtttttgtcaggtttgtcagagatcaaatgctggtagatatgtggtggtatttctggggcctctgttctgttccattggtctatgtatctgttttggtaccagtaccatgctgtttgtgttaatgtagccttgtagtatagtttgaagtctgatagcatgatgtctccagttttgttctttttgcttaggattgtcttggctgtgagggctcttttttgattctgtatgaaatttgaagtagttttttccaattctgtgaagaaagtcaatggtagcttgatggggatagcattgagtctataaattatcttgggcagtatggccattttcatgatattgattcttcctatccatgagcatggaatatttttccatttgtgtcctctctgatttccttgagcagtggtttgtagttcttcttgaagaggtccttcacatcccttgtaagttgtattcctaggtattttattatctttgtagcaattgtgaatgggatttcactcatgacttggctctctgtttgtctgttattggtgtataggaatgcttgtgatttttgcacattgattttgtatcctgagactttgctgaagttgcctatcagcttaaggagatttggggctgagacgatggggttttctaaataatgggagacgttaacaccccactgtcaacattagacagaccaacgagacagaaaattaacaaagatatccaggacttgaactcagctctggaccaagcagacctaatagacatctacagaactctctgcctgaaatcaacagaatgtccattcttctcagcaacacgtcttatttattctaaaattgaccacataattggaagtattgcacataattgcaaacagtgataatttgacttcctcttttcctaattgaataccttttttttctttctcttgcctgattgccctggccagaacttccaacactatgttgaataggagtggtgagagagggcatccctgtcttgtgccagttttcaaaggggggaatgcttacagttttttcctatatcagtatgatattggctgtgggtttgtcataaatagctcttattattttgagatatgttccatcaatacctagtttattgagagtttttagcatgaaggggtgttgaattttatcaaaggccttttctgcatctattgagataatcatgtggtttttgtcattggttccgtttatgtgatgcattatgttgattgaaccagccttgcatcccagggatgaagccgacttgatcgtggaggataagctttttgacgtgctgctggattcggtttgccagtattttattgaggattttcgaattgaggttcaccagggatattggcctgaaattttcttttttggttgtgtctctgccaggttttggtttcagaatgatgctgtcctcataaaatgaattagggaggattccttctttttctgttgtttgggatagtttcagaaggaatggtaccagatcctctttgtagctctggtagaattcggctgtgaatctgtctggtcctggactttttttggttggtaggctattaattattgcctcaatttcagaacttggtattggtctattcagggatttgacttcttcctggtttagtcttaggatggtgtatgtgtccaggaatttatccatttcttctagattttctagtttatttgtgtagaggtgtttatactattctgatggtagtttgtatttctgtgggatcggtggtgatatcccctttatcattttttattgagtctatttgattcttctctcttttcttattagtcttgctagcagtctatttggttgaccttttctaaaaaccagctcctagatgcactgattttttaagggttttttgtgtctctatctccttcagttctgctctgatcttagttattttttgtcttctgctcacttttgagtttgtatgttcttgcttctctagttcttttaattgcgatgttagggtgtcgattttagatctttcttgctttctcttgcgggcatttagtgttataaatttccctttacacactgcttaaatgtgtcccagagattctggtgcatcgtgtcctttgttctcattggtttcaaagaacatctttattctgccttcatttcgttatttacccagtagtcattcaggagcaggctgttcattttccatgtagttgtgtggttttgaatgagtttcttaatcctgagttctaatttgattgcactgtggtctgagagactgtttatgatttccgttcttttgtatttgctgaggagtgttttacttccaattatgtggtcaattttagaataaatgcgacgtggtgctgagaagaatgtatattctgttgatttcaggtggagagttctgtagatgtctattaggtctgcttggtccagagctgagttcaagtcctggatatctttgttaattttctgtcttgttggtctgtctaatgttgacagtggtgtgttaaagtctcccgttattattgtgtgagagtctaagtctctttctaggtctctaagaacttgctttatgaatctgggtgctcctgtatcgggtgcacatatatttaggacagttagctcttcttgttggattgatccctttatcattatgtaatgcccttctttgtctcttttgatctttgttggtttaaagtctgttttatcagcgactaggattgcaacccctgcttttttttgctttccatttgcttggtaaatattcctccatccctttattttgagtctatgtgtgtctttgcacgtgagatgggtctactgaatatagcatactgatgggtcttgactctttatccaatttgccagtctatgtcttttaactggagcatgtagttcgtttacatttaaggttaatattgttatgtatgaatttgatcctgtcattatgatgctagctggttattttgcccgtttgttgatgcagtttcttcatagtgtcaatggtctttacaatttggcatgtttttgcagtggctgctaccagttgatcctttccatgtttagtgcttccttcaggagctcttgtaaggcaggcctggtggtgacaaaatctctcagcatttgcttgtctgtaaaggatcttatttctcattcatttattaagcttagttgggctggagatgaaattctgggttgaaaattctttaagaatgttgaatattggcccctactctcttctggcttgtagggtttctgcagggagatctgctgttagtctgatgggcttccttttgtgggtaacccaacatttctctctggctgcccttaacattttttccttcatttcaaccttggtgaatctgacaattatgtgtgttggggttgctcttctcgaggagtatctttgtggtgttctctgaatttcctgaatttgaatgttggctcccttgctatgttggggaagttctcctggatgatatcctgaagagtgttttccaccttggttccattctccccgtcactttcaggtataccaatcacacgtagatttggtcttttcacatagttccatatttcttggaggctttgttcatttcttttcactcttttttccctaatcttctcttctcgctttttttcattgagttgatatcaatctctaatatcctttcttccacttgatcgattcggctattgatacttatgtatacttcaagaagttcttgtgctgtgtttttcagctccatcaggtcatttatattttctctaaactgtttattttggttagcaattcatctaaccttttttcaaggttgttagcttccttgcattgagttagaacatgctcctttagttcggaggagtttgctaatacctaccttctgaagtgtacttctgtcagttcgtcaaactcattctccacccagttttcttcccttgctggcgaggagttgtgatcctttggaggagaagaggcattctggtttttggaattttcagcctttttgcactggtttctccccatctttgtggatttatctacctttggtccttgatgttggggaccttcggatggagtttctgagtggatgtgctttttgttgatgctgatactattcctttctctttgttagttttccttctaacagtcaggatcctctgctgcaggtctcctggagtttgctggaggtccactccagaccctgtttgcctgggtatcaccagcagatgctgcagaacagcaaagtttgttgcctgttccttcctctggaagcttcatcccagaggggcacctgcagatgccagccatagctctcctgtatgaggtgtctgtcagctcctactgggaggtgtctcccagtcaggatacacaggggtcagggacccacttgaggaggcagtctgtcccttaacagagctcaaatgctgtgctgggagaaccactgctctcttcagagctgtcaggcagggacgtttaagtctgctgaagctgtgcccagaaccgccccttcccccaagtgctctgtcccagggagatgggggttttatctataagtccctgactggggtgctgccttttttttttagagatgccctgcccagagttgaggagtctagagaggaagtctggctgcagaggccttgcttagctgcggtgggctcccctcagttcgtacttcatggcagctttatgtacactgtgaggggaaaaccacctactcaagctttagcagtggtggatgcaccttcccctatcaagctcaagcgtcccaggtcagggtcagactgctgtgctggcagtgagaatttcaagccagtggatcttagcttgctgggctctgtgggggtgggacccgctgagccagaccacttggctccctggcctcagcctcttttcctttccaggggagtgaatggttctgtcttgctggtgttccacgttccactggggtatgaaaaaaaaaactcctgcagctagtttggtgtctggccaaatggctgcccagttttgtgcttgaaacccagggccctggtggggtaggcaccagagggaatctcctggtctgccggctgtgaagatggtgggaaaagcacagtatctggactggagtgcattgttcctcctggtacagtctctcatggcttcccttgggaaggggagagaattccccaaccccttgtgcttcccaggtgaggtgattccccaccctgctttggcttgccctctgtgggctgcacccactgtccaaccagtcccagtgagatgaaccaggtacttcagttggaaattcagaaatcacctgcctcgatctcgctgggagctgcagattggagctgttcctatttggccatcttgccagcagacccagatgatactttatcttgacataacagtcttgtttttattcacaagttgtggcccatagggagaatcactcagtgacagaattactcagtgacagaattagctatatttgaatgggctagtcagcctgcccaagtcctaaagcaagcaaatgagaagaaaagaaaaacaaaatgccaagcctatcagagaggatgactggggatgtaactctgaggtcataaacatctaatatgtacaataaagaaaacaatgaaaatgattttaaggtattttacgaaatgctgaagctttgaaaatcttaagtcttagtttttcatgaattctaaaaggcagaagaattattagtaataggactggatataccagttaactgacagtcggttggataatcttaatgaaaataatggactagaatatggagagagcagttagccctttagctgactgtaaataaatcagttctcttaggtctagaacacctgaaacatatacgtaatatcttttttgtacactgtattttcagttttagttacacagacatgctaacttttctacataaacagtaatcaatgactgttgaggccatgtgattattaccctttccattttgaattctactcaggaaactgacagagaaagcataaactcatatttcatctccctaattactggtctagggaagcaagagatctaaggacttagtcaatgaataatataaaaatacagtcagcagatcataaatatttattgctacatcaaaagtctgctagtcgatctttcaataattccttcagcataaaatgcttgagtcaagatattggaaaaaatattaattaaaatttagacttagctctgaaaggacaggaaatagaaactctaccaaatattttctactgtcaaatgtctttaattttttgtcttagtttcattttccctgtgggtttgactgcaggttcttaaatttattaacctactacacatgcaattatcattttaaatctgacaatgcatctacttgcttagtggggaaagattagagctaagtggtggaattttattttttttttccccaaaggcaaagggaatactaacataaacttcagtgtttatttcacttaagtatttttctttgttcagtcaaaattttcttatagactctttactaattttttttaaatcaggaaagatgcatgaacactaattttaacaatttactgactatagttgattaacagtcgagtgaatataggtaaaagataattgcagttatgagttaccttacatattatatgtatatgaaatatacaatatcatctttattttcagtatcttacaagctaaagatatatttaaaatgttaacctggttatctatgagaatagtaatatcactggtgtgcatgaaaattcatggtagaggagaagaatgatatgtgcctggtaaattctagtggaagggggaggagacttgtaaacattgaggggaggggctagagatacaaattttggagtcatcaatatagagacctaggtcctaagcattcacttccagacttcttatttctctctgcattccatatttaaaacgattttccaatctcaatcttatttattaaattagttctatttttactaatttaactactagttgtagtttctaatcagcatgagtgagtcaactagtgtaacttacattagtttgatgtatttttgtcataaaaaataattttaatgttttagtacccatttaataaatatgaagtcccagcagatacaaagatgagtaaaatatagtccttgatcttaaagtatagtaaactatgatttagcaaggaaaattatcataatttattatgattcaatgtgtaattcccatttaatacttcagtgaaatattaaaaataaccagtgatcacaaaagtatcaaaacaaaatgaaagaaactttttacctcttctctttggaataacgtagaaaataatcacccttatttctcatttatctagggggcatccagtacagcagtgacacacagtaaaggcttgcaaacatttgccaaatgcaaaaaattagtaacatttcaagaaggcatgagatgtccagaacagagctatccaaaggtgcagcaagttttagaaaatggggttagcaagagagtggattctgaggtaagagaagcccatgagggagataggaaaagtgagatttcagagaagagtcattagtgtagggtgccagagaagaatggtgtctgaagaagggctgattacctgtttacaacgtggcaacagtagaacatcagattggaaagtagccattgatttcgccaagtgggtataccccaggaatagtttcagtaggctactgagagtagagacaatagtataggaaattggagagagaacaagtagtgagactatagatgtggtggctgtctatctactacatctaagaagtctggtagggagaggtagaaaatgcatagaaaagtaatcagagcaggcagacagaagagcaaagaggaggaggaattgggaaagagaaaacacattgggttaggagaatgtgatccaagatcagagtatgtgaatttgaaagtttagcttgaagtttggcttcagattgagaaaagtacctttttatctgactccagaggggaaacaaaagggtagtaggagcaatagcatcttgatttataaggaaactcacatcattatttcagcaaagtagggtaagagatgcttatcctggggagtactgggaattacaaaaaaacacacaacaaccaaacgtgcattctaaggtttttcagtgtctctgccctgatacagagtaccattaattagctgctgatttcatggcactgctgttcctcaagagtaggtttgggagtagaagacaatcaagtttctagtgaagtgaggttgtctgctctactaattcagataagcaaaaactcataatttaagtatttcaataattgcctgcactcccgccttgtgttttgtggatctggattgatatggtttttataagctctctgaaataatacaagttaaagaagagattactactcaaatatagatgtggaagatttttctgttcataaggactgtgatggatagttttatgtgtcaagttggctagactgtagtcccaattattcaatgaaaccctaatctcgatgttgcttggtaaatacattttgtggatatagttaacatctacaattaactgactttaagtaaaggagatcatcgttgatactttggccaggtctcatccaatcagttgaaaggccttaagaataaaattgaggtttccctgaggaagaagaaattttgcctcaaaactgaagcatcagttcctgtccaagagtttccagtctgcttccctgcccttcagattttaaatttgccagccctcacgatttgtgtgagccaatacctactctggttttgtttctctggagagcactagctatacagagaccaaagctcaaattttactgaaaagaggagtctgatctcctatttctggaactatacaatgtatctattcaaacttatttattaaacttattgaagaaaaatgaagatgatggtgatggttagtgattagggcaggggatatgtgacaggggatgtgggagaaggattttaacatatcagaactggtttcacactacctggttttactagttggtttttagtcctttacttacttggtacagcacaaacaccgaatgggatcagattctttggattagtcacacttcttcagttctgggattgtatttcctgttgactcaaacggtggtatcagaactctcagttaaacacacagaaatacagcttatgtctgaacaattttgatgagacatagtccaaaaacatttgtctaggggaaggcttaagtcactccgagtggataaactggcacgtctaagtctcctgctttgtaggtaagttgtgacacaccatattgtatgctgtgtgtgtgtattcatatttaaattttctcttgtttgtgctgttttagacacaattatttagtcaggaagagagtgagtccaggctgaacatcaggcttaaaactgcagtaaacaggtgaatgatagcctaaattcaatcaccctcagggcatcttagctgcagctaggaaataaagaagggagaagtcaggtgggagctgatgaaaccaaactgataggcctgagccagcattaaggagactaacccatgttcctgtgttcagatccctctgagtggggagacagtcatgggatatatacatgtctgtgcatgtgtgtgtgtggtgtgtgttggtccatccagagtgttccttcccattgaggctacagttgtagtttaagtgagcacagaaacaatttagtgaaaattcttgcttttctggctccaatagcaggatctgtcattaactaaagcggcagtgcttaactactatcaatacggagattgaaaactgaaaagtgtaagatttgcctcatacaggacacctgcaggcatcctcaaacccagcagcaatctcagcttatccttaagcaaactcagcttaaacatggcaagcaaacccagcttaatcaaacccagcttcaccagctgaaacatggcaagtttgccgccttcagagtgacctctgggaaaactcagaatttaagctggaaatagaatggcctttgagatagagcaaggtaagcagcgctcagcatagtttctgggggatttggaagggtgtcctgatgctgcaggatcaggtggcactcatggcatggggaagctatctcctgtggggaaaaggaagtcacttgtttagctaaactgaggctcatcaccccacaaatacctccttcacaaagaaagacaaattgtgggggatgtggaaggggtggtggttactggtggataccaaatttgtatctaatttagagttaaagccaggaaaggacaggaaagagccactgaacttccactttctcagcttacaacatattgtttgtaagagacctgcaaaacacaagaactcctctttcagaattcctggcagctggttatcccactgcagctgttataataaggaagtgaaggaggaaaggagattgatatttattaagtattcattatgtgtcagcacatagaatcttgtttagtcctcccaagagtcccgtgacatataagtatcactacctccattttaccaggttagaaagattagactgagacgttaagtatgttccaaggaactcaggagtaagtggtggagccaggtgggtggaaccataaagccttgacactcagactgtggacagtcagggactacaacaatggcaccactggagttggttagaaatacggaatgtcaagtccctcccccgaccatctgcatcaggaattgccttttaacttgatcttcaggtgatgggtatacaaaaaaaaaaaaaaaaaaaaaaattgaaaagcacagctctgaagcgtgttgtcttcccaccagttcactctatggaggtgggtcatcacaccatggcagagccataattgttaaatattcttccttaaactgaatcaaaatctccttcctcataacttttacctgctatccttcaaagagtcatcagatatcatttttttctcttccttttcatttttctaatctaagctcaactctttacatttattaaatatcctcttcagtctacatttttagtctgagatccttttgaatcctgatccatttctccagcacttataatctatacatttaataggcatattttgttgttattcattcatgatctattgatatttttaaaaactttaaaatacatactgatgtggcttggctgtgtccccacccaaaatctcatcttgaattgtaatctccataatccccacatgtcaagggagagatcaggtggatgtaattaaattatgggggcagtttcccccatcctgttctcatgatagtgagttctcaccagatctgatggtttcataagggactcttccccgcttcactgagcacctctccttcctgccactttgtgaagtaagtaagtgccttgcttcctcttatccttccaccatgattgtaagtttcctgaggcctctccagccatgctgaactgactcaattaaacttctttcctttagaaattacccagtctcaggcagttctttatagcagtatgaaaatggactaatacacatacatactctctcattctaaatacagtcacaagtagagtctggcagcatagtgatattaattcatttgtgaactcactctctgtattcagaaagctacacattatcctgaggtattttccaggtgatatttaaccaacttatctccatcaagagtttttttgttaagtgtcttgctaaactcaaaatactctatgggactatcctaataaccttatttcatggaagaaataagatggagcaaaactccatctcaaaaaaaaaaaaaggagaaaacttgcctggctttcatgttccatatttctcccattcactttcatttcttacagaattttcactgtgagttctttcaagagaataaactttgaatgcttggaatcagaaaacatgtttctaataccattgaattgcctttgcaacaatcacttcatctatgaaacagacataatcttaagagatgatatatgggaaggtattatataaactataaagcatgtgtagtactattgctggtattaaaacaactttggatttaaaaagaagctttggaatataatcaatgtcctggagacttaaactcatttagtggctgatgctcctttaccttgattttccctgtcctggttcttctaccactcggagtccctatgccaaattctttccaaaggccattgaagtgatactgtttgtcttgccaagactttctcttagaccaagagtcagcaaactgtgacaagtaggcaaacccagcacactgcctatttttgcaaataaagttttattgggacagccaacgtcatgtttttacatattgcctgtgaatggttttgtgctacaacagcagagttgaaatgttgcatcagagaccgtgtagcccataaagccaagaatatttactatctatctatctatcttgtcttttccaggaaatgtttgctgacccctgccttagactgtaagtttcaggaaaaaaagactttctgaatatgtaattttctgcatacaattcctaatccaactttgtacttaggtaataaataaattcattttatgataatttctttatggcctaaatataattctgaaataaaatggtgcagggtgattcaactgatcaatctggattaagatatttagctagaaaaccctattgatttcaagctttgttgacttcatgaggggtgggagggtcacaatatttgttcaattttcagcattaagaagtcctaaacattaaaccaaaatggatccttcatgatttgactgatgtttatgttaacaatgagctatcagattccattatccaacaaagtaaatatctatggaaataatatagaagtttaggctgaactcaagaaataataagatatgacctggatttcctttcatttattatattgcttttattattattttagagatgaggtctcactatgttacccaggctggtcttgaactcctgagctccagtgatacttctgcctcccaaagtgctgggattatggatttcctttgaaaataattttcctagtacaatgtgttctcacaaaatttgaatattctaaaacttaagtacagaggaaaagttttctgaaattacgtatctcaagagtcaaagcttgaaatcactttgttttctaggccttcttcaataaagaatttcggatgaagtacatgttattctgtatgacagtctgttgtttccaagagaataataacaagctgtccttgaaaagaatggctggtgatggaattagctctagagaatttaaggtagtatttgccaagaaagaaggtcagtctgatattgtgtcaaacatatcctttattaacctgaataagtaaatatatgaataagtaaatatacctaataaattacgaagtgcttggtgagttacctgaccattgtttttaaatgttctcattagcatttcttgtctgtaataaatgattttaaatttcgtgtttctccgaaatggtattttaaattccctgaaagaaatattctcaatttttcatgggagagaatggctaggaaattctttttcataactgtgatctagcttgtgtactcaggtaactgataaagtaatggatcagtcatctatagaatacatgcctattccaaagtggttactgctgtatgtcatggcatctgtaattggcctaaaaagcgataaatctgtttttgtaaagtaacccaaaagaccccattaaaagtggtattttaaatgtcagtgagcatgtattctatttaatttatgttaataggccataaatgggagaaaattgatgaaaaatattaccttttctgcatgttaaaactcaggagtaattatttttcatttttcacttaaggataagcaggtgtttaacacaacattaaataaatgcctcagtaccacaaggtgataaatgtgtaacatttaacagatgagtaaattaaaattgtgtctaaaacagcacaaacaagaaaaaatttaaatatgagtacacacacagtatataacatggtgtgacaccacttacctacaaagcaggagacttagacatgccagtttacacctgaaatggcttaaaccttcccctaggcaaatgtttttttaagaaccagtttctagttattttttgacattttaaatatgaaaaatagccaattctgtttaaaaatagagaactatgcagtttaattaagttgctatccaatctcagctgttcctgaggacttttggcaaatacacttttatccatgtgtccactcctctctgcttcacctaccctaattggtgtttgggctgaggaaaggggaggttttcttttctttttttttttttttaaaataagaatccttcatttccagtctgaagaagctgatcacgctgatttggccagaagtcaatgcaatgtatttatcagtatctagctgaacttttgaagtgctgcattccctttatatattctagtggattcagcatgatttccaagcaaaaaggaataatatagttcactgagctgtaaggtagtcaccagctcaggacatgaattctaacatgaattctaatttgactccaggtgtggttttgtcttcagtggagaaacttagctgcctgtcatcaaaatgggagcagaatcagccgctagtgtgtccattaacaaagggaccttgattatatggtaggagaatcttcctccctcccccaaaacactgttatgtttgagctaatgaccaggaatttctctgggcaaaatcacgttttgaatttcattccagaaataagtacagaaaatatatgctaaaaataaatgtttacaattttaaaaaacacactttacagtttaaattagaattaacatgggcagcagctgaaggataaataagggctggtcaactggccacggacactctgaatggtttaacagccggtgagtaactttgacaacttaggagacagcttttatgagccagggcaaaacgaactcactgaaagcactgtttctagtacatggattcacacacacagatgcttagcaaaacttgcactccaacaaataccaaaacctcccacatgagaaagtgttagcagcagggcagacaatctaggttacgcatccaaaaaaaatcttaatccatttttagaactcctttgtatccttagatttttggtaaaatagttacataatacagttacataattatgttgaattattttacctctctcagtctccaataaatgaacaaaacaattcaattttttgaatgcttcctatttgtgagtaattttgctagtcattttgctggtgctgggaataataaaaatagatgatgcttattttatccttgttatgtgccaggcattgtgtgaaacccttaatacaaattatctgataaccctcacaggaatcctatggtcataagactgttaatgtcctagtttgggaaatggggaaactaaagcccgaaaggttagtaacttgcccatggtcgccagagttctcactcctaaccattacctttaactgcctctctgtgctctaagctcagcagtgtttcttaaagttgaatgagcttatgagatacctgggatcttgttacagggcgttttctgatcaggacatctgcgtggggtccaagattctgcataccttgacaagttttcaggtgatgccaatgctgccggttcatggatcacagtgtgaataacaagcctctagacctgcagttcatacttgagttggcatattagaaatatcagggcagcttttaaaaacttctttgtgcaggttccatcccatgtcacttaaaatctctgggactggaatggaggcatgaaaatatattttaaagatccctaaataatccttatgtatcatgctctagaaatgaatttagtagctcagtgttaaaaattagaataaagtgcactgcattactaagcaatattactctttgaaatgttttaatatccattgtgtgtgtgtgcacactaaatttacggtgtaaaatgtattccttattgtaggtcaaggtaaaaaaatttgaaagctcctttcaatactaaatttgttttctctctttttccctccctctctctattcctcctccctacccccatattttgtcttattcttaagaggatttaagagacattacaaatatccacacttttaaaagatatttttcttgtctgtaagaagctcatcatctactaggggagctgaatattttaccatacaaaggagtagtgttatacaaaatatatgaaatattttgggaacccagataaacaaggaatatggcgatttactatttaggggattcaatgaaggcgtcatagaagaattgatacgtgacctttgttttgagtaggaattggcaagttaaaggggagggtaagagattccagcaagaggcattccttctatcttgtgtaaaggcaaggcatggtctaggttttacttgcaggattatgataaacttggagatgaggacaatcatgagagtccgctgaggtgaagggctgtgggggcatgtctggggaaggtactggaaagctatatactagaatggtcaaggagaaagagggaagctgcagctcaaagctggagaagaagccccaagcattggttctgaaggagaggaggaaggcttcatggtctcagagagaaataaaatcaggaactggtggtggggataagtatgaaattggttaacaagaatgttttctgataaagaccaggcagatatgttgatatcagagcttgtggatttatacccaaatagacaagtttcatgaaaggacagctgagagagtgaatgtagccggatggaatactgcgacataaggctgcacatggtaagttgggactttatagtggaggacattgtattccaggctaaggaattatctttgtttgtttctttgttttataatcttcagagggaattactcccactatgaggggagtggcataatcattttttaaaagataattctggaggtaaagttagggttcaactggaatgtaaaataactactgcattgattaaggtaacagacaacgaggtcctgaactaatccaatggcagggcttaagaaaggagagtgatttctgaagagggattgtcaaggtttattaaatgtggagttcagagagaaggagaaattttgagagctagtgttaaggttctagcttgggaaatgaatagctaaacatactaggaaatgaatagctaaacatactattagctcagactgttaaggtgtttttaaggtggaacgtctgatatgtagtaggaaatactgagtccattggaggaggagcatatcatgtagacaatgaaggaggtggaacagacaatctctgtgacacgaggttggtactgtcagattgtcattatgaaaggatgtagttaaaacacaaataagtagtattagctttcaaaaatctgtattcttgagtcataaaggaaatctgtatagatgactactgaattaatcttcaaaagtcacctgagtgatctttaccatcatattttctaagaatataaggaagatgaatgtaaactacagctgtataatttcttcctgtactcatattttaggctagaatagtaattttagtttcatagcaatcatttaaaagtgtttttcttttttcctacagagaatgttgttaatataagaagctaacctactttaagtaggagtggatatgactactcattgacaattataatagattcagcaggaaaaaatcagttacctattccattttcacaatttggggatttgagactagttgtgtcaaacatctttctatcaggatatgttctagacttaacaaaggtacccaagttatcatttagacaagagaagaagaaatgcctataaatactatcatcttcctttccctaaaataaatgtgcaagataaatccaagtgcctggattttcaatgtgagtatattatttcaaacgcatgagatcacttaataagcagaatagaaaacatttccaggcctgtaaatccagcagtgcttttgctcatttcatgggatgaataattttaacggaattcttctaccatgagacaggcagatttaatacataaatttaacatgacaatgtaataataagctacatgaaaaataatatttaaataataaaatcatacctccttctaaatttaatcgcttatttgtattttcccattaaaactcaatgtaaacaatattaacagtaattcaaaattaaagtaatcatgtactgtttaacttctatttgacattacctacatcttttttctcaatgctttctccttccctaggttccttgttttaattcttcaggaaatacggtaagggcagttcaaagatgcccaagtaggaacagctccagtctatagcccccagcaggcgcaatgcagaagatggatgatttctgcatttccaactgagctttgaagagtgtagtggttctcccagcatggagtttgagatctgagactgggcagactgcctcctcaagtgggtccctgactcccaagtagcctaactaggaggcatctcccagtaggggctgactggcacctcgtgcagccgggtgcccctctgagacaaagcttccagaggaaggatcaggcagcaacatctgccattctgcaatatttgctgttctgcagcctccgctggtgatacccaggcaaacagggtctggagtggacctccagcaaactctaacagacctgcagctgaggatcctgactgttagaaggaaaactaacaaacagaagggacatccacaccaaaaccccatctgtacgtcaccatcatcaaagaccaaaggtagataaaaccacaaagatggggagaaaacagagcagaaaagctgaaaattctaagaatcagagcgcctcttttcctccaaaggaacgcagctcctcaccagcaaaggaacaaagttggatggagaatgactttgatgagttggcagaagtaggcttcagatgatcggtaataacaaaattctccaagctaaaggaggatgttcgaacccatcgcaaagaagctaaaaccttgaaaaaagattagacgaaaggctaactagaataaacagcatagagaagatcttaaatgacctgatggagctgaaaaccatggcatgagaactatgtgatgcatgcacaagcttcagtagctgattcagtcaagtggaagaaaggtatcagtgattgaagatcaaatgaatgaaatgaagcgagaagagaagtttagagaaaaaagtaaaaaatgaacaaagcctccaagaaatatgggattatgtgaaaagaccaactctacatctgattggtgtacctgaaggtgacagggagaatagaaccaagttggaaaacactcttcaggatatcatccaggagaacttccccaacatagcaagggagccaacattcaaattcaggaaattcagagaacaccacaaagatactcctcgagaagagcaaccacaaccccaacacacataatcgtctgattcaccaaggttgaaatgaagaaaaaaatgttaagggcagccagagagaaatgttgggttacccacaaaaggaagcccgtcagactaacagcagatctccctgcagaaaccctacaagccagaagagagtaggggccaatattcaacattcttaaagaattttcaacccagaatttcatctccagcccaactaagcttaataagtgaatgagaaataagatcctttacagacaagcaaatgctgagagattttgtcaccaccaggcctgccttacaagagctcctgaaggaagcactaaacaaacatggaaaggaacaaccggtaccagccactgcaaaaagatggaaattgtaaagaccattgacactatgaagaaactgcatcaacaaacgggcaaaataaccagctagcatcataatgacaggatcaaattcacacataacaatattaaccttaaatgtaaacgaactaaatgccccaattaaaagacagactggcaaattggataaagagtcaagacccattaatgtgctgtattcaggagacccatctcacatgcagagacacacatagactcaaattaaagggatggaggaagatctaacaagcaaatggaaaacaaaaagagcaggggtttcaatcctagtctctgataaaacagactttaacaaaggtcaaaagagacaaagaagggcattacataatagtaaagggatcaatgcaacaagaagagctaactatcctaaatatatatgcacccaatacaggagcacccagattcataaagcaagttcttagagacctagaaagagacttagactcccacacaataataatgggagactttaacaccccactgtcaacattagatcaatgagacagaaagagaacaaggatatccaggacttgaactcagctctgcaccaagcagacctaatagacatctacagaactctccaccccaaatcaacagaatatacattcttctcagcaccacattgcattgcacttattccaaaattgaccacacacttggaagtaaagcactcctcagcaaatgtaaaataacagaaattataacagactctcagaccacagtgctatcagaactcaggattaagaaactcactcaaaaaccgctcagctacatggaaactgaacagctcctgaatgactactgggtacataatgaaatgaaggcagaaataaagatgttctttgaaaccaatgagaacaaagacacaacataccagaatctctgggatacatttaaagcagtgtgtagagggaaatttatagcactaaatgcccacaagagaaagcaggaaagatctaaaattgacaccctaatgtcacaattaaaagagctagagaagcaagagcaaacacattcaaaagttagcagaaggtaagaaataactaagagcagaactgaagaaaatagagacacaaaaaacccttcaaaagatccatgaatatgggagctggttttttgaaaagatcaacaaaactgatagaccgctagcaagactaataaagaagaaaagagagaagaatcaaatagacgcaataaaaaatgacaaaggagatatcaccactgatcccacagaaatacaaactaccatcacagaatactataaacacatctatgcaaataaactagaaaatctagaagaaatggataaattcctggacacatacaccatcctaagactaaaccaggaataagtcaaatccctaaatagaccaataccaagttctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatccttcctaactcattttatgaggccagcatcattctgataccaaagcctggcagagacacaacagaaaaagagaattttagaccaatatccctgatgaacatcgatgcaaaaatcctcaataaaatactggcaaaccgaatccagcagcacatcaagaagcttctccaccatgatcaagtgggcttcatccctgggatgcaaggctggttcaacatatgcaaatcaataaatgtaattcagcatataaacagaaccagtgacaaaaaccatacgattatctcaatagatgcggaaaaggccttcaacaaaattcaacagctgttcatgctaaaaactctcaataaactaggtaccaatgggatgtatctcaaaatagtaagagctatttatgacaaacccacagccaatatcatactgaatgggcaaaaactggaagcattccctttgaaaactggcacaagacagggatgccctctctcaccactcctattcaacatagtattggaagttctggccagggcaatcaggcaggagaaagaaatacagggtattcaattaggaaaagaggaagtcaaattgtccctgtttgcagatgacatgattgtatacttagaaaaccccattgtctcagcccaaaacctccttaagctgataagcaacttcagcaaagtctcaggatacaaaatcaatctgcaaaaatcacaagcattcttatacaccaataacagacaaacagagagtcaaatcatgagtgaactcccattcacaactgcttcaaagagaataaaatacctaggaatccaacttacaagggatgtgaaggacctcttcaaggagaactacaaaccactgctcaatgaaataaaagaggacacaaacaaatggaggaacattccatgctcatgggtaggaagaatcaatatcgtgaaaatggccatactgcccaaggtaacttatagattcaatgccatccccatcaagctaccaatgactttcttcacagaattggaaaaaactattttaaagttcagatggaaccaaaaaagagcccacattgccaagacaatcctaagtcaaaagaacaaagctggaggcatcagactacctgacttcaaactattttacaaggctacagtaacaaaaacagcacggtactggtacgaaaacagagatatagaccaatggaacagaacagagcccctggaaataatgccacacatctacaaccatctgatctttgacaaacctgacaaaaacaagcaatggggaaaggattccctatttaataaatggtgctgggaaaactggctagccatatgtagaaagctgaaactggaccccttccttacatcttatacaaaaattaattcaagatggattgaagacttaaatgttagacctaaaaccatagaaaccctagaagaaaacctaggcaataccattcaggacataggcatgggcgaagactttatgactgaaacaccaaaagcaatggcaacaaaagcccaaattgacaaatgggatctaattaaactaaagagcttgtgcactgcaaaagaaactaccatcagagtgaacaggcaacctacagaatgggagaaactttttatagtctacccatctgacaaaggcctaatatccagaatctacaaagaacttaaacaaatttacaagaaaaaatcaaaccaccccatcgaaaagtaggcaaaggatgtgaacagacacttctcaaaggaagacatttatgcagccaacagacacgtgaaaaaatgctcatcatcactggccatcagagaaatgcaaatcaaaaccacaatgagataccatctcacaccagttagaatggcaatcattaaaaagtcagggaacaacaggtgctggagaggatgtggagaaataggaacacttttacactgttggtgggactataagctagttcaaccattgtggaagacagtgtggcgattcctcaaggatctagacctagaaataccatttgacccagccatcccattactgggtatatacccaaaggattataagtcatgctgctataaagacacatgcccacgtgtgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctgagcaaactattgcaaggacagaaaatcaaacactgcatgttctcactcataggtgggaattgaacaatgagaacacttggacatagggtgaggaacgtcacacaccagggcctgtcatggtgttgggggagggatagcatcaggagatacacttaatgtaaatgacgagttaataggtccagcacaccaacatggcacatgtatacaaatgtaatacacctgcacattgtgcacatgtaccctagaatttaaagtataataaaaaaatatatataattctttaggaaatacttgccattttctttagggctttgtaaatatttcaatatcattttttcacattttaattttttagcactgtttttcccaattagactgtgaacttccagtgagggagatactgtgccattattgctgaattaaccaagaggcgaagaatggcacattggatgtaaaattttaggagaaataatctgatttttagtgtattccaaaatagggagtattaaaatagttgtaaaagggaaaacaagaactttattgggtgttctcatcctagttgcattatttagtgtagtttctattttgatttccatatcgagaccattacctttttaatactttggaactctaaaggtcttaactctgttctgtgtttctttttcatttttgtatgagagtctagcactgtaggggactgataatgtttgctggataaataaacttaccatttggaaaagttttctgcctaaggcagatcttaggacacgtgtggaaacacttagcaaatagagtctctcttcttttaacttactagtagtgcactatctatcttgcctcaatgccatctatcagcaaattcaccaaccaagcagccaaccaaccgatcaacaagtatttactgagcctttgctgtgtactcggtactacgctaagtacgatgatggccacaatacacggtttcatcattaggaacttacagtctttgattttatggtggttgcacttgtaaggctgaattgcatttaaaaaaatttcggtacaatagttactgaaactgactggatattttgttccaaatactgctgtttaatgtattagaataacattgctgcatgatatgttaccattttcagttattctaactcatcagaacagaacatattatttttaaagataaggcgtcattattttatctatgttgaatatcatttatctgataatggcaaaataatgagcctcatcttaccttgtctttgtacctatcccctttaacctgtctatgacttttagttttttgtgcagtacctttaatatttacataggtataactgactataatttttgataatgtagtaatagttcagggatggtatccatgctgctggcttagagaaagtgagtccctgaaagatcacattgacaaatgaggctttgttttcttttcagctgcttccgccttatatctatatgttgtggtctactttggctataaccagaagattgactatgtgaataaatccatctctgtgcctctgtttttctcttagactaacaggagaataaactgtaaatttgtgcatctgaatgcttatccactgaaggaaagatagcctcataacctctattaagtttaaaagaatctctcacatgacctctgagggtgtgaaatcttattcagcgtcctcagtatcatcgcacatatatgatcactatcttcctcgaggaatttcttcacttggcttccagaatacagaattctcctagttcctatcacaatgactgttcagtgtgagcaactacactagcaattgctagtcccttgttctgtgccctttcatcttctttgttcatacttttagtccatagataatctcatccgatcccatggatttcaatgtcatctattatgtcagtagccctcccctaaataagtatctccaggcacagtgtctcctgtaaacttcaggctcaactactcaatactagaatatccatagtcatctcaaactgaacgtgcataaaactgcttctctgtgagtctttcccatctcagaaattggtaccgttattcaggacaaaaactttacagccgtctttgatttctccctcttcttactccaataattcaaaaaatctaccagccaatcctgtcatggctacctccaaaatatgtatttactctatgtctcacctttgccattgctattaccctagtttcagctataacgctccctttctttggctactctaatagcttcctaactggtcgtcctgcttctactcttgccccagagagtccattgtcaatcagagtattacaaaccagagtaacattttaaaaatccaagttttattattttattcctctgctaaatgattactcatcatgtttagaatgaaagccagaagatgccttactgtgttctatgaggtcctacataaacagaggcaatcatctctgtaatctcaccctaattcatgttccctaaccagcctgttgctgtcaggccaagcaaagcatatccttaggcctctggagtttctgttccctctgcctagtatgcccttgcctcacaccttttaggtctctgatcaaatgccctgccctcacagacatttcttgagtattctattcacttattctggtttttcttcattagcacttctgacataatatccaggagggatttatttatttgcattctctctctcccactaaaatattccaagatgctggggcttcatttactatggtatgccttgtacccagagagtttggtacatacagataaatatttttttcggtgaataaactcagtagaatatagaagcatttattagctcactcccttttctccacagcatccttctccaaaattgagtaacttctagtggtttcggaaatgcttgcttaagcatcagagggaaacttacttatacttgcaaataaatgcatgctatttgctgaatgaatatttagctttggaaatgagccaatacaggaattgatgccaaacaaccctgaacagctcagtcagcgtgggaaaggctcacctggcaaagcccagttaggtacgtttacacaaggagtgcttttttacacagggcagttgaggagaagtcatgtgctatagctcgctatagttaaaagcacaaaacactatgaaactagggctacttccttaatctctctaagcctttgttttctcaaccattaaaaagggcttacagcaaatttctgatgcagaagaattacaaataatttatgtagctatgtaaggtggtggagtataactctaaggtgtgagactgtaggctgcacaaagtgacttccttccaaagagtaccgaagggaaagggaggacaaagagcaactttatggtagataaacctgacaaacactacactagctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgcaaactagttcaaccattgtggaagtcagtgtggtgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatgcaccatggaatactatgcagccataaaaaatgattagttcatgtcctttgtagggacatggatgaaattggaaatcatcattctcagtaaactgtcacaagaacaaaaaaccaaacaccgcatattctcactcataggtgggaattgaacagtgagatcacatggacacaggaaggggaatatcacactctggggactgttgtggggtggggggagggggaggggggagggatagcattgggagatacacctaatgctaggtgacgagttagtgggtgcagcgcaccagcatggcacatgtatacatatgtaactaacctgcacaatgtgcacatgtaccctagaacttaaagtataattaaaaaaaaagaattgtctgggaaaaaaaaaagattaacattaacaagcaatgtcatgttgatagcatatactttcgatatgatgtgatgagaatgccattttacatctgtggtcttcctcacaaaattcaatagtctcagtataatcatgagcaaaacatcagacaaatctcaaattggggagcattctacaaaattcctgaacagtactcatgggaattgtcaaggtcatcaaaaacaagaaaagtctaaaaaactgtcatggccatgaggagtctaacgagacatgacaactaaatgtaatgtggtatcctggatgggaccctgggacagaaaaagaacattaagtaaaaactaaggaaatcttaataaagtatagacgttcgttagttaataataccacatcattgttggttcattaagggtaacaaatatactaaggtaagatgttaagaagagaaattgggtgttgggtatatgggagctctctgtactgtcttcacaatttttctataaatccaaaactgttattgtgtttttgagacagaaactctgtcacccagcatgaaatgcaatggtgtgatctctgctcactgcaacctatgccttctgggttcaaacaactcttgtgcctcagcctcccgaatagctgggattacaggaactgccaccacccttggctaatttttgtatttttcagtatagatggggtcttgccatgttgcccaggctgggtctccaacccctgagctcaagtgatccactcaccttggcctcccaaagtgttgggattacaggcatgagccaccacacctggcctaaacgtttttttttttttttttttttttgagctggagtctcgctctgttgcccaggctggagtgcagtggtgcaatctcagctcactgcaacctctgcctcccaggttcaagcaattctcctgtctcagcctcccgagtagctgggaccacaggcgcacgccaccatgcccagctaatttttgtattttttagtacagacagggtttctctgtgttggtcaggctggtcttgaaactcctgacttcaggagatccacccatcccggcctcccaaagtgctgggattacaggcgtgagctaccgtgcctggctataacggttttaaaataaaaagttaatttttaaaaagaaggtttattgggaaggtcaaagtaaaataacgtatggcaaattctgaatcctaccacatcttaaaactattttttactggttgctaacttgaagaatgagtcatatttcaaatttgtcacagatagaaaatttaagcagtgctcgttacatgaaatatgctattcatcatagtaacaatgttgctatctagcaggaagggtatggctaaatgagatagaaaataccacacaatcattaaaacttttaatggctgtaaacattatgggacaacatgaaaaatgcttatgatacaaagcttagtttaaagtagatacaaaattataagcacagtatgattatggcaattacaaaataattggaaagaagtacaaaaaaatgctacagggaatatgccagtgggtgtgttatatatgggtgattttttttggggttgccactattctgttttccaacttttaagtttaggggtacatgtacaagatgtacaggtttgtgacataggtaaacttgtgccatggtgattgctgcacagatcattccatcacccaggtattaagcccggtatccactagctattcttcctgatcctctccctcctctcaacccccaccctccaacagaaacagacctcagtgtgtgttggattcgtcttattctttttgttttcttcttttgtgggtattgtatttaaaatggcaaaaattaatttaatacaattaagaagtatataaaaacatcaatcaaaaaagtatggaaactgcatttcagcatactaatcacaaaacgagtaaaatttttctttttcatcatggaatttttggggttctgggtgaaattcaaggggtttgtgaacttggatgagaaaaaattacatcttgattttcagtgaattctaacataaatatttgccactgacaacagtagtataagcagaacctgtgactttgttatccacaaaaatcacagacatttttatattatagttcttgcagatatctcaaagtaacttttatgttaattactatattacaacagctattacacttgctgctgggtcttagcatttaataatttaatgaagaatcgaaaatgttactatatcacaaatttgtgttttaaaaatatgtggttaactacatatcagtgtaattgtttttctatgtaatcctctgattttatgcatttaaaagcattattctgagaaggggcaacaggcttcaccagactgccaaagacaatcatgactgaaatagtttaggattgctgattgaaagaagtctgaaagcaccaccataaacaacgtgaaatttcatattgcacttatccatgaattttcatataagtaaaacagcttagtggacatccttaacagcccacggtggcaataggtaattaatatcaagcccattcacagatagaaatcaataccgattaaaggcactcaaaatggggaagaaagttgatatgcgtaagttaatttctctactttccaaattaaaaatatggtgcctaatgagctgtgacttagtgtcaaggaaagaactgattccccagggaacatggcagaaatattttacatggaaatcctataaatctgagtgctactacattataaacattctatgttgctatgtatttgcaggttttctttacttaaaacgtatctaaaagttccttggaaaggaataacaaaatttgacttcctgctttttgaaataggctttcacctgatctcaattgggaggcgtgcttattacaaattatcaaagaggatggtagccaaaacatattgagtctggcactgtactaagcactttgtattaattgtcacagtaaccctgtaatgtaggaattaatgttaaatccattttaagatgaacaaagtgaggtgtaagaagacattatacaatgagtggtggaactaggggtcaaacccaatcactgtcattccagggaccaagcatttaatgaccatgtcatgcttccatgggtgctaatttagaacaaacatccctagactatggaatggttttggcttctacagctttaagatgccagacataaaagcactacatgagaaaaatctggagctagtgacccggagtcagaaaagaagccaatgcaagaaatataaaactttcaagaaagatcagtaaatttcagaaaaaaaacccttccatatcacagttacatccccaacaaaatgtctctgacacaaacgctcttaagacacttggagtacaaacatgttccccagaggaacaatgtgctgtgaatccatcaagtatttggtggaaccaggcatgcgagactcaggcgacacaagaaccacttaaagacttacagtgcacgatgatttctctaatgctttccctttggaatgcaggaaatttctgccccagacataatttgaaatgattcacatgaaacatatccttcacacttcagtctggtttttgtctgtctctttgtttcttattcattctcatatttgactgatgattggaaacttttctttttttgttttgtcctctgaagtcttatgctagcttcctggcatttgcatccaataccaatctcagcagctttgtactacattcaaaaattgcaattcatttttctatgcttgtacatatagagtatgtgcttaagatcaggggttccagagccagactatgtgaattccagtcatggcctcattgttctcaggctgagtgactttcagtaagttattcaaacctcttgttcctcagcctcccaatctataaaatgggggtgataacagcatgcctattgaaagggttatcatgaggactaaatgatctaatgcacgtagagccctgagcacagggtctggcacatagagtgctagccaaatgttagtgattattacatttactagactgtaaaccccatcagggagaacatttatattttgatcattattgtatttatagcataaaattagtgcctgaaacaaagtagaagctcaataagttattgaattacattaaatattaaatgacttagctatttcttcctatttgtaccatttcaaattcctttcacattcttattcagtcatatgccaaactcagtagactatggaaaagttccatataaatgccttggtcccatctttacaatagagaaaaaaaattcaaagagcagtttttaatgcttaatttcatccccaaacatctagggaatataacgtggtcaccgggtctgtcagtgtggtgaatatttcaaatttggatctcaatctggtgggcaggtgacctaaaacatactttatatagaacaggtcccatctgagatcaagttgtagttgaaatatgacctttaatttcactctctgctttctctattctgcttctgtgtttcacaaaccacctggtttactttattacaaacgaatataaacagcttcatctgggatcttatggctgccatccatccatccactcccatttattgagtgcctaatacatttcaggcactgcccctggtgctgaggccctagacatgaaaggcaaaaggccctttaaggaactcagtgatatcgaataggcatttaaaattttatcatctctaaaactcttaattcctactcccccattccccaccaagctattcctttcatagtcttccccaattcagctgatggcaacgtcattacacagttgttctgccttaaattcttactttcctctttgaaatctccctcttagcacatccatctattccttcaggaaccaagtgggatatgaacaggtaaagaggcaatcctaagtatgtgatggaagctatggcaagatagaaacaaccctaactcaaaccaggaggcagggaggggaaagatttattggcagaagtgatatttgaactgagttttgaagaatgaatagggcttggccttgctaaagagctccccacggccagacacggtggctcatgcctgtagtcccagcactttgggaggccaaggtgggtggatcatctgaagtcaagagttcgagaccagcctggccaacatggtgaaaccccgtctctactaaaaatacagtaaatcagccaggcatggtggcaggcatctgtaatcccagctactcaggaagttgagacaggagaatctctcgaacctgggaggtgaaggttgcagtgagccaagattgcgccattgtattccagcctgggcaacaagagcaaaactgtctccaaaaaaaaaaaaaaaaaaaaaaaaagctccctcctcctcctgaatcatctggatatctttaaagcaccagaaacttaccatgctcaaaataatagttatcatcatctctctgcatgctccctcccaccccacatttttatagttccaaatgaaagcgttggaactgtctttaacaacctttttctccaaatctaatcacttgtaaagcactgtgcagtcagcatcctctcctattacctttagtcttcgttcactttcctttttcaagcccaacttagattttcaatcttcactcccacaattttccagtcactatataagtgcttggtaaatgggaatgcactatgcaaatgttaggggtttattctaattaacactaattcccttggtgatctcatctactcccatggttttaaataccatctatacactgatgagttccagacttatatttctagctttgacctttctctcacaattcagactaaaaatctcgctgcctactcactatcttcacttagatattgaataggcatttaaaattttatcatctccaaaactcttaattcctactcccccactccccaccaagctattcctttcatagtctttcccaattcagttgatggcaatgtcattatacagttgttctgccttaaattcttactttcctccctgaaatctccttcttagcacatccatctattccattagcaaatattgtcaattttaccttcaaaaactatcctgactcttacactttcattgctctcataccaatctaaagtacttggactattgccttcctttctgtttctgttctcctgcagtgcatcctacaactccacagctttccagctcactcagaataaagtccacatccttaacagggctcatgctatctttctgacataatctcctatcactctccttagctcttgccactccagccaaggatgctcctaccttttcctctcctgttctctctgcctggaaagctctttcctctgatagttgtgtggcttgctctttccttttacttaggtttttattcagatgttacctgtttagaaagacctttcccagtctccctggaaaagagcaacacatgatttgcttaatcaccttaaccctactttcatttttatcttatttcttcatagcaccaatatttcttgaatgttctaggtactgtcctgatgctgagaatatagcagtaaacaaaataggcaaacatccctttgtttcatggtgcttactttccacttgagaaagaaacaataagcaaacaaattaaatagcatgccagatgatagtagctcctgtggtgaaaaatcaaagccaggaagggggataagacgtattgggggaagagtagtggttgctactttaataatgaaagcttccctgataggaggctatttgaacagagatcttaaagagtgaggaaagtgagcctcgtgaatatctcaaaaagtatctcaggtggagggaacaagtgcaaaggcctgtggcaaggtcatgtttgatggttccaagagcagtcaggagaccagtgtgtgtggaatggagtagcacttctaccacctgccattatattatagattgatttggtttttattgctgacatctttacaccagaatgttggctgcataagggcagtgtcttttttatttcttttgaaaacaagaacaactttatcctgagaattcagaactgagccttgttctagtggggactcaatgaattgtcatgcactatagacagacttcactattcggaaccccttaacatgccccacgtgttttgcctttcttgtctgattttctccatctggaatgcagctctgtctttcaaaaagcctacccttcaggacactccaatgctactgctttaatgaaacctcgcttggttggctctcagctaaatgtcatttgtgccccctttgtatggagataactctgtactgtcgttgctgctcaaccaaaagctccgtgagacagcgagcgtgtctacttgcctcctcagggtagagtgccagtgtagcctggtgcctaatcatatgtgccaggtgctcagtaaataatgaaataaatgactatctgtttaaggcaatgagttgctttaagatttaccatactcaatacagattgctactgtgttctatggtaatatgcaaagtaactcaagatccttagaagttggtcaccatctcagaatttgaaaccccttatccaactagcagtgtaaccatgagctccaacctcctatgcaagggggactcaggaatcctctagaagggcaactccctttgcattctccaaggaactgtatacatgaaagagcctgttccttttctttccaattcagccatggatttttctctatctttaagcatacctgattggtaatatagtcttttcaaaactaagacaattatgagctttagtttaaaacattgttttaaatccacaatacatttctagtcatttataaataaatgtcatatcaaggaggaaaaaatacttgctggtaacaaataatgtggcataatttttgctgaacacccttcaccttaaataacttggcctttcagagaactcacatttgttcaaattaggaaggaaaaaattcacattttggacaaattgaatcagaaaatatgaaaatacccattgcaagtcgttgttgtggtaacaaagagaagaccacctgtgtttgttgaactgagctgaagtggatgtgctaatgtagtttcacttcattgttatcaaagacttgaaaggcttcttcttagttaattgaaaggctaattggcaggtctttttaaggacgagctaatctaagttggattttgttttattttctcatccaaccccttgtctccctctagtcatcagttatgtgagtgatgaactcaagcaaagcatgtcagatggtataaaatgggttatatgatgtacttttcctagagggtggcatctaaaataacagcacttcgataagttattgttcattcattcaatttaaatccattttaacttggctatcacttcactagttgacactggtttgttgtccacattccaactatgtgcataaaataaagtgctatctagagtgttcttgcctttgaaactgtcatcaagtcatttaaataaaagacaagctgccagatattaatgaagcttattagtaaaatgctatgatgcagaagatcccccaggacataaaattatggttttatgcactaatttcagcaccaaatgactgtattcttcttttgctgaaatagtaaatgatgctctaaatgttggaagttctgggaaagtggagtgggctatcatttgacacatttcacatgttctcaatggccatttctatcctgaattaattaacatctgagtcctgaaagtcattggtatggttttaagaataatgtttatgcaatgtcagcagattaaaagctagtgcaagtaacttacaaatgagaaatttctgaatactttgatcaaagagttttaaatcctatttaaaatagtcaagtgaacagagagacgcatatgtccaattcaggtttaaacatgttaaaccatcattgccattatttccagagcacaaaatataccctggaaaattaaattttgtttcattttcataatttctgtaatcattagtcaacgtaagttgaactatcggaatattaatcccatactaaagaaaagaagagagcattgacacatacatgtcataaattcgtctttgtcagttctataattttagacgacttcatgcccaaaggacaacttttgtaatacaaaaggtaattttatttacccttgtaaaagtattttacatattttcactcctattactgctatacaagttgttaattatgcagttaattattagaacaattaaaaacttgttactgaccttttggctaatgaatttaaataggtgcagatactttgtggtacaaaagtacaaatatttttactgttctctggatactatgtctttgccaggtagtgatagtgtggcttataaggcttaattatatagattgcctattgtgaaactcatattatattagatgtggttttacatatgaaatatgcatgcagcttccctgtgtacctagagagcttatactacagtgttgtaacagaaagaacattaccagataacaaaacatgaagcagtaatattgccccagatgaggtcaggaaggtaacagagcaagtttaggcagcaataattagagagaaatttcatttcagacataggatttgaggtagaccttaatgaatctaagcatagaggaggagaaaatgcctttccagactggctaagagttgataacctaagtgctgagtatgtgggaattaattgtactattttctctacttctatatatgattaaaattttccagaataaaaacttctaaaaaatcgtttcaggaatgactagaatgagcaaagatgagaggagtctttgaaaagaggggccctcattatttcacctacctgcccaagcaaggtgctagaggcagctaggtgaaataataagggacaattcaaatggggtcagattttgagaggcattggataagagaattaaagacttaaattccagttaggtcattgggaatcaatttgctgaatcaaagagaaccaagctcactttaaataatgggcaatgaatttctaatactcagcattttcccctaccctgttgatggtgaaattcactgtcaatgttattcagtgccagtgccattctaatgggggatgtgatataggagagcttccttgttgctgctaaaacttctttgagaagacagcatctgggttgagtctctgtgatttaggtaggtggttctcagcctgtctggacactctgaggccaccttgaaatggtcagactcagtgatactcagacactaggaagagagaccaatgtacaacaagactgtcagcttagtcattcggagtggggtatccccttttctgttctatttctgcatactgaagtgtttggaagaacaaattaaaaggcttcttatttagtaggggcttagagcaagagaatacatataatctttaaggagaaggcatctaggccagggtgaggtccgacccatctttttttttttctttttttttctggaaagggatggaggcacagtagtctgcttctctacaccccattttctttgcctaccatttttcttctgtattactcccttccttttcaggtgttccattactatattcacactgaagtccacgagaatctcagagacaggtaggtagcaacctccttaggtctatacttgaagtccctttgtaagtcaatattcagctgagttaggcatcagtcacttaggaaactgcttcaggttttcatcatattatgtgctgttattttagtatacttatactatggggcttagaattatcagatagacataatacatagtttatctggtaattcactcattcactcaaaattcattaacagtacactacgtgtaacgtattactatacaatttttcaaatgtagtaagttgtttaaaatgattattcaaaatcacaatgagatatcatctcacactaatcagaatgactattattaaaaaggaaaaaaataacagatgctggtgaggctgtggagaaaagggaatacttacacactgttggtgggaatgtaaatcagttcagctaccatggaaggcattttggagatgtctcaaataacttaaaacagagctactatttgaccccgcaatcccattactgggtatatgcccaaaggaaaataaatcgctctaccaaaaagacacatgcatttgtatgttcactgtggcactattcacaatagcgaagacaaggaatcaacctagatgcccatcaacagtggtttggataaagaaaatatgatacatatacaccatggaatactatgcagccataaaaaagaattacgtaatttcctttgcagcaacatagatgtagctagagggcattatcctaagtgaactaaggcaggaatagaaaatcaaataccgtatgttctcacttataagtggcagctaagcattgggtatacatggacgcaaagaggggaacaatagatactggggactactggagggaaaggactgaaaactagcatagtgggtactatgctcactacttgggtgaaggaatcatataccccaaacgtcagtgtcacacaatataccaatgtaacaaacctatatgtgtatcccctgaaactaaaataaaaaaaaatagattttaaaaaataattattgaggtctttcaatagcacaatggaaaaagcatagaacctggaattaagagcctgaggtcaagttctggctttccggcttcctggctgcatgatctctgataagctgcttaacctctgtgaggctcagacctttcttctatagattaggttgacattaatattcttttcattgaattattgagaagataaaataaaatattctacataaaaatcctatgtaaagcttaatgtagagaacaaatgttagttatcattattatagtagtggtagcaacattggcccttttgtatgatacctagggtttgtggcagcatttgtataatccttcctgcttattttcttaatcttccataaaagcaaaaaattattcttctaaaattttatctaattaaaataagttttttattttatgcagttacattttcaatatatattttaaaagtacattagtggccaggcgtggtggctcacaactgtaatcccagcactttgagaggcagaggcgggaggatcatgaggtcaagagatcgagatcatcctggccaacatggtgaaaccccgtctctactaaaaatacaaaaattagctgggcatggtggcacgcacctgtagtcccagctacttgggaggctgaggcaggagaatcacttgaacccggcaggcgggggttgcagtgagctgagatcacgtcactgcactccagcctggcaatagagcgagactccagctcaaaaaaataaaaataatttttaaaaagtacatcagctctgctattctcggttatttaataattattgatacagttgattttttaaaattccaacttcttgagtagatgaacactaagtagagcagaatataacatattgaaatgatgtttataagaccttgtttggttggagtaaagatgctgggagtagggatgtttactaagatgacaaggatctggaccaaggtgggaaattgaaaagttaccatgaagagaggacaagcttagtaacaagattaaatggagatgataaaagagaaatgttaaatttgtaggatatcaagcttgattacctggaggatagcaatactagcaataaaaaagggtcacttgaaagcataagctattttgataagggaatatagcccaagaaattgacttttgttacagacatgttgatatttgacataatgttggcagaatattcttaaaagcacttggaaatatggaatcatacatcgaagtaaagatcaaaggtgaagatgtagctttgagtgtgatgagataacaaataatggtcatggctaatgatgacttaccatgtgacagggattgttctcagtgccttctaagtgctaactcatttgatttttacctcaactagtatatcaaatttactgatgagaaaccaaagagctgccaaataactcaccttacattacacagctaataagtagctaagctgggatgacaatggatgagctccttcaggaaataaaatagagaaagaaaaacagaagatggagtgagaagcaatccccatggtcagtagaaagatgaaaaagaaaccagatcccaggagcagtggggagggtggaaaagaggaacagttgagcaatgccatagaacaagggaaggcagaatttcaaggagaattgtgtggtccatatcattaaatacttcagaaaattcaagagcaatgactcgaagtctctgcatttggcagtactgacgagacaagagtctgggtaaagaggtgtttcagaatccagactacagaggatcaaggggatggatctaaagagagggaagtagtagggacagaataatttttcatggcattttcctgtgaaaaagagaatgacagtataaagaaacaaaagaaacaactgaagcttttaaaattagaatgtcatctgatgcatgagaacatgtcaacgtggtcatcttttcttgattataactctagatcaatagagataaaatatctttgtaagtgctcacatactgataaaacatttagactttgtctttttaattaaaaacattaatatgcaaacttatgacactttcacaaattctttttttttttttttgagacaggatcttgctgtgtcatccaggctggagtgcagtggcacgatctaggctcactgcaacctctgcctcccggattgaagtgattctcctgactcagcctccctagtagctgggattacaggtgcgcgccaccacgcctggctaatttttgtatttttagtagagacggggtttcaccatgttggccaggttggtctccaattcctgacctcaagtgatctgccggccggcctcccaaagtgctgggattacaggcataaaccactgcacctggtgacaaattcttaatctgttaaaggaacagaagggacctattaatctaaatacgattttacatgaaatgggcatttatatattggaaagcaaagcaaatttggttgaatggaggctgtggaaaaaaacttcatgccaaaaaaagttgttttattttgaaacattttttttctacatataaattaatatatagtaacatttaatttaaataggaaaaattagggtcaaaatgaaatttacatattttaagaatgaacatcaaacctaaacttcttatgtagcagagacatccagttctgcaatgagtataggcgaactgtaaattttagctaccgcaaaaagtatcataaaaacttatttagaaataatcaacaggcaatatatagaatgggataatttgcaaactatgcatctgacaagggactaatatccagaatctacaaggaactcaaacaactccacaagaaaaaaataaatagccccataaagacgagaataaacatttttcaaaataagacatacaaatggctaacaacatgaaaacactctcaatgtcactaataatcagggaaatgcaaatgttggtgaagacatggagaaaacgaaatgcttatacactgctggtgggaatgtcaattagttcaacttctatggaaagcagtttggagatttctcaaataacttaaaatagaaccgccattccatccagcaatcccactcaagggtatatacccaaagggaaatattatatcaaaaagatacctgcatacatatatattgtatatatatacacatatacaatcccactcctgggtatatacccaaaggaaaatattatatcaaaaagatatctgcatatatatatatattttatatatatgtgtatatagatatatgtatatacacacacacacacacatcgcatagaataccactcagccataaaaatgaatgaaatcataaaaaagagcgaaatcatgtcttttgcagtgacatggatggaactggaggtccttaagtgaaaactcagaaagtcaaatactacatgttctgacttataagtgggagctaaacaatgtgcacacatggacttagaaagtgtaatggtagataatagagactcagaaaggtgggagcattagagtgtggtgaaggatgacaaattacctaatgaataccatgtacactattcaggtaatggttacaccagaagcccggatttcaccactgcaatatatctatgtaacaaaattgtacttgtatcccctaaatatataaaaataaaaaataaaaaaatttcatcttggaggaaaaatgacattaactgtactggaaagtgaaacaaagcttaatgacataaaaaaattcaaattctatcattgtggttgtcagttcaaaacatcaaaatgcattttccaatttgaataataaagaatagaaacaatgataccaacacaaaatattaaaatctaagtatgtgtgtaaaaacagttacaaacattagaaagaagaagagaaaaatattttttttgatatatagaaataggtactttgctattggtacaaaaaaaaaagtcaagaaatttatggaaggggaagtattcttgtctgtgtattattaagctcaatggccagtagcacattttgtttacttttttgctcttaaaactatatctgctaagcaacatttcttttcagagacggaaaaaaaatcatatgcttatttgctatttaatagatttaagttcctcggatactacaatgactttttaaaatgacttaaaaattattgtatttatgatttaaaatgaattataggaagaaagttttgaaactgggaaacatgagttaaagttatgggtgccctggggacttaagttaaaatggagacatgaattaacctatactaagttaacccacactaagatgctgttcactttgaaagacctctcattctccatttgcattaaaaagattaatcaaacataacgtttctgtacgatttatcatggagccaaaggattggttccttgaatacaaagatagattgattttataagtgcctaatctttaaataagactgtaatggactcacactgcattaaatggcattagcccagaagaaggcctgggtagctcaagagccatatactattttgtttgatagcatatattttatatgatatactcataggacacaatgcagattaagtatttattaatgcctctttattgctttttcatgacttccagtggatataaaaatgatgccttacagctctctaaaagaggataaaacaaattatattatgggatgaaaaaggaagtttgtaagacagataatttgctgaggaattatcatgctatcctgaaaggaagagggcatggaaaaagatgactgacttataagagggcatggaaaaagatggacttcacttataatacaaactgcccacatcctagccctaaggagcaatgatccagaactttgaaactttagcattggctctattagtaacagtttaagagtgttaaccaggggcatgtgcacacatggcccctggggcctctgagttgattgtttttcagcctattactttttgttcagtaactttaaccatcattctttgctcaattataataattgtggagtatactcaaatcacgctccaggataattaaacattatatgttgttgttatgcttttgattgtgttgtttcttgtatatattcatgagaagttataaaattagctgaccatacctttgttggcacttgtgttttgactctattcgattgtattcaattgattgtggttgtttctattagaggataggacacggatatcagagttaactgttgggtatacccctttattacgggtggactttatccagtttgcagataggacatgctatagaaaggtcacagttttatactggctagaccaatatttgtaattttgtggttcacaactgtccatttgtataactttagagctggagaagatctgagacctactgtcacattttttggcaataggtctgtaaggaagaagtcacttttccaagtttccaaatgtcctagttaccacctcatgttgactcccacttggaattaagtgttttgcattttgatttcatacagcttagggacatcagtaagcaatatgacctggtattaagtgagagacatcacttgggctcaggacgtctgtgggccagagggttaactcatgttcaaaatgaatcacactaactggcatatacttggcagggtttcacattttgccattttcccagaaataagaattgatgatggagttcatacatcctgtaattccttttatttcttataagtgctgctgtctatagaatttagtcatgctattcacattgagttcttccttggagggttttaaacacggatcaggggtattattactagtccactgagcccaactaaatcatatagctccttgttcgcatacacccatcaataattataggcttagagaagactgaacattatgccagaaactcattttaaagagtattatcattctcagccaattagatcagaatctattatattcagaattgcaaactgttcaaataagaattaaatgtatagtaagaggctaaaacattatcttcaaaattagagcttctttactgttccatttcaacctcgtttgtctctattcatttctattttataggtagtaagtttctacctttagaattcatttgcaggtgtataaacatgttcttcatttacaggaagaactgtggtcatctttgtctctcggtcattttctttctcagtattgatttgctttgcttcaacaatttcctatactttctctggcttactccaaaacatattcttcctttaaaccttttcatgatggaagatttgccattttctcaatccatcgggagtctctgggtttgggcacttcttcaaatatatcccagagtccactgggaagtgtcttagctgtccgtctgtgagtgacagagaatgatctatgatactttgctgtctcttttacaaagtgtccttttatcccctgcagctactactttaaatgaaagtgctttcagatgtaaaggtgtcactcaatatttttcaaggtgcattgcaaacaatgaataaagatgtgtgtattcttttctctttcatcaaattttagcccagtaataaaactgggtgtatataaataagaattcattatttacactgcattttagtgctgatacagatacagtgagttcctgccctttcctctcctttatattgaagggattataaatgaagctctttaaacattctgagatctttaagttgatttctacatgaactccaagtggtgttaatgacattttcagaaaagatgctttacttagctgacaagaaaaagtactctgtaagcctttatttgtatgtgataaaacagagttgataaaataatctactattaacttatcaatgcagtcttacagaatccacctattacaaagtagataattttgttttctttccttttgtttcagtagaaactgtcaattaaaatcaataaagttctagaaaaagccatggtaaacttggttacaaaccaagagagagtcaactaaggtgaagaaaatgtgaaactctttattaagcacttgagaagcacttaaattataaccctagagtgagtaaatactgttcaatccttacagattttataaactatataggacagcagatgagcaatcagggattctggcccatgagctgataaaccatgaatctttgagctttgccaagtgtttttttctctttacttacaaattaggtaaattaatattttccctacccttgcttcacccgtgattctctaaggaacacagttaacacatcttaaacattttgagacactcctgaaagttctatatatgaattatttgcttatttcccaaatggcacaacacatctattttcccataaaaactgtcagccctcttggaattgaatagcgctgcataaaacaactattgcatattgattttttcttttgcatttattcaggctgattccccattccataggttagtggcttagctattatactctcataaaaagaagaacttcttgagtattgagtgagaattcatttgttctttttgcctttttctcaccctcttctgaggaattttcactccactgagctttcagaagatgtattattatatcccaccaatcaagaacaggagaatatggatgattaaataccaacagtgtactgtttctgtactaaacacagaattagccattggcctccacctaatgaatctataatctaattagacagcttgacaaccccaagaagggaaacgataagaatgcgcatcagcatagtaggttaaatggagaaagtggcatattaagatacgtaagaaggtaaaattagagcacctgggggaaggcgcggctgtgggcgcagcttcagccgacttaaacgtctctgtatgatggctctgaagagagcagcggatctcccagcacagcattcgagctctgataagggacagactgcctcctcaagtgggtccctgacccccgtgtatcctgactgggagacacctctcaggaggggccgacagaaacctcatacaggagagctctggttggcatatggtgggtgccccactaggatgaagcttccagaggaaggaacaggcagcaatcttcgctgttctgtagcctctgctggtgatacccaggcaaacagggtctggagtgcacctgtagcagaggggcctgactgttagaaggaaaactaacaaacagaaaggaatagcatcagcatcaacaaaaaggacgtccagacacagaaaccccgttggaaggtcaccaacatcaaagaccaaaggtagataaatccatgaagatgaggagaaaccagcgcaaaaaggctgaaaattccaaaaaccagaatgcctcttctcctccaaaggatcacaactcctcaccagcaagggaacaaaactggacagagaatgagtttgacaaattgacagaagtaggcttcagaaggtgggtaataacaaactcctccaagctaaaggagcatgttctaacccaatgccaggaagctaagaaccttgaaaaaaggttagacgaatcgctaactagaataaccagtttagagaagaacataaatgacctgatggagctgaaaaacacagcaagagaacttcatgaagcaaacacaagtatcaatagccaaatcgattaagcagaagaaaggatatcagagattgaagagcaactcaatgaaataaagcgagaagacaagattagagaaaaaagaacgaaaaggaacaacgattccaagacatatgggactatgtgaaaagaccaaatctgcatttgattggtgtaactcaaagtgatggggagaatgggaccaagttggaaaacactcttcaggatattatccaggagaacttccccaacttagcaagacaagccaacattcaaattcaggaaatacagacaatgccacaaagatattcctcaagaagagcaacctcaggacacataaccatcaggtttaccaaggttgaaatgagggaaaaaatgttaagggcagccaaagagaaaggtcaggttacccacaaaaggaagcccatcagactaacagaggatctctctgcagaaaccctacaagccagaagtgaatgggggccgatattcaacattcttaaaagaattttcaacccagaatttcatatccagccaaacaaagcttcataagtgaaggagaaataaaatccgttacagacaagcaaatggtgacagattttgtcacaaccaggcctgccttacaagagctcctgaaggaagcactaaacatggaaaagaacaaccggtaccagccactgcaaaaacataacaaattgtaaagaccatcgatgctatgaagaaactgcatcaactaacaggcaaaataaccagctagcatcataatgacaggatcaaattcacatgtaaaaatatgaaccttaaatgtaaatggactaaatgccccaattaaaagacacagactggcaaattcgataaagagtcaagactcatcagtgtgctgtattcaggagccccatctcatgtgcaaagacacacataggctcaaaataaagggatgaaagaatatttaccaaacaaatggaaagcaaaaacaaacaaaaaacaaacaaacaaaaaaacaggggttgcaatcccctcatcacacttattctaaaattgaccacgtgattggaagtaagacactcctcagaaagtgcaaaagaacagaaatcataacagtgtctcacaccacagtgcaatcaaattagaattcaggattaagaaactcacttaaaactgctcatctacatggaaactgaacaacctgctcctgaatgactgctgggtacataaagaaataaaggcagaaataaagatgttctttgaaaccaatgagaacaaagacacaacataacaaaatctctgggacacatttaaagcagtgtgtagagggaaatttatagcactaaatgcccacaagagaaagcaggaaagatctaaaattgacaccctaacatcacaattaaaagaactagagaagcaagagcaaacaaattcaaaagctagcagaagacaagaaataactaagatcagagcagaactgaaggagatagaaacacaaaaaacccttcaaaaatatcagtgaatccaggagctggatttttgaaaagatcaacaaaatagaccactaacaagactaataaagacgaaaagagagaagaatcaaatagatgcaataaaatatgataaaggggatatcaccaccaatcccacagaaatacaaactgccatcagagaatactataaacacctctacacaaataaactagaaaatctagaagaaacggataaattcctggacacatgcactctcccgagtctaaaccaggaagaattcgaatccttgaatagatcaataacaagttctgaaattgaggcagtaatagactaccaaccaaaaagagtccaggaccagatggattcacagccgaattttaccagaggtacaaagaggagctggtaccattccttctgaaactatcccaaacaatagaaaaagaaggaatccttctttactcattttatgaggccagcatcatcccgataccaaaacctggcagagacacacacaaaaaaaggaaatttcaggccaatatccctgatgaacatcactgcaaaagtcctcaataaaataccggcaaaccacatccagcagcacatcaaaaagcttatccaccatgattaagtcggctttgtcccagggatgcaagactggttcaacatttgcaaatcaataaatgtaatccatcacataagccgaaccaatgacaaaaaacacatgattatctcaatagatgcagaaaaggcctttgacaaaattcaagacgtcctcatgctaaaaactctcaataaactaggtattgatggaacatatatcaaaataatgcgagttatttatgacaaacacacagtcaatatcatactgaatgggaaaaaactggaagtactcccttggaaaactggcacaagacaaggatgccctctctcaccactcttattcaacatagtactggaagttctggccagggcaatcaggcaagagaaagaaacaaagggtattcaaataggaagagaggaagtcaaattgtctcttcttgcagatgacatgatggtatatttagaaaaccccatggtctcagcccaaaatctccttaagctgataagcaacttcagcaaagtctcaggatacaaaatcaatgtgcaaaaatcacaagcattcctatacaccaataacaaacagacagccaaatcatgagtgaactcccattcacaattgctacaaagagaataaaatacataggaatccaacttacaagggatgtgaaggacctcttcaaggagaactacaaaccactgctcaaggaaatcagagaggacacaaacaaatggaagaacattctatactcatggataggaagaatcagtatcatgaaaatggccacactgcccaaagtaatttatagattcaatgccatccccatcaagctaccattgactttcttcacagaattggaaaaaattactttaaatttcatatggaaccaaaaaagagccctcacagccaagacaatcctaggcaaaaatagcaaagctggaggaatcacgctacctgacttcaaactatactacgaggctacagtaaccaaaacagcatgatactggtaccaaaacagagatatagaccagtggaacagaacagaggcctcagaaataacaccacatatctacaaccatctgatctttgacaaacctgacaaaaacaagcaataggaaaaggaatccctatttaataaatggtgttgggaaaactggctagccatatgcaggaaactgaaactgggccccttccttacaccttatataaaaattaactcaagatggattgaagacttaaatgtaagacctaaaatcataaaaaccctagaagaaaacccaggcaataccattcaggacataggcatgggcaaggacttcatgactaaaacaccaaaagcaatggcaacaaaagcccaaattgacaaatgggatctaattaaactaaagagcttctgcactgcaaaagaaattatcatcagagtgaacaagcaacctacagaatgggagaaaaattttgcaatctatctatctgacaaagggctaatatccagaatctacgaagaactaaaacaaatttacaagaaaaaaacaaccccctcaaaaagtgggcacaggatatgaacacttctcaaaagaagatatttatgcagccaagaaacatgaaaaaaagctcatgattactggtcattagagaaatgcaaatcaaaaccacaatcagataccctctcacgccagttagaatggtgatcattgaaaagtcaggaaacaacagatgctggagaggatgtggagaaataggaacacttttacactgttggtaggagtgtaaattagttcaaccattgtggaagacagtgtggcgattcctcaaggatctagaaccagaactaccatttgacccagcaatctcatcatgggtatacacccaaaggattataaatcatgctactataaagacacattcacccatatgtttattgcggcactatttacaatagcaaagacttggaaccaacctaaatgctcatcaatgatagactggataaggtaaatgtggcacatatacaccatggaatactatgcagccataaaaaaggatatgtttctgtcctttgcagagacttcgacgaagctgaaaaccatcgttctcagcaaactaacacaaaaacagaaaaccaaacaccatgtgttcttacttataagtgggagttgaacaacgagaacacatggacacagggaggagaacatcacacactggggcctgttggtagatggggggataggggagggatagcattaggagaaatacctaatgtagatgacagtttgatgggtccagcaaactaccatggcacatgtatacctatgtaacaaacctgcacgttctgcacatgtaccccggaatttaatgtataaaaaaaaattaggtgaactaaatctaaacttatgatgaaaatgtgttgttaaagttgtatatgaatattagtaactcagagtcttaagttgtcctgtctttggagtttcgaccctaaggaaatatatacatatatatatgtttcagttttctggtatgacactgaaaggtgaagaatgctgccttgttatcttataactgacttggaagtcctataaagaaaaatatcaaaaatattgagcattttctcatctaaaaataaatatgtgttcatccaatgaagagaaataaaaacgtctatggaagaaaaaaaaaaaggtaaaattaccaaaaaaaaatttacatttgaagaaggttttgcagtttccaaaatgtttgtttagtcacttctttatactgtactatgatcccagaggttttctaggcaagaatatcaagtatatacttgggtctgaggcatcaacagactataatgcaatgtcttggtattgaactacaagaaatatctttctgtgattaattttcctcataaaaccgaggacctcattccttcagcatctcagcaatgtgagcaaaggacattcatacttctttccttcaattaaaaaagatatggtatgtttggattggcataaaattctatgttgtcttgagaagacatcaaccctctttggatcacttcttaggtaacactacattctttcatttatcacatgcttgaaacaaaacaagggtcctaaagctcttacctgggggagatagtttggaattagaagcctcagagaccagccctggaatcctgcttcattgccttggaatcctgcttcattacgcttagtctaactagttaggtttaatttttatggtcatagttttttttgtgtttgtttgttccccccggccccatagaacctagtttcattttaacatcaacaatcaagtgaaatcttcttgtaattctaaaattgtgcttaatttggtaatctaaatgacataaaaattattgcatagttcttattctgaggagctttgaaacacctttaacttagtacttcttaacaacaaatgatactcacttattgattaaaaatgcaaagtgacttctggatatatttgctggcttttttcctctgaaatcaatgagggttgggagcaaaaacctggggcatatagcagggaaataaacccatgctggtatgaaatttctatacgttctgtgtattgatcttgaaattttctttttagctaaccagagtatttggatatacagacaagggtatattagtaaaaagggaatggacttttatctcttatctaaaactttccctcaatgtgtgtttttatttaaaaaatggagcaaaataattgacacactacactacactacactacactacacactacactacactacacactacactacactacactacactacactacactacactacactttagaagcctgactgagggggaaaaaaaaaacagaaggctggtggagagtgagaattttatcacactttagagatgggacttaaggaatcatatggttcatccaccaaccagagcctgagaggcaattactgagactcgtattaaacctccagtttagtcgtgttgactgttctcctggaaggtagaacagcacagtagtcaagacaggtttggatcccaggcttattgcacactgctggtgtgatcttgagctagtttcttacctttcctaaacttcagttctttatttgtaaaataattatacctatcctacagggttatcacaaaaattaaattagatattatatattaagaatgtggcacaatgtcaataaactctcagtgaatgagtgttattattagataacccattccattgtaaggtagctctgttattaagctattttttaaaataatgaatctgcccaggtgcggtggctcacaactgtaatcccagcactttgggaggccgaggctggtggaacacctgaggtcaggagttcgagaccagcctggccaacatggtgactccctgtctctagttaaaacaacaacaaaaaactagctgggcatggtggcgggcgcctgtattcccagctacttgggaggctgaggcaggagaatcgcttgaacccgggaggcagaggttgcagtgagccaagatcgcgccattgtactccagcctgggcgacaagagcaaaactccgtctcaaagaaaataaataaatacaaaataaaataaaacaatgaatcaaaatctgtctctctatagctgtcatctatttgtgcttgttctcccatctgagaaaccaaaaataactgatttaaagcatggctcctccaccttccttttggtagctatttcatgtctgaagcactttgcattctttatgttgtagacttcagcatatatacttattatcccactgtacccctaagagtataggctaaatgaatcctattgctatcattacttcctgaaaagaaccaaaaagggaatcataaaacactcaacaaagaaaatatagctatgaaactgagaaccaatttgtctttgatgggagacagtttatagatgctgaatcttccagacaaactttacagccttgttcacatactacctgacctaaccttattccttatgacttaagagatattaaagcaccttaattaggtgaaagtgatgtaatgcctgctcctccttctactatcatagtcttccctagttgctccagcttgaaactcaaacaagcaaacatacttgactcgttctccacccctctcttctatgcagacaagagggaacactaattctatggtccagatatttgtcctttcattcctgtttttcttctcatggttgttagagctgacatttccaataggtagatgaccaggatacagcaaactagcagcaaagaaaccaatgcattaagaaccaggaccccactctcatcctgccctgtgatcacctgctacttcttcccactgacccaacccaagtggaagccacagggcaagggagcccattggtgcagtgaataaagagaactagaagggatgagtctggagaggaagatgaacttgattccacacatttcttaacttcttttctgacttctgtttctctctctctccagaggtatcttttgatcaaaatcattttgaatgttacatgtttgatcatgttgctcccctacttttataatctttccattcctcttaagcagactttatagtttcctcctgatcaacctcctggcagcctttcaccttaagttctgtttccactttccttctctgttgtctcctaggcttcaggcataacagacaagctgatggttctccatgtctcccagatttagagactcccaaggaccacactgctttcatcttataagaagagattgtacctgacgtagccccaggctcatagtaaatgctccacatgtgcctgctgaataaagggatgtctgcacttttgcacacaatattctctgaacctggattgcctaataaattcttaatttcccttccgtctctgaatcatacttctgtgaaatccaccctgatctctccacatgacatctcctcttatgagagactcattcctctgtccttgctctgcagtctgtacacatctcttttagcacttatctccaggtgcccttttaaattactcacattcctctgtggctttaccagactgtacattcctttatggcagagactggtattacacatccacagatccccaggacctgaaaggatgcctgatgcatggtgggtactcaatgcacatgcaacctgtttactgaggaaaatggactcgatcccactcatttcttcttctctggcttctgtttgtttcagaacgacagaaggggaggtggaagaggtataaaaatataagatagtattttttaccaattactactttcattccttttccccattccttaatgatatcttgggaagattattaacttttaagtaactttttgctataatatattcagtctcattaaagccccaacaccaaacttgatttaaatcactttccttcctcctccgtggagaggtatggtctgcctctgaatcactgcctttcccctcccttcattcttcaaggtctagttcttccagtgtgttaggggcagagaggaagatctttctctctctctctttaactggttgcaattgtatgcttttttatgttggctgtggctgcttgtctggtgaatggtaactggctggcatccagtggctggctcttttgtaggatggatctgtgcattcttcctccggccagtgtaatatttggctcaagcttgacctctttcacctctgtcagctcctgccacattggagcactgcccagtctgttgacactgggtattccttgcccagcaggcagctctcttgagtggagggtagaagacagctggctcaagtcaggctctattctccatggccacttcaaccatagaaatctcacatagcaacctcatgccaaatactgagttgcgatggcttcattgccatgtcttctgtctctcctgccatctctctccaattcacttctttcctgttatgactggcaaaggaagcgagtccactgcctgagcagatgtccaatttggaaacctgatctccatcttctcttcttacaggctaccccaatttcaatgagtgattctcctgtagcctcccctttctttttcacgcagatggttgtgttacctctcaaacacaaatcccacataagaaaaatctaccctgaagattctgttttcccctcttcagcttctgtttatggaggctagggtgagaggagagggtttgattatagtaggggagcccccacagtagcactgaggtaggtttttgggtcctggagtcaattctatgaaaaataccactcaatatcccctgataaggtttgctgaataaatgaatgagcaagtggatgcatctatcttgaatagttgataatagatgggaatactgatgctgtgcaataaggggctaggtggattgtaaaacagaacaagattagtcgatgacagaaatcagatgtaagccctggacttctgactcagggctaagtgccccagcctgccatctttgtataacctctgcttgtctcagcaagacatgtagtcataacattaattaataatgccactccacacatcaataagagccttggaaatttaccatgaaaaatcagttttgtactttttagaatttgcagctctgaatagggaggaaaatgtcatttctgccagaggcacagcatcttgttcagctcttatgtaaactcactgtcaggcaatcctagaaactgcctccacttgcctctgggcaaaatgtctccttttcttagaaaaatgtcaccttttctcgaggaaatggcaggtggttattttttttccaaaggaaaaatgacctttgcattttgttaaaaaaaacccaaaaacccctcaaggacttacgccttgatgaaaacactgaaaacaattccatatcttttactttgtacttgaggttctactctgtaagttttgagattacatctgtcaccactgatgtagcctgtaggcaaatgtcagtgaccagaaatactgagttaaatatataggatatatttaaggatataagatgccagaaaatcctggcatcttgttttccaggaatgttcaacggatgcttatatctcagctcttgttgctcccagctctaaaacacacacacacacacacacacacacacccctctctctctctctcttactttattctcattactttaacactttaaaggctttatatcccaatcctggatcacaatcttatacaagtccatgaaagactcctctgaaaaaaatgccaatgttgctacattgcttatcattgtgcttaaaattatgttcactatttcatatgaaatttatacctgtggcaatctaagtaattttttcataccaaatatttttcttctctcatgaggacacgggagaaaatatatccagtattctttcccaccatcccccatagtcagataagaaaatacaaaagaaatacaacaaagaagtaagaggagtgaaaatattaggacgtaatactttaaaacaaagagagcaggaagataaaagtgatgatataaagaaagacagttctaggttattaaccttggcttgacgaaacaaagttcccacttcttttgtcaatatttcatatacgtagtagaatttttttcccttgtgacaatagttcttgccattaaaaaaagcaaaatttaccttacagagtttgattttccagcaaagtagtaagttagatgatgacactcaagatttaccatgtgtactcttgtcacttcatgcaaatcctcagctggagcatatgagaggcacattaattacattggatacagggataatgtttctgcagctgcagcagttttgatatttgcagactccagtgcactctatctgtaatttcactggcagcttgcaaaaaccagcagaatcacacttataaacaaaggtctgcatggtaatttatctcctattgacttcaatgaagtctctttattcagaatactaagaaattcataattatgagctaagatctatgacttagctaaagaaaatgaaagatatgtttcttgcctcttgtcacttatattccacatacctgtggatgatgacacatatgtgcatatatatacaattgaacttttcaccgagcacttgcaaacccatatgacaagctataggaatatgcaccaatatcctatatatttaattcaaggagtgttatttctcttagcagaaacatttacttttcttcatgcatactccaactatcttaccctcctcagacttttctttttgttatgattcagaattgacttgcttttatttttggagtgggttaccataacaaaaatggagagatcattattaaacaaatgaagattaggttactgatctgtaaaacgtgcctagcaaaaagagatgagcatcctacggcatacttacatggcacctagcccaattttagtgtcagataatgcatacagaagaggtgaaatgtccctatttcagctgccagtctgccaacagaacagttgtcaacatggcaccacaattctgaaaatttcctgatacctctatgaagtctaaaatgatttaaagaagcaagaggtgtctttaaatgttcaatgcagaatcattttgtctccaggatccaaagggtgaacatcctaagagttcataagatcttttcatgtatccattacttctagaatattatagctttaatttattgggagatagtcttatggagattcataatggctaccatttccgagagattccatgtgccatgacctaagtattttatatataataacacatctggtgagatgtttggttaaactagactaagaaaagctttaaataattctgtaaggacaacataatcatagaagactctatgatgattacagcaaatcttctgcctccatagtaatccatgtcagactagtgctgcatagaaagattccttcacggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaagaaagattccttcacttatttaatcaacaagttgaatattttccatatacctggttatgaactaagccttggggatttattaacgatcaagtcagacacaggttttgatctcaatgaacttattatagtcaggttggggaggcaggggctggcaaataagaatttccaattcagctgagggaggatcagataaaaataagcatctttcataaaaagcagattgtttcctgatgaaccaaaggctcagttcagagagacagagtagtacgaactgaacgaatctgacattgtctataagagtgcatatggtgcgtatacacgtgcatgtgtgtacacacatacacacaccatagaacacacacacaccacagaatactatgcagccataaaaaatgatgaaatcatgtcctttgcagcaacatggatgcagctggaggccactgtcctaagtgaattaacacaagaacaaaaatccaaatactacatgttctcacttacaagtggaagttaaacattgggtacatatggatataaagatggaaataacagacactagggactactagagtggggacagtcggggcaagggctgagaaactacctattgggtactaagctcaatacctgagtgacaggatcatgcataccccaaacctcagcgtcacgcaatatacctatgtaacaaacctgcacaggtacccctgaatctcaaatacaagttgaaattatgtataaaaaaataatgcagatggcagtccagatagcagaatccggtaaatctttggatctagctgtgctcactttggttcattgataaagcaaggcaattggtgattttggacctacacttaaaaagctaaagtgataataactgcttaaatgcatttagttattacttttagtttaaatttatcttaaggtaaacacctctcactaatatagtcacagccaaccacctactcctatactattaagtataaaaagatgatgttaaccccatatcttccagtccatttctattatatttaaataacaggctttcagaattctttttaaaatgccaattttatacccagtagcatactctggtactctaatataacattcctggtgttataatgtctagcaccattctgagctctgctctcaggccgagtagaggccccatctatattttactttagctcctcagagggccagtgagccttagtgcaaattaatataaatattttgtgcagaataacttaaaaataatagtaataaatgtacatttaagtgcattgacttccatgaccttaacaggtaaaatcatcatgcatatcatatctcaattactgtgtgactaatccaaatggataccaatactgaaactagaaaaaaatgtgaagtagcacacttcgctatatctgcactaaaatgatactaaagttcttaatcctgcagcagagatgagaacctaggataacatttgtatagttaccccttctcaagtgaacttttatcaaaatgtgattttaaatgaagagggaataaagaggactgtgcaaggcaaaaagaaaagacagaaatgagaataaagaggcaccacaatagcatttgggttacaaaggcctctttttaaaactaaatgttttgctgaagcatagcatggttttaagaattgatgcaatgacgttgtttttaatccccaagtggttggtctgtagccaaactcaagcacttttccaggtgtgacatctgtatcacctatgtgtcattataaaaggagagtaggctgggcgcagtggctcacgcctgtaatcccagcatttcgggaggccgaggcgggaggatcacaaggtcaggagatcgagaccatcctggctaaaatggtgaaatcccatctctactaaaaatagaaaaaattagtctggtgttgtggcgggcgcctgtagtcccagctactcaggaggctgaggcaggagaatggtgtgaacccgggaggcagagcttgcagtgagccaagatcgcgccactgcacgctagcctgggtgacagagcgagactccgtctcaaaaaaaaaaaaaaaaaaaaaggagagtagtggctagaaagtgttcagtgctgctctcaccctcactgtgagaggtcatgttattggtctgagagatacattactagcagtggagatattaggtatttgaacaaaatgaagtggagttttgaaagttaggtgtgtttagaaagaacaaagagtaaatatattgatgggctaagtttatttcttttctactggaagatactagcattggccagctggctagaaatttattttctgacttttagagagaccaaaatgttttcattagcacctaaagttcataaatgtctaaacaggcaaaatgatgttatgtcatggcagttttagaaaattatctaacacgatgtgagtatgaatattttgctagattaaaacctttttttaaaaattgaattcctataaccacttcctttatttttattaggaagataaagctagagacctggtggttttactgcttataatttctggatgtggtactatgattcactattatttattgctagcactacagagaactgaaagggaaaacattatcaatgctctgtaccagaaagattgtgagaaggcagagtgcccataaaagtgaaaggtactttcttaggggagtttgcacaaacacagggaactctgaaacaaagcagccacaagaagcatactgcagcagataaaagattactaaaaattttttgctacttctccaccaaaaggttcccccttctcttgagtctgggctgacctatgactctctctgatccaaagagtagaaaagttgcatttctctgattagatcatttggttttaggaattgacagaccacctcaatgatttataccacctaaatcaatggaatgaggtggaagtgatactgtgcaggatccagcctaggccttaagaggcctgacagccttcccttttgctctctcaagctaccctaagctaccttgtcattgagactgtgtggagcaatgcctggcaagatctcaggtgtcccaaccatcccagcggaggcatgaagcgtgagtgaagccgccctgcgcatgctagccccaggagagcttcatatgactgcagctgggtgatgagtcccaaaggaagtctagtaggagacagcgacctgcctgatcctgagtgagatcgcagaatcatgagccaacaatctagtgttcttttaaatcacttgagtttggcatagtttgttaggcagcaatagaaaactaaacaggtacttcaaaagagtagaaaaattacatttctctgattctcagtgtgtgctcaggtttcaaaaggaagcctgctctggatataggttggttatgaagtggtggaaaaacaagccagaaaacattttcaaatgacttcttaggctttcttgcagctctttctcagggaatgtttaatgaacaaccaggaaattgtattaaactgctaaggagctcagaatggttaggaagggccaaagaacactgcgctggggtagagtgggaaatcactggatgaccattaactggaaaatcaacatggaatggccagcactaagaagagaggcagtaactactcatcggagagcaggcccatcaccatgcacatggacctcaggttaatcctcactcttccctagagggtaaaaagggtaactaagatttcagataataatgctatgggatagaatttcctgaaacagtgctaaaacccccaaagtgagaaactgctcatagtccaacatcctagacttattcccagaagccacttaatgtgactgataagaaagataaatgtaaagattagggttttttctgttggatagaagcccatagtctccaccctaaaagttaatccccactgttattcacaaacaccccttcaaagcagttctgagcataggcttggatgggagagggggaggttaggatggagggtgtttgcaaagctgtacagtaggtgagaaaggaatcttcttgctactactacaggcagtcgtagcccaggcatatccacggggcatatgatgcggattctgacttttggttcaagataacagactgaacacacatctttctctttaacaaggactttaaaatagataaacccacagcaatgaagagccccagagaaagactgttataaggacaagacaatggaagagaatgctagaatatggaatgtcagtaaaggcatgagagcagaggtatcatgactttgaaaagtatattccagagcaggagctggcaaactaagacccatgagacaaaacctgctgccacctgtatttgtaattaaagttttattggaacacagccatactctcttgtttttacatgttgtctagggctgctttcacgatagcagagttgaatagttgtaacagagaccatctggtctgcaaaacctaaaatgttttatctaagtatttactaatatttgaccctttagagagtttgctgatttcggttctagtgtcttcttggctgggagggcagcatggataggaaggactctcagttgctccacggaaccccagaagggctagggattcggaaacatctgatctgagtacatggaagatcggcttggccatttgcctgcatgcagaactcccaccacacacccaagtcagagaatgggagtgtctccaaaacagaaagaaaatgccccagagaacagattagactttcttattctgtccctgcttcataaccctaaataaaatctgactagtcttcaaactctgccaccaacgttggacccccaagtatctttataggatttcactcttaaatatggaaatctagaatcattagacatgtgagcaccacactctagtaaaataaaggtatgtgagaaaaagaggatatggataggaataacaggggactgtgtttgggaaaaatataatgcaaagtccctaagtgtcagccatgcaaccaccccactagacaagggttggaagacaaaaaaatgaccagaaaaagggagatcctccatagtacctaacatgatgacacttttgggggaaaatatgattattttaagaaatatattgcaataaagaaagagtataaaactccacaaagctgtttatgggaaacaatatatttatggtacattactgggctcagtgaacaaatgtacaaagccataatgatgcaaaaactatgcaaatttcactaaaattagtgtaaaactccactgggaggatgtaggagggttaccagatgctaaagcttcatttctttctaaaagaaagtaaatataggtcatgtctaaaccgttaaatcaagacaactgtataagtgtatttgttagaagtgtgaaggtagctaccaaaagaattgtctaaaagaatataaactaatccactgtctctgggattataggtttagagggtgggaagggacagggtggagacattttaagcatgataaatattttgatccttttttatttaccatgcacatgtactgcttcaacaattaaaaaaatacatatatatacacacatgcttattgttgaacactgcttctagaaacctggaatcagtaggtctgggggcacaggaaactgtatttttaaaaagctctccaaatggttctgacaaagttaatcttgtgcccttactttcagaagcacagatatagaggtagcgaccactgaaagagcagtgatatctacctgctcaagtggagaagtgccaggggctgaagaattctaggatcggctgggcatggtgcctcataactgtaatcccaggattttgggaggccaaggcaggagccttgcttcaggccaggagtttgagaccagcctaggcaacaaagtgataccttgtctctataaaaattttaaagaaattagccaagcatggtggtgcaagcctgtggttctagctacttgggaggctgaggtgggaggatggctggagcctaggagctggaggctacagtgagctatgattgtgccactacactccagcctgggtgacagaatgagactctgtcaagaaaaagatgatgaaaagaagaaagaagagagaagaaagaagcaagaagaagaagaaaagaaagaagaaaaaaagaagagaaagatgaagaagaatgctaggatgctcgcgagtttttctctcaggacactttcttgtgattttactaataaaatggataaatactaaaggaaggcaaataaaaatgaacgggttatgagttacttctaattcaacccctgcctatggaagcacttcatgaataggttagctctcttctctctcgtgtatgctgcaaaccacaagctttgattcaaaaattagcctagggaaaaacacaaaacatcatgtaaagagggaagctttttaactgaaggatgttagataaataactatctatcagactctgtggtttctgtgtaagccatgttacatcaaacttgatttttaaaatactttaaagaatgtaatcagggtctctagtgtttacaaatgattgctgggatgtgtagaatacttaataaccagaactcagaaggtttctgggcactgtgataattctttctgagaaaccttctggaacatcataggatcatcagggattggctcagtgattgtcaataagcagctgttgtcaaaaagcagccaaaggcacactgccctcattttctcctgttctccataccttcccaggagtcagtgctgactaagaaagaaataattcccaactctacccttgtttctcttgtacaggaccctggttcaaactttttggtacagaggatttttctttgtgcctacacaaactactgacatctttttgcctaaattagagatcacctagagctggagaagttgattaaaatactttcatgttgatttcaatgtcaaatgagactgctcaccttttcaataccaatgacttatcatttatatctgtagcatctattatttgtgttaatttttgaggttcatttgatatataaagtcattataaaaaagaaaattaattttgtctttaccatgtacttgtcttttaaatttcatccagaaaatgaaaaactggtttgttggtgcttcagtggtccgctacattgtccaattagcattgactaggctatactgtaaaagaggaattcagcctattcaaatttcatttcttcatttataaaagcatccatccaatcaccatccatccatccatccatccatccatccatccaagaagtacttatgagcacctgttatttgcccagcgctgttttatgtgccaggagcatgtaagtaaaacaaaatattagccatagagcaaacctctatgccaaatgggctaaaaattagttgaaaaattctatgagaatggttttaattacaggtatatgtgtatttgtgatattttggtttttttatttgaggatatatgactctatactgtctctgatgtttgctacaagtctaagtagttcatctttaccacttatgatgatcattttactccatacttcaccataaatccacactgaaggtgaaacattaatgtacacggtggcggcgtaccgctttttctaggcatttctcactactgtgcctctctgcatgtgctatttcctcttcccatgatcttcctcacttgtccacctagcagatatctgttcgtcatccaaaactctttcaggcatcatcttctctatgaggccttccctaagcacctcccagcagaacggattccccctttcctgtgtactattgttgtacttatgtacatatttttattatagcattgatataaatactcattaacatgtcactggtaaacttcttgaagatagaaacatttgtctcatttttgcatccctagtaatttgggatttgctagtaattagcaaaatatctggcacattcactaaatatttgctgaattgaactgaagagccattccctctattataacatgtgggatgttgcagaaatgtgtttttacatgtcattttaaattatctcacaattacaggtaaacattttatatttttgaatatttaacaagcattacattctgtttgattaaactcttttccaatgagagacattatcatccctataaaagcctaataaaattatacagttagcaatatactttaaaaaatttctgttgcttagccgggtgtgatggtgcatgcctgtagtcctagctacttggaaggctgaggcagggggattgcgtgagcccaggagtttgagtgccaccagcctgggcaacatagtgagaccccatctcttgagaaaacaaacaaacaaacaaacaaacaaacaaacttctgttgctcactcctcctactctcctgactttgtgccaatattgtggttattacgtacctattatattttgttacaattacgtgtttatgggcctgtggcccctcctagatgtgaactccttgagaaacagttctgtgttcttcccatctttatagccctggtgcactgcaatgactatgaaagggaggttcatagtcattgaaggctcagcaagttaaatgcatagaggactaaataggagacggtgaatagaattaaatctttggttcttttatcttgcctaggacctgctttgtgattatcttaaatgaagacaatctgctaaattctaaataaagctttgactttgtggttgaataaagctaacttagactgtgtgggtgtggcaaactagcaaaatgagtaaaaaagaaaaaagattttctattcaaatatttttattttgtcttttaagtttacactgaaataagtcttttctagttttgaaacatgaaatagtggaaagaaaaataactacattttttattctaaaaagtaatggatttgtgaaatatttcactgaagttcaaaagcactgggggagtctttcccctttcccaagatggaattagtcccacaattttgtcttattctaatcgtaggcaatagggtaatttttattgaaacatttgatgtttgtgaggttttggcaacatgaagatgtggatgctcagtaaaatatcaccaaatgaatggcagagttggacaccctctaactcactcttgtagaaaattatgtacacatgacttttataacagtagcgtttggaaacgtggtgagttagttttgaaacttcatctcaacttttaaggagatataatatgcattattactcacaaatgagtggcagtgacaaatataagggcaccataaaaagttatttatacagaaactatatgataaatggcaatacagcgttggtgatatttaaaattaaaaatgtcagatgaatacctcaattttttttgtttctctatacacaaaccactttaaaacccatggaagaacaattcataagtgtattggtcataaaaatggcagaactttttctccaaaggaattctctaatttttgtatctattagaactgattgagtttataaagttgatatcatgaactaaataaatgtgaaaaacatgacaatggggatagagtatattcctttagagatatagttattgtactttataatagtattctaaggaatttaaaaattacactataccaagaaaaatttctgaaattgaggcagtaatagcctaccaaccaaaaaatgtccaggaccagacagattcacagctgaattctatcagagatacaaagaggagatggtaccattccttctgaaactattccaaacaatagaaaatgagggaatcctccctaactcattttatgatgccagcatcatcctgataccaaaacctggcagagatacaacaaaaaaagaaaatttcaggccaatatccttgatgaacatcgatgcaaaaatcctcaataaaatactggcaaactgaatccagcagcacatcaaaaagcttttccatcacaatcaagtcagcttcattcctgggatgcaaggctggttcaacatatgcaaatcaataaacgtaatccatcacataagcagaatcaatgacaaaaaccacatgattatctcaaaagatgcagaaaaggccttcgagaaaattcaacaccccttcatactaaaacctctccataaactaggtattgatggaacatatctcaaaataataagagctatttatgacaaacccacagccaatatcatactgaatgggaaaaaatgggaagcattccttttgaaaactggcacaagacaaggataccctctctcaccactcctattcaacatagtattggaagttctggctggggcaatcaggcaaaagaaagaaataaagcgcattcaaatagaaaaagaggaagtcaaatagtctctttttgcagattacatgattgtatatttagaaaaccccatcgtctcagcccaaaaactccttatgctgataataagcaacttcagcaaagtctcaggatacaaaaatcaatgtgcaaaaatcactagcattcctatacaccaataatagacaaacagaaggccaaatcataagtgaactcccattcaaaactgctacaaagagaataaaatactaggaatacaacttacgagggatgtgaaggacctcttcagggagaactataaaccacagctcaagggaataagagaggacacaaacaaatggaaaacattccatactcatggataagaggaatcaatatcatgaaaatggccatactgcccaaataatttatagatttaatgctatccccatcaagctaccgttggctttcttcacagaactggaaaaaaccaccataaactttatatggaaccaaaaaagagcccacattgctaagacaatcctaagcaaaaagaataaagctggaggcatcacactacatgccttccaactatactataaggctacagtaaccaaaatagcatcgtactggtaccaaaacagatacacaggccaatggaacagaacagaggcctcagaaataaacaccatacatctacaaacatctgatctttgacaaacctgaagaaaacaagcaatggggaaagaattccctatttaataaatggtgttgggaaaactggctagccatacgcagaaaactgaaactggaccccttccttacaccttatataaaaattaactcaagatggattaaagacttaaatgtaagacctaaaaccataaaaactctagaagaaaacccaggcaataccattcaggacataggcatgggcaaagacttcatgactaaaacaccaaaagcaatggcaacaaaagcccaaattgacaaatgggatctaattaaactaaagagcttctgcactgcaaaagaaactatcatcaaagtgaacaggcaacctacagaatgggagaaagtttttgcaatctacccatctgacaaagggctaatatccagaatctacaaagaacttaaacaaatttacaagaaaaaaaaaaccctatgaaaaagtgggcaaaggatatgaacagacacttctcaaaagaagacatttgtgcagtcaacaaacataaaaaaaggctcatcatcactggccatcagagaaatgcaaatcaaaaccacaatgagataccatctcatgccagttagaatggtgatcattaaaaagtcaggaaacaacagatgctggaggggatgtggagaaacacgaacaaacgcttttacactgttggtgggagtgtaaattggttcaaccattgtggaagacagtgtggcaattcctcaaggatctagaaccagaattaccatttgacctagcaatcccattactatatatatacccaaaggattataaatcattctactataaagacacatgcacacgtatgtttactgtggcactattcacaatagcaaagacttggaaccaacctaaatgctcatcaatgatagactggataaagaaaatgtggcacatatacaccatggaatactatgcagccataaaaagggatgtgttcctgtcctttgcagagacttcgatgaagctggaaatcatcattcttagcaaactaacacaaaaacagaaaaccaaacaccacatgttcttactcataagtgggagttgaacaatgagaacacatggacacagggaggagaacatcacacactggggcctgttggtagatggggggataggggagggatagcatttggagaaatacctaatgtagatgacagtttgatgggtccagcaaaccaccatggcacgtgtatacctatgtaacaaacctgctcgttctgcacatgtaccccagaacttaaagcataatttaaaaaaattacactatacaaatcttgaatcagcacttaaaagacataaggtcatatttaatttcttcattgttttctagataaggaaattcatatttacaagttatgggacttatccaagatcatgggccaggcaagaaaatttaaaatcagactgtgaagccaaaccttgttcattactttttcatttactctgtgtaatttttgtattttatatgtttctgtccttagcaatttgcctctgtatttccacaagaaataaatttcagttgtaatttgagtagacatctgagtaattatatatgaaaaataatttttaagggctagaaaagactcatatattaaaacataatatagggacatatacagacctagtccagtttaaagttttccgtatgagatgggcatgtatatttcaataactaacctgggtgatatagcatgagaatattataagattaacacagattttaaaatattgtggctgaatataagttagaaaagtgtgaaatgttaatcacacccctaagaacaaactctagagataaattagaaaagtgtcaatctcaagagtccattgaatccagcaaacagaaggggtagtttaaaaaagaaggcaaaaattatattcaaaattgtttccaaattaattcaacttgatatttttaaacttaggggaaacataatttatgcttcatgcttttcctaaagtgaagtgacctttgtcttttgaataaaaacacaaaagaagctccttatatttgccttcagaaaaaaagatgttgcaaaacaattttctaaaccatgaaggaccttacctgtttccatttttccatcctgtgctgcaggcccatccggaatcacacttttcacctgcagaaactcatcaggctcgtctccaccaatgatggtaaatccaaagcccatgttgctcttttttagggtggtgctgaggaatgttcccttcaactgggatgcatcccgggtgaagagtggtttttctacattggccaatataagttaaaaaagaaaaaggcatgttcaagtcaagttctcagacaagagaaagccagcccctgagcagcgacaatcccaggggtaaatgtggggggtcttatacagcaaatgcaagcaggtggtgactgcaagaggagcaaaactattagaacttcctacacacgaagagcagtcccaagcatccagggaaagatgaaaaagctgtttggtttggagacagactttttgtcaaatcagtttccactcattaagttagccttcttgtgcttaaaaaaggctgtgtcaacaggctgccagagccttctaagaaagaggacaaggagcccaaatcatccagacaacatctggatctgttcctgttgttattgtgaaagattccaggtaggaggtatgtgtcagtggccgatcctaaactaagccttgaagaaataagggtagagaaatgaaatggacatggacttgtgattttttttttaagtgaataagagcacaatatttcagcatgtgcaatatcacaaacagagaaacagtggaatgtgatcacatactcaaaggtccagattgcttagaaagagtacctgtatgtggaactgacttttgtttacactgctctattgtgagatactataaagataaccagataaataaattgctattggctccgatagtgtttagtatactctaaaatgtgagcaaaaggcaagccaatgtttttagatataattatgaatgtaaaggtaacacattttgtcacaatatgttgatagattcaaatcatatgcccgaataatctgaataggcactgcatagatttacctgctaatttgttatataatatgattttccagctatgatctgtaataaatatattcctaagtatagtaagtgttttaaaaaataatagtcatactaggaaacaattaatatctgctttaaattccatcacagataaatattttatatgattcttttaaaatgtgttatatttaggtggtctgacttaatatttttaacagccaaattgtatatggtaactcagttaagtattctgcatgatatctttgttgttacattttgggtgacaagtaataaactctaaaataatgagtcattctattagacttctgcttttactgtccgcttacatatcacatgtatctttattaaaaacagaggttctttaaaacataaataaaaaccacatataatcctttctcctatgttttctttatcaaattaatgtttatagttggagataagttcaccaggagacctttacattcatttaattatgctgcagtatatggcgtgaaaactaccagcaggcaagcctaggcctcccgactctaaaggctgttttgtgcttttatttagaagctcactagctgtgaaaagtttgtgcagcaactcatcccactacgtggctcccaggtgtagtcaggtcccgcaagcagccctgggacataccgaacagccagggcctccctgctgggtcgcgctgatagtaagacaagtcattcacgctgcgcgacctctccggggcagcacgggggcggatggatttgggcctaggtaatgtccatgaggagctgtctactgtcacaaaggagaacaagcctcattcttgtgcttggtcttttaaggacaaacttatgagtctctatgaatctctcagtttacagtgccactataaaaatccattaatctccacgtggtgacatgctgtacattcctataaagtactgcctgtggctataacttcatctgcggttgctaaaggcattagtttagagagaatgcaaacatccagctaaagctaataggaaggtctggagaaagcaaatcaatttttcaaaatggtccaagctacagacatatttggaagagcaggcagtttgacagacaattttccctttgaaacatcacatgctgacaggtatcatacctcggaaacctggggcctgcaggggctttgttccaagttctgtgtggggcatgttatgttgctgtagcttcctttttgcttccaggacaggattttcaaactgtgttcttctatttatgtggctaaaaaagaaaatttcagattaggataaccgtggggcaaagttatttaaaagaccatatgtatggctctatggagagcaggtgattaagggccaccttatctgattacagtcaagtgcctcacccagcacgcggtcaggctcctgactgggctggcctgtgtacaacacacatttctgtgacaagtgctgagttttcaaaggctctctcatatgttattctatttacattatgcataattcagccaaaagaactagaatgtgcacttgctttctggtctactgtgttcatttgagatgagtttaatatgcatgaaactaagtggtcaagaaatgaaatttatactgaatggtattgaagaaaagagcatcacctgagctttgcaaagtccccatatccaacaggataaatgtgaggtaaattcattgatagagtatagcaaccagagtctgcactttttagagttggtcctggattgagagactgggatccaggagaaagagtttgcagaagttacagaatacatatgtaggacagttgatgctgaaatcaagcaaaagtagagaattcatattctacatggtgagagggcaaatttgtaggtatcagacgcagagtggcttgaagcaactgttgcccagctaaactgagagcttatagtccaagcaaactgtgaatttctgtatagcaggctgtttgaaatgcagagttccttatctgtggggagagtagaaaccaacaaatctgcttttagtggtgggcctatgctgctctttctctaggatataaacatcccatgagagggctggcatatacattgatacatagaattatggcaggcaagcatgaagaggagagaaggaatggaagagaaactgacaaatactgagtacttaactcttggccagttactatgtatagttttcctcagtgaagtttcataacaacccagacttgcattccaattattcaccttttaaaggcaatgagactgacacatggagagatcggattatttgctctaaatcacatgtctcgtaagtggaaaggctggacttggccgggtttatttctaaactgaatctctgcacacttttttcttttggatatacaatttcacattggcatgtgcacacacacttattgtgtgtatacaccctgcacgtccccaacataaaccacttacagcttcagaaaggaaaggagacagaagcagcaacatctcaacaaccaatttccaatactatgaatcagatcatttcaaagcagttcccagaaacatggtaagtcaaccgtaagatctaattctttcctcacgggagacagggtaaggtagctgcctgccccacaggctctgcagttaatcagtcctgtattcaaattccagctctaccacttgactagctatgtgaccttggttgagttattgaaactgagtcttagtgtcttaatctgtaatagcagcgtaatgcctccttcttggggtggttgtgaggattaagtgaaataatgaatattagcacatggttttgagtacagacatactcaataattagcagcagcttgtatcatcatcttaatcaccaccattactgtcatcatttttcatccataagaaaggctttactggggaacttcagaagcactgggaccttgctctaactgcctttggtgctgtttaggaagggagtgcttctaacagtgctctttgttaatgaaactcatttgtaagaggttcaaagtacaaccatctatgtaaaattattttcccactggaaataaaacgttattgtaatgctcttgttcaccaaggccttgtgcatcatgactgtggtgcacagtgaactaataatatctgtgcctgtaaagcatgtgagctgtaaactctaacactgccaccctgttttggaaggaccagagtttgatgcctgttttcccgtttctccattgttacataacttccttaccaaaatcctttgaaaccttcctattacttaaacatatactgttcctgattttgccctcactcatttctgtagcttcacctttggctgcatcaccacatgtgccctctacgttgaacatacttggagctactttgatcagtgaccctctatcagacctcttatctttccacgagagattcagtatgtaaatggtgcagcacttgaagcaagacaacctgggtttcaggtggcatcttgggcaaatttctaactctctaagcttcaatatctttatctgtaaaatggggacattaatagctacatcacgggttgctgtgaggataagagaattgtttacaatgtttacaatgtttgtatctcccttagatacccagggagaacccaacaatgaagttatggttgttatttttttgaggtacagttatttcttattactattattgaagtgttgcagtggttattgccattattctaaggatgtttttcctatctctcctgtgtctccttccctcactcctcccagccacattccctgcctgtgtgatattcttccaccttgggttctcagaaaactttgaacagacttctctcattgcagtttattcacttaaaaaaaatccatccactgaagcatttatcctttaagtaacaaataatccaattacattctttaagttatttaaaaatatacaattaagttattattcactatagtcagtattcacttattttcttatactccacttcatcattaagaagatttgaggacaacaacaacaaaagtaaacaaaattaggttgaagttagttgaatcaaggtgggagatcaatagaattgataagataggttcctatttatttactagagttttgttgcaaattagctttcagcttttaagctgctaattcaacaggagagagaaaccaattatactattaagagtatttaagatgcaccgaagccagttgtttagaaggacatagtattcctaagtcttattgacattcctttccaaattttgaataaagagatttctgtgacgtagtatacagcatcctaaatgataattttacaataatgaatttcacaggctatactaactttattaaaatgtgttttaatgattaattttcatgctgatttccttccctagattgtgtacttctatatacaggatacatgtgttatttatctttctgtattgagcatctaatacagtgaatggaaaatagcttttcttgttaaatgactaaatgatgagtgtgtgttttaaaacatttattttcaaacatatgtcaataactttaagaaaccaagaaacagctttgaaatgtactaggatatcaacttttcttgtttcctatctgttctatatccgttttgctaggtcattgttcgtcatatgcataactttatccttagaaaatacattacaaaaactttctgggatgcagttatgcatacaacccagttcctccaactttccacctgcatgtaattattttcttagaaaagttaatgtgcagccacctgctttatggtcactatgttgaaaatattccatttaccatcaaaatgagtttctagagttcacagagaatgagaataccaatgagctagtttggcatgccttggaccccacagacagcaaaagcaggatatggctatagcaccataagctaattgctacagaacatttccattgtcacaaatgaagtcattcatttgaaacttaaaatgctcacaagctctaaaagacttatcacaaagaaatgtgattgtagctgaatagaaacttgtcttccttatgcttccaaaatgaatagtttcaagttctttcagcaaggatttgggggtcttacaatgtgtacaaaaagatgtgaatgacaaatgccatccttctcattgtttaggctctgtgaggtaagtactagctatttcatctagcttccatacagaacaagaagctgggaagctaccaagagttcttgctatttaattatatctagtctattgtcatattttgctaagagaatcttgagctattaaaagctaaaagcgtaagagtcatattctgaagtgcgtatatcttaaagattccgttttctctttacagaagggaaagactactgatgagagatgcttccaaattaaaagtggcaaaggactcaggatatttaaggatgagattccattgcctgatctctttgtctttacattcacttatctgcagtctgactctctcctctcaccatggaatggaaacttagagtaagttcgtatgtggcagtgctttgaaattccagatgcaccagagagcttcaaaaacaaacagaaaacagaagactcagggctaccctaaatcaactgattcataatttcagaatgagatccacaggcattggcattttttagatgaaagaaagcttcccaggtgtctctagtgtgcagctacggctgtgatcccctgagttagaagctgagaatgtgtgaagaggtgttgcataaggagtatcttgcctgataagatttatgcagaagcctctttttctatatgtggcctcagggaggattaggaaatgcaactttgctcctgaagaggacttctgccctcagaagtttcagacaagcactgagggaaggaaatatttgcagctgattagaggccatgctgccaaaggtggtccctggtccaggtcctgtttgcctgccattttcttcattgtggagaggaaagggaggaattaggaggaaagtcttaaatactgagcccatcagtatgcacaggacaggtaggctgaaggttatcaaagccattccccgaccctcaccatcaatgctccctgtatatctatatctcagcctgttcacaacccaccttgcttctcctggggtttttggagacaggctcttttagtgcatagtcgtggatgacacctttgcacctgcaggttactatcctgctatcttgacttcagttaacatttagaaataatcaatgtggaagagagaagggagcagcttttaagtggagactgtgtcacagataaaatgtttccaaggtatccaaggtgtctgtgctaattatccaagacatgaggtacatagtgctcaaatatttactgaataaatacatgaatggagcaaggccagcaggaaagaggatatatctcactgttttccagcttcactctcctgtaaaatacgcattgtgggcagggaatggtgacccatttctgtaaccccagcactttgggaggcttaggtgggcagattgcctgagcataggagtttgagactagcctgggcaacacggcaaaatcccgtctctactaaaagtataaaaattagccaggcatggtggcacaagtgtctgtagtctcagcttgggttacaacagaaaagtgtgaataaggaaaagcactatattagggatgaaatgtgggagcattagacaagcagcaactcagcattgagagagggagtgagaggactggcttggggcttggcgttgtggctcaggatgaccacaatgcaaactggcttcttttgggcttcctgaatgaacctagtgtggatttcatcattgcttggaatccctaggctttctctaaccccaattccaattccccatctctgcactgttaccaactcccatctgaacccctagactacagctgaactagcaggcaaacacagacattgcaccctccctgactatattttattcattttaatatgagccttgggaagacttcataattttttctctactgtcatgtttgaataaatggaataaaaacaacttcatgctttggaaactgggaggaaaataaccctagaaggatcttctggagccaaccctcttcaaagaagacaggatagtataattatgaactcagtctctgtagtcatgatgctcacatccaagcccctgcacatcctaggtatgtaaccgtgagcacatcatttaccctttttttgtgcttcagaatttttcacctgtaaagtcagataaaaataatattcaccttacagagttgttgtgcatattaaatgtcttaaaatgggtaaactacttaagaacagtgcctggatgtaagtactcagtcaatgctaactatcatcattcatcgcatatttatttcccaaagtctcttgactagacactatggttgataggggagggacaaagatgaatcaggcacatagtctagcaggggagagaaaacagggacaaaaaagaattatgatgcaaaacaaggttacataatgcaatgtgtgccttacagggctttgaaatgctgaattttagaagtactagattaaagcctaatgttttaaatacgttattataaaatatgagctttgaataaatggaaaaatggcatctattttacttggagcattttttaaaaacagaataattgaatcctgcctcttgaaagatttcttcccaattctaacacttaagtgataattttccttctataaacgtccattcattatttcctactgtacctggggaaatgtcagtttgctttgtgaatgtgaatgggaagattgagtcattcacacgttaatttctcctgctcttcctggacatgagggtgtctatgttggggatatagtatccagctgggaggtggaatcatggccaactgagaagaatatccacatattggcactgaaactcttacagctgagtctgtcctctactccacactaggttgagcttctcaaaatgcaaattttcacataaatgagatctcttccctccctcggtcgtaatgctagttatttagttaagacattaacctgtaatgtgtattttatatataaaggaagattcatcactaagccattactcttcactaattccatggaaaacttcgaactaactcctagcagacatggccgtgtgcaccatcaatcatgtcatgaagcacccaggacctacaaggtacatagattcaacttcaaaaaattcagagccactaggcatgcattaaaaaatgttgttttctatcgatcccttttcactcccataaagtatctctctaaaatgttattgctgagtgcaggaggagatcattgttatcaaaggtatttctaaccttttgcttctagattgagtgaaagtagtgaattataagttcatagaataggctttagctaaaggaaaactaaaagactacactatttcaagatctttctgtattagagacaagactaataagtcctcttctactggtgtctgacaatctgactaagtagtttaagtcctttacgtctcatatataattccattgattcctcagtattctgggcactaaggacacaaaagtgaacatgacaaaatcctttccctcaggaggctcatgctccagtgggggagacacacaagttggatgaccaaccatttcagtttgcctgggactaaggagtttcctgggatgtggggctttcagttttcaaacagggatatcctgcataagttaagatgagttactcattctagaagtggtcaggaaaatataacacaaggcaaaaactgctgaaatttgtatgcatgacgtaaatactcagagggagaaaagacaacttagtctgatggctcagggaaagcttcacaaaggaagagacatgtaaacagactgtagaaggatgaaagtattttgctggttggagaagggggcattttaggaagagagtagtagatatagaggtgctcaataatattcaattctgcctacctagagtacaaggctagtgcacacagacatgcatgtggttgtgtatgggtggcaatgtgggagcaagaggcgtaggggagcggatggaagctacaagactggaaggacagttctgagtcatggtatggagttttgtttagtctgaagatctccctacttccattgtgaccttagtctaatggaactgcagcttttaaggtctccatcttggatgatgtaccttattcctgaacttgggagcattataagatgagcttcaacacacatcaaccaagtaggaaagctgtggttctccctagaattcccaagcatttctgcatcatttcctggctaccttcagtgtcctaggtattgttttcacctagggtatgaggttgaattagagatgttccatgcgtatgaaaaagtcatccagggaaatagccatttctgtgtacaaggaagggtgagaatagtctgacttgtaacatactctatgttgaactggatttctatttcttaataaattacttatgagttgctaaaatgtgcagtcacaatataacttaattgaactccaaaaatacacattcatacataatggtaagcatacacagccatggatacaggaatcctttggagcttgactctaaggagagtcagagaattaccaaggacactcagaataccgggcaatggcaaaggcaacatcactgatgtctgggattatccaggaaggagggaatcaggagaagaatgctagtgaggggaaattgacaagactggggacaaggctgtggcagattatgaaagtcaccaggccatgaaaataactccaattccatataatacccaaattccaggtttccaagaccaacattcagagatgagaaaaatactgaaaaagtattattcttgactactgagtctttatgaccacatagagcaggaggaaatcaaatatatagcaattccttttatatgctagaatgggatgcaagagggattagaaaacacaaaaaattaagaaaaaaatacttttgacgagttttagggagaaaaggatatattgctggatacctagaatctgcacagaatctttaaataccttgccactaaatgtgaccgcaaggtctaggagtgagcaggaggctacaattctgttaggtaaggactctgggaagatagaagaggtatggagaaaaagtaggaatagaggataaaggttcagcagccccaagaacagagaaaggtggcaataagttgcttcagtgttgtttttaatagattggtttattggggataggtattgtgacagagttttatataattaacatactatgtctaaaattatgccattactagaagatcaaagctttggacaaatgagatgatagtttcatgtaactgtaatgggggatgtattttcaaataacttgtttgttcttttccataatacagatttatatccccacagtgggctgagtttgtgtttttcattctgaagctcttaataaagaacaggaaaggtgtgatgttggatatttctgaagaaaattccatttgtgcacttttaaagttaattccaattcagatttaaattctgtttaatagatgccacagtttgctgaaagaaacagttgcatgaagaatgaatgtcagccttgtaaaaaaacaaaggagagactaaagggaagatagtggatggcagagtgggatgggaactaatattcaccgagcgaatactatatgctgaccctcagtgaaataggttgcatgcttttaattcacttgctcttcctagagggtaaaacattttctgcagatcttacattaagcggcagatgcacaaacaaagcctagctccgtgtactgccaacatccaagaacactgagttaggtgattctgcttcaaatatacacttagcttttatggtgaaattacttatgtatgtacagacatgggctatgtctggtaatctgcaacacacttcagccaggtgattctcaatttctttttatcagttttcattacgaaattggaaactttaaaaacattgtgaactacctgcttactttctgaagacaaaaatgtgaaaatacagatatattaaatatattttttaaagaactcagtgatcacgtgcatagaaacagtgactgaacgtgttttaccagaaaatgtgtgtgtgtatgcgttttacatattggagaaagtgagaaatgaaatggtaatgagggcatgaatgaggagtcaggagactgggctttgtgtaacattgctttcaaaccagaaggatctgttccaagggttgtctttcagcttcccttagggcaagtcctaacatcaatttcttgaactctttgcccttactgactctggaagttgagggtgggtcatgtctctggcaattatgataatgataataaggtgattctgtgctaatattcatgaataagattacagttctatgtgagggagaatggaggtagtcaacaataacaaaactatgtatgtctcgtctcaaacttataaaagaatgctgcatgttgtaggccaggttcagttcttctgagggccagtgatctaagaagaaatggagggagttgttaaaggatatagacttacagctagataggaggagtaagttctggtgttctacaccactgtagtatgactataatttacaataatatgtagtctcaaacagctagacggaggatattgaatgttcccaacacaaataaattataaatgagatgatggatatgctaattaccctcatctgatcactacactttataagtatcaaaacatcactatatactccatgaatatgtatacttattatttgtcaattgaaagattttataaaaggacatggaaacatgttaattagcaaggaattttttatgtaacagggtggaaccttgagcgctggtgggaactcttcccaaacacccacataaaagtcacctgaaaggggtacacttctcaccccacctgtgctatattcaccaccaaaccttggacaccaacaaaggcaaggaggtgccacttgactcttggtatcctcaatctcactgagattcaccaaagtgaaagccacttccaatgagtctgagtggtccttctcttccatctttcagaccaaaccagcattttgggtttaagctacaattgaagattttgtctaccactcactatctttgagaaattcccctaatgtttctgaactgcaactgcctcatctgtaaatattctactcatttcataggactgttttgaggagcaaacaagataaaatatagaaaatgtttaaagatgaagcactgtataaatttgattttgacattcttggaatattcagggtctgggagtcaagtgcaacttaaatatggacagtgtgaagtctcttaattcttgtcctgggctgcaacaatatttttatcacctactagcttgatggtctggcttctttaagtttcattttctctgtttgtaaaacagcagtaatagtatctcccattaagcactgtggtggtgattaaatgagttttacaaaatgcctaatacataccaagtgcttaataatggtagctattaatatttttttctctgggttgattaatagttactaaataagacccccttggagataaaatttacatatgaggtcagtgccccaaaataaattactaagccacactagcaaaaaagaaagacaatcattcctgtcattttatttatctgaaaatattattcacattattttgatgcccaattaaaactggagaaagtgaagtaagaataatagaatggaggggccctgtcaaccttcatagctgagtgttgtgcttagtggaaagttgaattaagatctttacatgacaacaaactcaacaagtagtgcttaataagctttcagagatttgttaccttatgataagtttgagactaaatttatgcaaaactaattttattagcacaacaaagagcctttttttttcttttgcctttagtagatccagttaaccttctcaaacacagaatggaatttcttttctttacaattgtagtttggcttaattgtattaaacttaaatgtgaaatttgatgataaaagtttctatgattcacccatttttattatacaattaactcagtctatgtaatataatcttatctaattaaatatgaaatcatctgataaacactagtaataaataatgtttaatgatgtcattttttattgttaaaaaaaagaaaaacaggtttcctttcaaatgtgttcagctttgacagaagttaaaaatatatctctgggctgggcgtgatcctgggaagtcgaggctgcagtgagcagtgattgcgccactgcactccagcctgggcgacagagcaagactttgcctcaaaaaaaaaaaaaaaaaaaaaaaaaaaaaaaaaaatatatatatatatatatatatatatatatatatggacagagagaactatctatatctagctatctattttgcccccaggtggctgctgaagacagcagaaagacagaacctggtgctcagtggccaaggccatcttgtgggccacccggcagccatcttggccaagtgggttctgctgggaaggaaactggtggttgagcaccacgagggcatcaacatttctggcaatttctggagaaacaaattaaagtatctggccttcctctgcaagcagatgagcaccaacccttcccaaggcccacccgccccgccattcctgggcccccagcgcatcttttggtggccttgcagaaccaagtggggccaggctgccctggaccaccttatggtgttttatgggatctcactgccctatgacaaggtggttcctgctgccctttaggttgtacgactgaagcctacaagaaagtttgcctccttggggtgcctggctcacgaggttggctggaaataccaggtagtgacagccaccatgggggagaagaggaaggagaaggccaagatgcactacaggaagaaaaagcagctcatgcggctgcagaaacaggccacaaagaacgtggagaagacaaatgacaaatacacagaggtcctaagaccgagggactccctgtttgagaccagaaaagactgtttattcctcatgcttggcctggcctacccttctgccattgcgaccttgggatatgggggagcctacccttcctgcatcaccgccctgggatgtgggggatccaagggcagcaatataggtgccatgggcagcctgggacttaagctgggggcaagggaagggccttagtcactgcctttctataaggttattttaaacagctctaagatttgtacaggaataatttgtctatgacctacttgttcaggacagagttttagaaaaccaatagagcaaccagttactttggttttaatattggcaaaagggacctggaacattaattggagggagccccgcctcgtgaaaggggcatctctttttaactcccaccttctcgtgctatactctgtggctgttataatatgaaaaagtgcttagggacagcatgatcttactgttattcaaaggatattatagagaagcttagactaggaagatgtgtgaccaagaggtggcaggggtcgcccttgctccttccctgtattttgtgaccagaatgaaataaattactttcaaagaaaaaaatagttcttatccaccttttttgttcataaacttatcctttatctttagaaatgcccttttaatgttaatatcagccctcatgtctttggatatcaagtatatttatatttttttcctacagcttggtaaaaagaatccatgataataattcgcccttctgagaggccttctttccataacactcacatgatgggattgttaaaatcattaaaataaaagaatggtaatatatgttactgtccaaccaaacaaaaagtagaaatggaaagaaaatgctttaaaaattttaagtattctttgatcagcaactgtaatgagaaaatgcagaggcttacagaaaaaaggccaaatttattcttgttaacataaagtggcagtgagttaaaagagatcttagcaatcacctaatccaaaccattcatttaacaaataaaagccagagaggttaaatgtaattttgcactaacctgtaaattcaaaattgtggatggaaaaaacataagctattactaacattgtgatttatgacacacaaaaggaattttgaaaaacattccctgcatattgataaagagatgaattatagttctcatgtggggatgaggtagtaatgtattttacccagttagggtaaaacatcttctgtttcattattcaattataggatgcccaaagaataatatcagtctgcattggtttgacttcctcagtttgactaagttccttcatacctttaacattgtcggcatctctttaggctgaatgtgatcacagttatgtatctattaaagatctagaagatgcaaatgccagccaactactttaattccagaaagaattattttccaacaccaaaggaaaaaaaagtggcagtgttgtttaatatgccagtcaccaagaggataggatcttgaggaaatgttagggtaattttgactcagccattttcactttatgtgctaactttagaacttaatctcagtctaagatatgattccaaagtatgtaatgatacagattgttagcatgagacaatctgcagttcacgcacaagaagcagagcatgtttaatctcgagagaggaaaactaataagctatatgagctaactgtttcacaaataatagaataatcatcatctacctgtcatagaacactgccttggtgagtggcaaacaggattgtccaatgaaagatgctagcagtgttttctgggttgcctagcaatgagctacctgggacaggggtcccctcttccagcaggagggacagcactgctcacgcagctcacatccagctccaaaagttgtctgcaactctcttaatcaacaattccccaagttcagactgtcttccccgccttcacaaggccattctcgagttctcatggtcctataaaaatgatggagtagaaggaaggagcatggtccttctttggcagcagagaacatggtgtctccagctgtgagcattcctgccctctcttcctgggacgtcaaggggtcagggtctgtgtactgcacactgttaccttctgccaggaagtttccctgcttctgtactaccctgtgtgctattgtgctatttgtctatgcttagcctctccagaagtgcctaaacaagggcctgatttgttagattcataaaaaatgcttgggccaggcgtggtggctcactcctgtaatcctagcactttgggaggctgaggcgggtggatcacgaggtcaggagttcaagaccagcccggccaagatggtgaaaccccgtttctactaaaaatacaaaaattagccgggtgtggtggcaggtgcctgtaatcccagctacttggggggctgaggcagagaactgcttgaaaccgggaggcggagcttgcagtgagccaagatcgtgccactgcactccagcctgggcgacagagtgagactccatctcaaaaaaaaaaaaaagcttgaagacaaatacaacccccctcccccccacaaaatgtgtttatgttgcagttatctttatttacaaatatattctcaaagaaatgttggtgtgagaggaatggttcctttgctttttattattggctttaggacaaagaaaataatgtttgagagttataaaaattgtttgtaaaaaagaacatttatatacataactgatgtcaaggtgaataattcattgttatttgtaaaagtccatctgcaattaaaccaatttaaacttctgggtgcctaaaacattctctatgtggaaccagaagatttgttaagtaaggttgttgataagatgtaagagtcgctaataaaagtgtatttaattacagagtcaagttttcatcccttcagtttaagggtggcggagtatgagtaggatagagagcaaatgtcgattctgctagaatgagccagcaatggtgaagtgtctcccagcaggaaaaacgacctctaacttcagaaacagggagatgaagcacctccagatcttgcctggatggtagtggtgagaagagagactggacgggagacttcttttcatgtgaaaggatcgtggtataaaaacatttgagggggctgggttcggtggctcatgtctgtaatcccagcactttgggaggctgaggcgggtggatcacttgaggtcaggagtttgagaccagcctggacaacatggtgaagccccacctctactaaaaatacaaaaattaaccgagtgtggtagcgcacacctgtaatcccagctactcgggaggctgtggcacgagaatcgcttgaacctgggaggcggaggttgcagtaagccgagattgcaccactgtactccagcctgggagacagagcgagactctgtttcaataaataagtaaataagtaagtaagtttgagggactctgtcatgcaaagtaaaatggtagttgaaaagaagtattgggaaagaaatcaagagccagttgaagttttcatgagtgagtagtacagagggtcggggaggtaagtgggaattatcaactatgaactatcagaaaagttaagagcatgtgtgtggagctaggagaccccctaacttactgctgggaatcttagcgactcatgtctcgtgaggcctgatgactggttttatccaggctaggagaaatgatgccccaaattataaaatcagcctgagtcagctagaaggacgtaaaacgttaaaccagtcataagttaaggtcaaataagttaataaaaaaactagctctagttcagttagaggtaggacactcaatatttgttttgatatccatgctccttttgttcaactataaagtggagtttactgatttatgcttgttgaatagaggaaaatatgttgtaaagtataaaaattgaacaaacttattaacataaaaatatagctactctactgagaggctgtttttttgttctaaatggcatcagcatcgcttcgaccttatcagtcatattcccttagaaaactcagttaactccttagagatttgatcttctcctttgtacatgttgtgactgtcatccgggatgatggatgtaaaagcatattaaaataaaagttaaaataaaagtagaagttaaaataatgccttacacattggtatatctactattattataacaaattcccagctatatgagatgatacatattctagataattatgacaatataacctccttatgaatgactgaaggctcaacgcctttggaagccattttctgcagctacggaattgttaataattctgaggaggccggccgcggtggctcacacctgtaatcccagcactttgcgaggccgaggtgggcggatcacgaggtcaggagattgagaccatcctggttaacacggtgaaaccccatctctactaaaaatacaaaaaattagcagggcgcggtggcgggtgcctgtagtcccagctactcgggacgctgaggcaggagaatggcgcgaacccgggaggcggagcctgtggtgagctgagatcgcgccactgcactccagcctcggtgacagaccaagactccatctcgaaaataataataataatgataataataataataataataattctgaagaaacactgtttttattcattgtggcatactctggccatgggattatatgtttctttccaaatcaaagtttctcttagaattgttcactttttgaagtatactgtaatcatgaaagtattgaaaaagcaagtaatgccaaaaggagaagctttctacatattattggtatatacaagattaaaaattactaacatttattgaacagttactgaacatacctatgttaagtgctaaataccaactctggaataagaccgcttaggttcaaattctggctctattatatagtacttataaaaatatctatagctcagtttccttacctataaaatagggataataaaacagactttctagagtttctggaaagattaaatcagctagtacatgtaaatcacttagaataatacttggcatgcacgaagtgcacaataagcgttcctcccctcccctccccttcctcatttctttctcgtcttttcctcctcctcctccctcctccttcttctctataatctgcctactcaagatctcacagctggcgagctacagggctagcacactgtgcaactctgcagcccatacttttggccactaagtggccaaaattgatgtgtgcaaattctgtttataagatttagagctttccttagtgagattttaaaagggtattcttttatgtttatttctaattggaaatgtttcatatgtttactgactttttataaactttaaagttaggaactttttttcctagaaaatttagaaagctactcaaagccatgaagcattattaagataagatattgagttcaagttctctctaaccacttcccaacttgctacctcatgatggatactcaccactaaccatgaaatgaatgcaattttccatttacattaaatgttacattcaagatattatgcagtatttttcatactttctggaattgcatacaaataatgttttatagtagcagatgtgtgacatcacatgaaaaacttgtaaaacctttacatgaaaatcacacctgccagtctccactatcattttaactacagttatatggtttgcttctctgtctctgccagagaaggcagctttgcatgaaagctgtcccagcaaatcgtgtcttctggaccagcagctagttaagcaaattgtgtaactgccattaaaaccaaaatgtaccctgcagacataatttcactaaagaggagagagaaccacatttgtacaaaagtcacagctgttcaactctccattttgcatattgttattaaaaaattttcctatctttatgaacagtgacagttacattcctagttagcaattttaggacttcttaatacgtagtgctaagtgctgcaccatcacggatttggtgtctgtcaggaaaaattgggctaagttctttctgctgctacatagagtgagaacttggtctgtttacacagacagcagataaaatttaaaaagatgttgagtagggcccattgttttctaaaatagctgtgtgttgcctctactaatccaaatgagggccaacatttctatgttaaggtccaaacaataaggattccctttctttcacatcttgctctcggtggccatgttgtccagggctactccaaagtggtgggtaatggagctggtggctcagaatgcctgggtcagcagcctgtctcatgaggctctgcatgcagcatgacctcacattgttgggcattctgctgtagaacggtacgacagggaggccagggaggagatgttcttgaggaatccctcattcttctccagggatgggtcccaaagccttgttcagaccattatgggttataaatgcgaaatttatagcaggcattttgggtaagagtttggagtctgggctctgcagtcaaactgcctgggtccaaatttcagcccctcatctcaataatgtgtggttctggataagttacttaacttctttagccagggtttcctcatctgtaaacttaagacaatttagctcattatcactatagagagaattataaatgtgatagaaactgttaagcactgagcccagttaatggcacatactaagcactcaataaaggttaacaatttccatgacatgattatgacctttctggttcttgaatatattaaacctacaatcttaaaattgaatttgcaggggatagaacagtggcatagtagggtaaagtcagttatagtggtcaaagcctgctcaatccaggtttctcattttctagctgtttaaattctcttctgctattgattgttgcaattgctatttgcttgtctgtggctgagaggaaaatgtgtgtttatgcaactgtgctagagacattacactgatttcaatctgatgtcacagagcccaacctgtaacttctgttcccagttgttggtctatctgaagagaggtgctaactgctaaattggacctcttgtgtccatgcacgtaagctttttttgctactgggttggaaggtggaatctttttcatatcttgtaaagagtacctccaattgtatgaatgggtgtgtaattaaacataagaatgatagctgtacagagaatccactgctcattatcactaatggcattagtaaatcaacattttcttgactatatattaacacaaaagatattgcttgttatattaactaaatattaatattaccaattaaaaatataattccttaagatattaatgctatcactataattatgaatggaatcttaacctagacagtttttattttatatttataatacatataccgaaaatgtggagatagcaacttaacttagactagacatttactaatcttttatggtaagaaattagttgactttcttcttccaacaaaaacactctacatactgaaagtgatgaataacctctatgtttacatatgtattcttatagtttccataaagaaggctactattcagaaccaatatataccttgtgaaaataatagtgcaatagagatgagatacagaattaaaacaaaccatgtaaataagtgtattccaattaaaatatttgacaagatttttgggatgatggaagatatcccccatctcaagtaatgtatacatcatatacaataacaggtattttagttatgtttatgaagtttttcaagaagatgtttccaataaatattgggataatattctacttaacattgtctttaagtttgaattatctgtttatttgtctcagttttctgtgtggcctgctacacccacacacctaattactgacactggtcaactctataaaatcatgtaatggggacaagaccatgacaaataatagaactgaatgtaacgggaagaaaattaaactattttgacccactgtgacctgtatatacaacctcccgatcacttaaaatctaaaactattaaacatgtcagcctgatctaattatagaacacatgactgactacattctatataatactctgacaatggctgtgttacatggaaaatgaagttgagaaatgtacacagaagtataatgtaggcaaacacacacacacacacacacacacacaaatttgaagtacaaagataagaaaaattttcgtttagggttacagccagtgtccaatttcataattagttataaaggatctaccagcagcagatcttcacttgcagaacacacatctcgatgatcaagaagggatgaagcatagctttctgacacaggggtgtcttgcctctctgttagatgattaggacagagaagaaaggttttagttaaatcctctcctgcattggaagttagcttgaaaggagctgaagatatgaaaaaacaaccggaagaattaaaatagggcaggggccagcaaactacgacctgcaggcaagatttgaccagctgcctgtttttgtaaataaagttttattggaacgtagctgatgttgctgatggttgctttcaagctacaacagcagagctaagcagttataacagaggccgtattgtcctccaccccaaatatttgctatctgggtttttatggattttgccaacatatggactaaggagtggttctttttcaatgattctgtgaggaaatatactaaagataagatgtgatatgcctcacactcagttctctttccttacatggaatttccttgaatatcggatgtagtaggcttagacacagtacagtttgattcagtgaattaagacaagctagcatttatttgaaatatttagtgttatatttatttagggaccgtaactatgttatttaaaacatgtaggtactttaattcatcagcaatctagtgggacacagaggccttataactgtttataaatgatgtccctttatttttgcagttagagatacctctatgtatttatcttactttttttgtatttgttcagtgtccatgtgacaccatacattagatactatgctagcagattgcatgtggaaaatgagctgaattcaccttgactgtgaatctggaaatgactgtggagccaaaattggggcttttccaaatgaaaatgatgggtgaatgtagttaagacaagtgctcctgagggagatactcaagggcagagagcacacagattttacttatctgtacattttcagtgccaagaatggcatgacacctaataaaagctcagtaaccgtttttgaatattgttacaaaaacaatttagcactaaagccaacctgtaactcttgaccatctgtaactattaaacagaatgtggttggaaaaaacaaagtaggatcttgatgaacaatgtgaaagtcttttgtttttcaacctctggatttcttgggtagtatttcccataaggaatatgtaggctttgttattcacccaaataactttaggaacattatacgatagataagaatgaaaaacaatcgtctgtttggagagagttctagaaaaataaatcacatatttaacttttgaaaattatgaatattacttgatttcccaagaaaaatatgtgtatataatttaaccctgaatagtgtatttgttccgaataaaaggatgcatggggggataattcataccatgacaaattattgcaatgtaacctccaataggtaacataaaagtccaatgtaccgaaagaatactgttgatttggaatgaggtcccaaaaaagaaaaaaaatctaaattttattttatttttcaactaaaaaatatgtctgattcatttaattgacttcgaaatctgttttaatagaacatctcatttgcacaaccagtcagctcccaacattttgattgcaaaatgaaaggcatttactttgatatctttaattatcactcatttagaggacagtgtgaaacacactttttcaattggtgttttagaatcgttgagtcaaaggaaaggaatgacaaattagccagctggagaggaaagaaacagctagctagtgctgctagtcttggtggatacttcaaagtaagatgaaagggaaatgaaggggctgtgagccacacatgctcaataaataaaatactaacataatttcacaacatattaataacaagttaatatcacacttagagacttactcaacataataagtgccataaatgggatcatcgattttttcccagccatatggaagctctgaaaaataaagagttctttcagtaaataaagaatatcacaatttctaataaaaagtaatataatttaattgttcatggattgcagaaatggtctgccaaagtggaacaaagcattcagagtcagcagcaaatttcagaacatattatagaaactataagaggcactgacttgaaaactggcagttaaaacacagagctctcttctctgcagatacactgctcggtctagccatttgtctcatgccaaatagtaggatggcatgtcatcacgttatcaccatttagtgcaatatagaaggcaaatcgctttcctgaaagtgtatatgtttctcttatttatttgtattgctaaaggaggatttcaggacaaagaccacattttcaaaatatatttctgagaacagcaaattgtttctgatgactgaaacaaagacattataaattctcaattgatatcccactatttgagatggtaggcttgctgttactccacatgggtcagaatttgaatgctgccaatacactctttgggcatattttaaaaataaggtataaaattgtgaacatgctttccttgatattatagttcatattttcaattctccatagctaattttaattcacacacacacacattaaaaaaaatcaacaatactataaatcctattacaggcaaaaacatgctgtctgaaaactaggctttgcttcataatattgttttccaaatacaccaaggttttataattattaactcctacaaatatgaagaatgctgtatttttcttggtagatatgaatttttacatatatagaaattgaaacctaagatatattgacaagtttaaatatatttcagtgaagtttaaaaagttttattattatagcaataatatgtatcactgtagacaaagcacagttatcaaaagaaaactggaattaccagcaatcctgccacccaaaaataaccagtgttaatatttaggtgaatatccttcaaataattttctatgcatatgtgtgcacatacttttaaaagaaattaccacatacagtgcatattacttttatagccttatatttctacttaacagaatatcaaggatgtcattcaatgtgaatgtgtgttaccgcacaatatcattttcaaggtggcaacagtagtcggcagcacagctagaagctgtgtaattcatcatttttctatttttgaatatttgggactttctagtttttacctgtcatgtgtcatctgtattggacctactaaaatgtaaatcttttatcatatttctataatatagtatggaaaaattcctagatgtgaaattttggatcaaagggcatgcatccttttattgtttttgacatatattaccagatttctaccttcccaactcataaaaaagtactaatttataatctcactgagagtgtatgagtgattttgtttctctgtaccatcaaattaaatacagatccacaattcctcatccaaaacttttaggaacatatatgttttagaatttagaatttttgcaattttagaaagttaacacagtgcaagtgctttctctttcataacactctaagtagagttggggaaagcagtttataattgaacatatgagtatttctgcagccaaagatatgattcatactaagaaggataatttaaacttacaacaccaaattttagagtaccttaagaaatctttctttcagaaggataataagagtaaacctttactgagtattgtttgtggtttgagtactgatggattttctaggtactaactcattttattatgccagcaactcaggactcaaaaaccctgtactctggttccagtaaacttacccaatttaaatatcaattcagaaactctgtttaacaaggcataaacaccacttaatttagattaagaagaataactctccagatggttttcaccaaatcccccaagctattggcaaattcatctagtaaaaaggaattcatttgacaagtatctattgagtgccttttataaacagctcattcaaaacccttttttataagcagctcatccagaagtaaaagaatatacagaggacagcaattaatattatggatatttattattaatttattaatatggttcgatacatggatatgtatttataacaggtttaacatcatcttatgaatgcaacaatatataaaacaatcatgttcaataaacataaagagtaaaagcctaacgtagttaacttatgaatacagccctacttcttaatgccaatgccatatggaagcatttcatggtcaaagtttgtacaattatcttttataaagtaaatgattatttcattttaatctgagtaaattactagttctaagcaatatatcccagaagggcagagttcattgattcttttctttgtcagatttacaatgccaaatttcttgggtacaatttattatatattatactgtcccacttgttatcatgcagtcctcatcagaatttagggagaatctactttatttttcataagatatcaacatgttttgtgtgttcgtttggttgtttcagatttccaaagtaaactattatttcatgctgaaacaaaattatatgtcatacacatttgtgttttaagaactgttagaggtcctagactcacactttgaggcaaaattatacactagttctaactttctgttagaaagagcaccatttgtttcattttaaatattgtcaaggaattgatggaggaaccttacaggaaaccaatagcagatacacgcattgcttcatttggagcagaatggatgtaaaaatatacaactaatgtttaaaaagttgtatgtatatgtatatatgcatgtgtacctgtgtgtatatgttggcacatgtgtgtttgtgtgtattcttttattgacattttgcttcaaaaacaaagatttaacctagtatgctaatgaaaaaacacaactttcacaagtttttcttcacttgtaaaaagacaagtcatcaaaaaaacttcttaacattatacactgaagagtacacatctagatgatgaaaaatgaaaaagttaagaattatctttcactgtgaaaattaagctatttggacttggattagtttaaaaaaacaaaacaactgctgcttctttaaattaagctaacagatgagaaaaagaatttccaacatcgcactatttgtccaatcaggcaagcatgtagcttggagcttttgagtcctaggttatttagaatactgtattcaacaatacttgacaaatctgtggatgattaaggtaacactgatgaaagaataacatacatgatgcaacaggaaaaaataaacacttgagatcagcaaggttaatgttgcattaagaactgttttaattgagattttcttcaggccatggaaccatggggcaaattcagtgattaaatattcctaccatgaaaaagtctagattaatttgtagtcaataatatcagcttggaaaactggaataaaaacaaaagattaaacacgcacctagctttgcctggattctggcatagtcagcatgctatattttttaaatttaattgtgcttcccaaatattatttcatttatttatttaatctttagtcagctacactttcattacagaaaacagagacccctttatggtagctcagtaagaagatatccacattctgatattatgcactgagaagggcacagctttacctctgtagtatacttgtcaaaaataaataaccttatgtgtgtgtattttttaacagtcggggttccgttgtgttgcccaagctgaactcaaacttctgggctcaaggaatcctctcccctcagccttctgagtacctggaaccacagtgcgcatcactgtgcccggccaggaatgccattttgatcatgagaaacatatgacaaactcaagtggacagatattcaataaagtagctgacaagtacccttagaaagggtcaaggtcatgaaagagaaaaactgactgggatattaccacagatgaaggagaatatggagacatgatgactaaatgcactgtgggataataaattggatcttgaaccagaagaaggacattagtggagcaactggcaaaattcacataagatttgtagattaggtaatcgtttatacggatgttaatttcctgggttcaatgtacttatgaaagatgtaaatgttaggggcagctaagtgggagttatggggagccactttgtagtatttttgtaattttttagaagtctaaaatagcatcaaaacgaaaacatggaaaaatctaggtcacttactcttactattggagggctcctactcacactttattttaaaaaccttttctttccaacttttacttgagtttcagtggggtgcatgtgcaggtgtcttatctgggtatatttcatgatgctgaggtttggggtatgaatgatcccatcacccaggtactgagcatagtagcacagagcagtttttcaactcttttccccctccttcccttcaccttctagtagtcccaagtgtctattgttgccatctttatgttcatgaatatccagtgtttagctcccacttataagtgagaacatgcaatatttgattttctcttcctgcattaatttgcttaggataatgccctccagctgcatccatgttgctgcaaaggacatgattttgttattttgtgtggctgcatagtattccatggtgcatatataccacattttctttatccaatccaccattgttggacacctaggttgattccatgtctctgctattgtaaaaagtgctacagcaaaaatatgtgagtgcgtgtgtcttttggtaaaatgatttgttttcttttgggtgtataccctgtaacaggattgcttactcacctagtagttctattccaagttctttgagaaactgtcaaactgctttccatgtaagtgttcccctttctctgcagcttcaccaacatctgttgttttctgactttttattaatggccattctgactggtgtaggatggtatccttttgtggtttgagttgtgtttctctgatgattagtgatatggaatatctttatatgcttgttggccacttgtatgtcttcttttgtggggtgtctgatcatgtcttttgcccatttttaaataaagttatttgttttttgcttcttcaattaagtttcttatggattttgggtattagatttttgtcagataaatagtttgcaaatattttctcctattctgtagatctttttactctgttgatagttccttttgctgtgcagaagctctttagtttaactgggtcccacttgtcaatttttgtttttgttgcaattgcttttgagaacttgaagttggtttgctagtattttgttgaggatttttgcatctatgttcatcagggatattggcctgtagctttcttttttcattgtgtcttgccaggttttggtatcatggtcacactatatattaatgtgaaatcagatacacagaacactggattcattttgatagaactgaaatttaaataaaatgagaatgtaggatttttgcacttatattcttcttttacattgtgttgatttttttttttgagacagagtctcgctctgtcacccaggctggaggacagtggcgcaatcttggctcactgcaacctttacctcctgggttcaagcaattcttgttcctcagcctcctgagtagctgggattacaagcgtacaccactacacctggctatttttttttgtatttttagtagagatggggttgcaccatgttggcaaggctggtctccaactcctgacctcaggttatccacctgccttggcctcccaaagtgctgggattacatgggtgcaccaccattcccaggcttctgttgatgtctttcaataggtatattcaagagaatgacttttaattttgctatcttaccttttatttattttttgttgtctttctgctccctagaaaaactgggtaaatacaacattcatgtttaaatgcagctgcatcctgggtcctagaagtcacagattcagtaacaggagtgttaaatctagagtcaggcattgttcctttcttgggaggcggtgtcttgtatgggccacaaagcattggttatgtaaattcatgtaaggttgtatggaggtctattctggtgggaagaccagaatgggcctccttttacagaaaggcagcccaatttaggaatcatgcaatgtactaagatatcagagacagaagcagaaaccaaaaaccagaaaccatatccttcaaccctatattattttatgttgactagcctttttaaaaaaaaaacaaaatttgaggttcttgtttgattgttttagaggtaatgactgtacaaaagaaaataaggaacataaaaaattcccataggttaagtaatgtagtgtatagtgtattatatggtaatagctacttattacaaaatcttttcctctaatattttagatttttgctatatacttgtatacaaactggggaatataactaaattttcttgtaaaagttatacagcttttgctcctagttggtctttaggagtttgaggaatccttaatataagtgagtttaaaatatgaaatatgtttttagaattaacaagaaaaaggaggaagagaaagatcattgtgcaaggataaaatatagaatagatgactttttgctaacaaaaggtattatatctttgtctcttttttcctttattcaaaaatgcatttgatactataaaagtaaatcctgaatatattctttttttttaaaagctaaatccatacattaatgaaagctaaccacagtcccattacctcatgtacaggtaaagctgggggtgtaacttttcagacctttttccatgtatcaaggttccagtttgctcctttttaccagaaatctttattccattcagtcaggaaaataaacaactaaaccaaaaccaaagaacaaattaaaaaacctaaaactgaatatagaaaatgttgctcctttatgttccgctctctttcatctttctcagatattgcctacatgggagcacaaacccagtcaatatcatggaaatgtaggctatgaagtctttatttatgaactctgggtataggagatttattattttacagtggaaagaaaaactagctgagctgtattctacagtgatgatatgtaattcatattatcaagtagagttaacctgagtacttaattccaccatattataataaaaaattaaaatactgaccatgattttatgggctggttgttgatgaaagatgtgattgcagagaaaatttcaaataaatttattcattaatatatcttaccaaatttaatagaaaattgaaacaattttcttggcagctattgatgtatgaaaaaatatatagtcaatagtattttggggattcagaatactatctggagaaaagccatgaacttttgcaacactaacttaaatatgacatctatgtatttgagatggtgacaagaagcggtggcagaaaagcatggcactataaaggatgttgtctggtaaagacttagcaagagtcgtccttggtttaagtttgcaagcggcattacaaggtcaaaacatgatgaacctagtaggtttttgtctttatatttctagtaatctgtagaaagggctggctacaaagaaagatttgggaagcaactatatatggaggacttcaaaatatgcatctccagcttcaacttctagaagcctgtgttaatctacccatccaactatttatcatcatcattatccatttgaaaatgcttatgtaaacatcctggactctattatagtgtaaaggctgatatatagattttaacctctctacttaccccttaaaaacagtaaatatctactaagagagaaataaagccacccataacctacacctacaacattatgaggagaaacaaaatagtatgaacttcaaaagttatatataagtagggatgtgaatgctccaatccagtgcagccagctagtgccagagtggagactgtgcagaaaggagggtagggtgtagcaggtgtgaggtaaggtgggaaaacagaaaaaataatgctcagaaaggtaaattcccatcccgagtgaagaaatgtttctagcaaacctgcttgattagaacacaagtatgaagaattgaaagaaagggggttgacagtgagcagaataacattcttgggaaggcccagcttctgaagaagagggggatgatgttagtgggagagggggctgttccttggagacttggctatgaaggaaaaaagtatgaggtgaatatcaaatatctgcagataagttcataagacacaccaactactctgcaaaaaataataataataataaaaaataaaaaataaaaataaaaaaggcatccactgaggaatctgtacttcatgaaagcaacagaagggggtgctcatgaactaaaaaatgtagtaatccaccaagtcctttacttttgcttacatgaaactgttatcgctggtctaggaacaaaagaaatatcaaactaaacaaaaaaaaagagcagactatttatagaaagttactataagaaaataatcagaaaatgatagccaaaacaattcagctaatgaaaatttctctcaagagaaaacaaaaacaaaattgcaaacaagaaagttgtaataaaacctagagatattttgaaacaaatacttataaataaaaacaccactttgaatcacatatttaaaagctttgaacattaatggacaaagaacagacagatagtaaaagatagttgacaaaaatgatgaaataaaatttaaaaaaatctgaaatgaccaaattacaaactgccaaagagaaaatagagtgaacctaaaatataaggactattgaggaaagccatgacaatagccaagagaatgtaaatgaaataaacaaaaaggtaaaaagaatcagagaggtcaataatatagaaggtaggtagagataatccagcatatgcataattggaatacataaagaagaagaaaatagaatagaactaatacataaaactgtgatccaagaaaaatttccagaaataaaataactatatctatatattgaaaagtgttgtcatatagccggaaaaattgtccccagtcaattccaaaatacataccagtaagacattagactttaaaaggtagagaaaacatggctaaaagataagctccttacaatggaaaaatcaaattaacattaaatctcaggaagaacgaacacatctagaaaacagtgaagcagcattttaaagactctcaaagaaagtgtgagctaagaattttatatccagccaaattgtacttcaagtattcattgtgcaaatacacacaccccccaccatataaacagtttattctacccaagatcccttcctgacacatacctacttaattaaaccaagctacttcgaccaagagatattttgaggacaggactaatggtaatcattcaacacatttaattgtagatctaagcttatatgaaaggtggggacaaagatagaataataatatgtaaatgtcttatattgagacaatatagaagtaatataatttaaaaagagaggagagggaaaaaaagtacaatggccaatgagctcacgtactattgcttaggcaacaggtgagagtcaatgaatattatttaaaattgacaattgaataagggcctcatagaagttaccagtacaaagacaaacattagaacacaattaaaagccatcctaagtaccagggacttatagaagttatcagtacaaagacaaacattagaacacaaataaaaaccatcctaaatacagaaataaataaaaaagaataaataaagtagggcacatagagaaataaacagtcatattataatacgggcaataaataaaatatgatagagttcaaaccaaacatagaattgaatgtaatttatctttcttattaagattttctatctggcttataaagaaaaacctgactccatcctgtaaagatgacacacatttaaagaaagtgactcagagagctaaaaataaagtttgggcaaagataggcctgacaagaaaaataaaacagagtttacagtcttcctattagatggaagaattcaagtcaaaagctttaaatatgacaagaaatcccactttataacaataaaggtcacaattcagagtgctctacaacagttatcaatatttgtgtaccaaataatataaaccaccttcacaaaacagtaactacaggagctgtgaggaaaaacacactaataagaagcactttgactattttcagtctaagacagataaagttgacaaaattacagatatgaaagaactaaatatcataactaggcagatcttgtggctcttactccctttctttccatccatctttctctttccaatttcatactacaataatagaaaatacacatccttctcaaatatgcatggaacactcgccaaaattgttagattacaaaaaattcttaagttccatgaagcagaaatagtgcaaacaataatcctgaccataatgcaataaaatgtagatgttagtgtcaaaattatgatcaaagaaaatttcatctagaaattaagaatttgaaataactcttggtccaaagaggaaatgttaactgaaattgcatattttctaaaatgaatgaggtaaaatattaaataaaaaatctgtagcacacaattaaaacagtgaccagaagaaattttataatatatacacataggagaatggaaataataaaagtaaattcaaaatttaaaaagctataaaaagaacaacaaaggaacctctagggacaacacacacacacacacacacacacgaggaaaacaaataataaaagcaaaaaaattgtacaaaatagactatttctttttttaaaaaagcaaaataaacactagctagcttaagattaaaaagagttaagtcatatataacaaagcaagaagtaccaagaaggaagcaatagtaaaaatagccaagatttggaaacaaccttaagtgtctatcaacagatgaatgagtaaagaagatgtgctatatatatacaatggagtactattcaaccataataaggaatgagatcctgtcatttgcaatgacatggacaaaactagagggcattatagtaagtgaaacaagccaggcacagaaagacaaatgtcacatgttctcacccagctgtgggagctaaaacttgaaacaaccgaactcatgaatatatagagtagaatgatggttaccagaggctggtaagggtagcagaggaaggggggatagttaaagggtacaaaaatatagttagatagaatgaataagatttagtgtttgattgcacaacagggagactatagtcaacaatattttattgtacatttaaaaataaccaaaagaatataattaaaatgcttgtaacacagacacttgaagggttggatatcccgtttatcctcacgagattattatgcattgcacgccgatattaaaatatctcatgtatcccataaatatatgcacacactgtgtatccacaaaaataaaaataaagtaatacctggcacaaatatatgctaacaaaattttaaaacctaaaatgggcaatttcttaggaaaatataattgatggaaatgagccccatctttctagcttaattagaaagatttttggtcaatttaccatagtaatcttcaagtataaaagaacaaatgaaacaaaatgaggctaggtacagtggctcacacctgtaatctcagcattttgggaagctgaggctggcggaccacttgaggtcaggagtttgagaccagcctggccaacatggcgaaaccttgtctctactaaaaatacaaaaattagctggccgttgtggcgcgcatctgtaatctcagctactcgggaggctgaggcaagagaatggctttaactcaggaaggagaaattgcagtgagttgagatcgcgccactgcactccaacctgggtgacatataagactctgtctcaattaaaagaaaagaaaagaaaagaaacaacatgagtactaggggtaaattcctttataatccaagtatgaggaaaggttttcttactctgattcaagctcgacaaatttaactacataaaaacagaaaagaatatcttctatagctcaaaataccataactaatactaaaagataaccgatgaactgggagaaaatatttgtaacatatcagtgataaagagctactctccttaataaagaacttttttaaatggaagggaaaaaaacctaaccacctaatagaggaatatgcaaaagccaggaatagagagttcacaaaaagtatatgcaaatgacccttaaatgggtaaagatgttctacctccttcattatagaagaaatgcaaattaacactatattgagacatcattctctaacagacacaaaaattcaaaagcttgacaacacactcttagacaaggttgtggggaaactgtcccctcataccttactggtggatggacaatgtggtacaacctctaggaggagaatttggcagtagctaacataaccagataaattttaccctttgactcaaaaatctctcctctgagaaatttctctacagttttatcttcaacaatactttttaagcaaacaaacaaagttattcaatgcgtcattattttaatagcaaatcatggaaacaatctaaatacccaaccagagatgactggttaaatgtacatgatatgtgcagacagtacagaactatacagctgtaaaatctgtgaagaaagtctctatgatctgatatgtggttatatgcagatcatattgttaaacaaaaacattcaaatgttcgttttttttaaaaaaacacaggaagaagagccacaaactaaagaaactacttaactataagaggtggtatgaacagacgagtgggagagatcagaaagggaatgagacttctctgagtatatctttttcatatacattaatactcatgctctcttattcaaaaaaaaaatgtaaaataacttgaaatctaatacaaacaataacaaatgagcttacatgtgtacaaaattgctaaccagtcaaaaaaattaagtcaaatcttgaagaaattagagattctaggactagggtttcatcgtacagcaactcaaaaggtaaaagcattaaaaactcattgaggttcaaaagagaaataatcatatttatttgtgcaaacttatggcatacacaagaaattttgttacacgtatataatgcatagtgatcaagtcagggtattagggtgtctaccaccctagtacaatacaattttaagtacagtcgccgtactctatcgaacactgaatttattccttctatcttattgtacttttgcaccctttaacccacttttcttcagcctcccctcaacttccactcacctttcatagtcttttatctctctttccattctctacctctatatgatcacattttttagctcccacatataactgaggacatatgatatttgtctttttgtgctggcttactccacgtaagataatgacctcaagttccatccatgttgctggaaatgacatgatttgacttttttatttatgattgaatattattctactgtgtatatataccacgttttctgtatcagttcatctgttaatgaacacttaggtttatttcatatctttgctattttgaatagtgctgcaataaacacatgagtgtaggtatctctttgatatattgatttcttttgctttgagtagatatccaatagtgggattgctgaattaaacggtgattctattttcagtttttctgggaaatctccatactgtttttcatagtggctgtattgaattacattgccaccaacagtgtacaacagttcccttttctctgcatcctcaccaacatctggtattttttttgtcttttgaatagtaaccattctcactgggtaagatgatatctcactgtggtttttatacgcatttctctgacgattagtgatactgattattttttacatatctgttagtgtttgtatgtcttcttttgagaactgtctattcatatcatttgcccactttttaatgggattagttgttttttcctgtttgatttatttgtatattctggatattggtaccatgttggatgaatgatttgcaaatattttcttccattcaacatgctgtctttccactctgctgcttgttttctttgctgtgcagaaatttttagtttaacatagttcactttttcttttgtttttgttctctgtgcttttgaggtcttagtcataaattcttttcttagaccagtgtccaagagagtttcccctaggtttccttttaatatctttatggttttgggtcttatgtttaggtcattcatccatttgagttgatttttgtatatagtgagagagagggatccagtttcattcttctgcacacgacaattttcccagcactatgtattgaagagggtgtccttttcccaccataagttcttgttggctttgttgaatatcagctagctgtaaatatgtggctttatttctggattctccattctgttatattggtctatgtatccatttttataccaataccatgttgttttggttaccatacccttgtaatatattttgaagtcaggtaaagtgatgaccccagctttgttatttttgctcagaattgctttggctatttgtgctctttttttttggttccatatgaaatttaggattttttctaattctatgaagaatgacattagtattttgatagggattgccctgaatctgtagattggtttggacaatgtagtcattttaccaatggcattacctaacatagctttcataatgtaacatattttgtgagactttttcaagaaatatttattgataacctactatgagctaagcactgtgctgggcccgaggttagagtgacaagtcacaagatccatggatcagatagtttcaggcagagccagccaataaacaaataatctcactaattattaattcattacaatttataatatatgctactaggagaagtacatgtatattttactctacctaaaccctcaggtaatttataaacagcttggaatcataggctattacatgtcataggcataattcatcacaattgatttaaataatcctaatgcaataaatcagcaacacatttatcaattgaatgttttggggtgaatttacacaacagaacttatttttctagtgaagcagccttttcaaatttaatgaattggatgtttacaagaaaatcctactgtttaaaatctctggggccaactaaatattaacatcaatatagtaaggatttaaaaaaatgaaatttaaaatttacctttattatattagacaaactgaattctacttgggaatatgccttaatttcattttctatttaatatgcagccttgaagcattgtttaattaaaatggcacttagaccaacggatcagactgagcacaaacctagggctgctcactaaaatttgcagataagattagcaaagtctatgatgctgctgtctgaagcatctcccataacactgggtgtaagcagcatcacgacaattttacatgctgctaaatggtaacatcagttttgcttttgccgtgaaacgcatggatcctgagagacttgaatgctttatagataagcaagctgggcacttgtcaaattggggtgacatggggttgtcatagattccctactttattctaccaagctctgtgttttcctgttagaaaaaggaagtaatccacagacattttaaaaacggatgcatgcaaagaaaactcaataaaagtactgattgtcaacgtgatttgggtggaaaaggaagagaggaaaacttccacatttttagtttgtgttgtggaattcttttaaacattaacacaatggacaagctgaccaacctgacagtgcccatcttatccttgttccaggtggagataatatataattttcagcattacttatcacagacagtgtcaaaggcactgacagttgagagataaggcaggaaaatgcttttcccttgacatgaaaggatgactatttagtgtgtaactgtaacaatgaaatttctgactccctatttggtattaatctaaggcatcattgctgcttattaaaatttaatgaaagtaatgtccaaattcaaccattaaattgaatgtatatagccagatgtgtatgtggggtttctcagatgttctttaccaaaataatttcctctctagattattttggataatccaggtggagatactgaaatcacaattctttccatcttggcaatacagtatagtgaacgttgacttgaaagaacataagaatctttaaatttgaggagtatgaatgatgtaaatgttacacatataccttcatttaggttataattaattttgaatcatataataccagccttataaaaagcaacaaagtatctattaacacacattgtagtgggatctgttttcatatatgagcatccacttcaaatatggtcttttgctcaaagagggaagtagtgcgattatagtaaaaaccctaattttcctgattcaaacagagcaaaacttccccccctagctcaaacagtgggcaggatatttattccaaagacctggccattgcaatttatatgaatctttgccatttcagctctgtcccacctctgcagcattcctgggcagaaggactagattaaacatcaggaataaaaaatgtaatctcttcttaatggaatacaaaatcccttttgataaaattataaaatacaatagtgatatatatacatcactattttgcattactctctccatacagcatatatatattctctctatataataatgcaaaaaaagtagaggatttggaattaacagcatgcatcgcattactactttgtttcatggtagaaggaaacgaaggaacatggaaaaagctgtgggtaagatttcctccacagtaagtgaatctgcaaaatataaagggacctggaatcgaaaacatgatgcctgctgttcctgcaaggtttcctgatgcctaaaacatcaggaaaattcttggagagcacttcaccccagtgaaaaatattacccttataaagctgtcagagtctgtctcagcttcagttacctggcatgtaaagagccagtcagtcccacaaattaggtaagccctgtaggcttgtctaacatacatgccaagctttcaggaaatgttaaaagcccaagtggagctgtgatttgtacctctggtaacaactggactgtgtgtatatcatattgagcagtgacagtgtgatgtgatgcaggactcagcaactttggaagactctacatgcaaacacgaaaactattcaacagcactggtaccagacagggtagccaaacggagagctttagagggccccaggctttaatatatggaatcacataattttgtcttataatggcatttagaggcaaaaagcactaaaaatattgatttgtacctagaacaccaccaactaaattgtcattaattgataccattattgggtcaaggtgttaggctacattttaaatttggtctcagattcttctgagtttgcattttcagaattaaccctgatagacacagggcatatagattggtatgctactatagcgacaatagttttttaaacctgtgaatgtactttttaaattcatacttccttgggtgtggcttttctcctatttaagcagacatttattttaggagattttggtctgctcaagtggagatgtaaagacagagtcagaaatcaatgtgtgacattcatgcaccttgattgggggtaagatttggaggtgaggactcagggtgtgaagtctttacaactctaggcaaaagataagaactgttacatgaacaggtgtaagtcctactacagcagagaccaggaaagatagcaaacagcaggcagaccacagacccactcacatcaccataggatacctattccttttattgtttggcagcatcttggatggaagaggagaggagaaaccaattggggaaaagcctgacagggaatttgaacttgaaaattgacaaagtatttgtaccctccccaaataatgctgatttaaagtaaaagagacaggcaagtctttaattagtaagcttaagttttcttaccctccatcaccacaatgaaggcttcaaacaagatgatattaattacagaaaataaaaatagaccggatgtagtgtctcacacctgtaatcccagcactttgagaggctgaggcgggcagattgcttgagcccaggagtttgagaccagcctaggcaacatggtgaaaccccatctctataaaaaatacaaaattaattaggtgtgatggcacgcgcctgtagttgcagctactcaggaggctgaggtgggaggagcgcttaagcccaggaggcggaggttgcagtgatcccagatcacgccactgcactccagcctgggcaacgaagtgaaactctgtctcaaataaataaataaataaataaataaataaataaataaataaataaataaaataataaaatctattcttacacctgagttgtagtttgcaaatacccaacggctattaaacagtatgaagtaaaaatcaaattaggtatttaggtaagtatatttgacaaaaacattactggctttggggtcacacaaatatgatctgagtgttgggttttcttgcataagcctcagtttatttattctgcatgatgttataaggaatagagatatagagtgccctacaatgcttggcactcaataaagagtaggtactgctatgattattactagtactgttactgttgctccactgttatcatcatcatcatcatcatcgtcatcatcatcatcatcggtagtggtagtaaccataatagcagcaatagtaggacttgatggaatagtgaatgatgaagacattgggtccaaacttagagtgtgcggcaggtaaaaatcactagtgtatgtgtcccataattgttgaaagaaaaaggctttctggaactacctgaaatatggaaaagagctaataacactgagtgtagaaaatgaggattagaaaattattaagtaggaggagactttattcttttcttcctgtgggaacttggcttgaaggggttgggataaagagacatttagctaattgttaaattgacattagccatttggcctcagaaatggaagagaggacctgatttataaagaaggcactgactagtacaaagggattcaactggagtacatttacaaaaccacctgaaagcaaacacaattctgattatattttctatttaatatacacataaatgactatttttaaagatatggcctttttaaagaaaaatagagtaacaagcaagacaattatttcattagttcacaaatcagaatcacgtcggtactacaaatatagtccgtgaaataacaactataattaagataatagtgatattttcattagaacattctccttgatcaggtgactttttcaagaaaaattttaagtaattaaaaaatctatttctgctcaaagatcaatcagttattgttactcagagataatacttgaaagtgaaagataaaatctgtgttttagaattacagtgctagacaaaggatattttccagttggaaaataaataaaagatgaagaacatgaaagctactttatcagtgttaataaaattaacatgtactcagcaacttaatagagacacaaattagttctaaaactgctgtgatttatggttctgcagtgagaagcgagagttgaaaaactcagtaggaccagatgccacaagacagactggaaggcgctccatgggaggcaaagaaaaagagaaaacaacgagggacacaaagaatgtactattccatggagaaaggggactgctattgagttctgaagaatatattatgaccatctgttttctgtcttcttcgtggtgagaaacttgaagatagggagcatatcttactcatctttgtgttcctggaacctactgttaggtgctcaacacggacaagtgttaacggaatgaatgagatgatgtgtccgctgtggcactgggagagataaaatgttgtacctttctcagaagagcaaccctagacagatatttgggtagcacacggaattttggcttcctgtgatattaatacctttgttgtgattttatgctctttaataattaattcagttaggtattcttatggtgagagtgtttgctgtttgccccgcatttcaggtattttccaaagtgtgctggtttggggtagaggagagaagaaaaagttgacattggctatattctataaagctaatttcctaacccttgattgccctaacacagacgtcagaaaagcacatgtggattaaagaaaatgttttagtaaaaactatgagcaaaaccattaaaggtttagttacattgcttttggaacatacgtagactcttagtagcttttattccctcatgtggacactgtgtttttaacaatcagactaataatactatactttattgccttttacaaaatcatgaatgaaataataatactttgtgacatttcagaattttcttagtttaattttgtaagcaacaccatattttatgctttcaaactttttcttttatatttgacatctggacagaatctctcattactgagacagatcccaaattcctctcaaaccatttttctaagagtaatatatttaaacccccattagacatagaatttattataaatgaaagtgcccaatatcatgttttcaggaaaatacatacaaatcaatagaaaactcaagaaaattatagaaatggaagagattttcagatattatttggtttgtttccatttctcctttcagctttacatatggcacagcagagagaaatatggatcaatgctttcgttcactggtaatgaatttgaacattataaaatttgtatttattcaacatttattgaaaactgtgcagagagctggggatttacatttttctgtgtaaaggggtccatcgtatagttctctgaaggcacacatgtaggttgtcttgacttgggcatgttatggtagaagtggggcagaggtgctcaaatgaaggaatggccatttacagcagggattagaatgttggcaatctttacctgacaattcttactggtgggggtggggggtggaggggaagctactctatattaagaaaaaggagtatttaacttcaatagtgctacttctgtttctactgcaacacatttagtatattatcttttacattttccatgccccttcctgcctcacctcagttatttagcaccataggagtactaaaattagctgtaatttatataagttattgatgctatctatcagacactgatctcataaatgattgctttacatgaaacacctgatttgatcctcaagacaactcagtgaatggaaaactaacttttccaatgtcataactaaaatttctttgggtgagggtgggagatggaagtgctgaaatcccttgaaatatgctttctgggccgttttttcttaggattcctaaagttctaaatagcagtaagaaaatgtggagagccacatgcaaggaaagacttggcccctgtattcaacagccattacgtatccagcctttatgaagaataccccagaactctgaaattctctccacatcgctcttcagtcagagtccaaattcagcattcctaaatccctttgtattgaattccttgtactacagatatagtgaatatatgctttggttatacagaaagatatcaacatacagttaagtctgccagctagcattagagtcataatttaatatctagtatttatgcattcacacaaattatattcatgaggacacttagaagagaaacatttagaaactttaaaaattctctggcattcacatgataaggaaatatggatatatttggaagcctatttcattttatttgaattgtaatgccatctgccaaaattcactctctcaaaaagtactgcttttgacagcatcagaaagaaactttgtgtgaggaataggcatctatttttttacttaatttacaaaagacacattttgtttgtattcacaagggcattttgcaaattaattttacccaattaatatgtcattctgtgacaatgacagaaatatcagattcttaagtgagttcaaattcctttcagttttaactttgcaaagcatgaaaaaattatatggcataacacagaattttactctttcaatttatgataatgccatctttcccctataaagatgacactattggcatcacctaggcattcactataggtaatttctagtaatgactgaatttgtgttgagtcattcttacctgattcccactgcaatataaagtttgtattatttgtgaagtgataaatacatttacctgaagttagtgattgtgggaagaatgaaacagatcaagtttcagagaaattggctttaagatcttcaattccttgtaagcaggtagtgagagctgaaactggccagacatcggctcagctgttcgacagacacatcgtttcgactctgcatttaacatgctaaataagacagaagggatacaagagaagatacgatccttgcctcaaacactttaccatctacttggagacgtaaaagtatccacgggtaaaagtagaaatggatctgtaaggggtatttatgcatgaaggtgcaggtacgactagtatacataaatattgtatgatttcacaataaagctgccttaatttaagatgtcttcatgactttcattgattctcaggtagaatcatgaagaaggcaaaaaatagaagtgggggctgttaggggaaattgatgagttcaggtaaaagatggggaaaagtgtgtgagatagagagatacttttgcagagaatgggcaaaagtggtgtttgtaaattttaagataactatcctagttggaatagaagacttgtgttagaaaataataagagaaaagactgtatatataatatagatcaactaatggaatgtttttggatactaggttgaagagtctgaagtaactggaaaccattacaaggtcaaaaagaggaacaacataattgctacattttaggaaagacttatccacgcacttgtattcttatttttttattttttgagaataaatttatatttatttcgctcctgttgcttaggctagagtacaacggcgcaatcttggctcactgcaacctccgcctcccagtttcaagtgattctcctgcctcagcctcctgagtagctgggattacaggcatgcgccactgcacctggctaattttgtatttttagtagagatggggtttctccatgttggtcgggctggttttgaactcccaacctcaggtgattcgccaacctcaggtgattcgcctgccttggcctcccaaagtgctgggattacaggtgtgagccaccgcgcctggcctgtattcttaatatttacatcattagtacatagcacatatccatgtccaggacagtgcatggaatataatagtaaaaaaaacgattagaaccaggaggtgaatgggttattcaaggggacagctttctttctgtggctgaaactcaagtgtgttacactggggtttgactctttgatttgcagaatgctccacagcacaagtcgtagttggaggtgggtgttgcttctcacctacggaagttgaaaaggccagatacttgacttctctggaaacataggaacaaaggcatggacctgtggcctaggtttgggcaatcagacacaaccagatgggattttgaatctggagctagtgatgcaaagcagcggcaacagtggagaatgttttctagtggcagcagagactgccacagttagtttctgtgggcagctgtggcagtttggccagagacagcagtgtctttactcagctgtccttgtgagatgaccctggctggagtctggctatggaacctctctttgttttttcttattgtccacaactggttttgccacctttcttgtgattctgtaagctactcagtggcctttcaatgaatttgttttcttcataaatcaagcagaatccatttttgttgtttgcactcaagaactctgataaagcatccaaggcaggcataccatctggggataatgacagtaggtagagagagaaaaggacaacagtgagagacattgacaaggaagaactgacagagttggtaactagcaagacattgctttactattctgtttgcagtagtatgtgcacgacattgcctaagggatgaaacagaatgaaacaaaatatttgcaagtatataccctaacagatttgtaacaaagtgcttgcagaacatgtgaatataatgtctgtaagtgtgacatttcttcggaggataaactggggaagtaagtggtggtaaacataaatgattttttaaaattaaaaataaatctttctataaagggaaagagtaaagctagagaaccagaaaagctggcagtgtaattcagtttgagttcaaaggcccaagaaccaggtgaactgatggtataactcccatcccaaggccaaagctctgagaaccaggagttctgatgtctgagggcaggagaagatggaggacccagctcaagaagagagagggttaaactgttctggaagcacttcccagtcacacccagaaatactgtttcagcaactatctgggcatcccttacctcagtcaagtaaacacataaaattaaccatcacatcaccctacttatgactgccagagtaaatactggacaaatgcaaatccattcattcccttcccctactaggagagttttggtgctttcccctttgctctcagataaagcctaaactccttagaatgacattcagagtctgccatgacctgccatggtcacgtcttccccagggcatgtcctctgccacagaaacctttcgtgcttaggcttgccttgcaaccctttgactcctggcttttacacatgttgtttgctctgcttggagcccacttctcacccccctctcccatctaactcttctctctcctctacagttcagctacatgtttcccttcttaaaagtgtctgctgaccaccattcttagcaaaatagccactgctacatttttataagtcttggttcaaacattatagcccttaacacttacagggcaacggttaattttctcattttttttcaccattagacagtgagaactgtgggaccacattactcatcgatctttgcattgctatttctcaatggttgttgcattcccaacatccaggctttactctaagtacatcctcgatatgtacagttgcaggaatggaaagagcacacatgacttataaaacctacaagatttccatggccgcactttagctaattttattattaacaaggagttcttttttcacaaagtgagagaaggtctaaggtctattaacctgaactggatctacaacgaagctggatctttaagatacaatgtatttttgtttcctgaatgttcaatggtcaaaaggctagttcttataaaggagaataatttattgagaaacattcttggcttcagggagagtcaaacttcagaaagctgtcttgtctttccttcaactttagagtttcatagatagggtcctttagtgattcttgtttaatgtaagtcactcttacactatgggaaaaacaaaaaagaaagcagaaagataagcacagattttaaaaagaggataagatatagtgagagaaatagactggaaaaatatcctaaaattttaaagtccaatggaaaaagaagaaaaagggggaagcaagacaaatgttcaaaagtgtagagaaagctgtagctcatggttactgagattcaatcccaacagaaaattggggtttccttcagcttttggtttctttaccagaattcctttgtcttcatcatccagctccttaaggtcacaaaacatccaccagtaatcagccatttgaatagcaggctgagggggtagtctgcattttatgcatttttgcagcttaatgtagggaggaggtagaaatgacccaacgcagaaaccctattctgtaattcagcagtatagatattatcacagtttacttaatataatttcaactttgaattaacttggaatgctactctaagagaaaggttctaaaccggtgctactcttttttctattttatactataaattcagtttccttatgaaaaaaattttgggagatttatcatgaaactaaaaagaatggcaagaatgtgatgaacatgtagatagatacatcttaaatgtttcttttgggtaaagtggataaaggaatacagcatgggactaaaaatagatattatccaagatccagagaaaagttcatggaaagtcaggttgatccttacaagaatgcagacaatgttaactgtgaaaaattgaacaaaacctttttgtatgaggctatgtgttcttggatgcagaaaccacatgtttgtcattgttaaatctccagctctagcccagtgctgggaacatagtaggcactcaagaaacatgagtagaataaatcagcctacaggacaatttggagagggtgcacctgtagttttaaagcaacccttttaagataaattttcagatcaccagtataaaatataatcttcataaagcaaagcgattgtaaataagtagaaaccaggtacaatcataccccattaaaaaataccctcccatgtgattcaggaaaaaaatccaaattccacacagagactacagggtcttccattctgccagcctccctgacttctcatcataccacttctcctctctgttctctataggccagccacgctggtttttttcctttgtgttctctgaatgtgtcaagtccagtccatttttagggcttttatctctgccctttactttacttggaacgttcttccttagatgttttcatagctggctcctcatcattcaaatctcctttcacatatcacatgcttaccttgccttcaccatgctatctgaaatagctaccgcctttccttccctttttccaacaccttgctttattttattagcattttctaccatataacattttactatttattttctggttttctcattctaatcttcacttgagactcatggtactttgatacaaaggaagtggtctcttattcaatcaatggataagtgtgaacacttagaaatatataaaatgctataaaatgattcctaagtgaagagggtgatgtgatgtctgaaaggatcatggcacataaagaatgcaggaaagaaaagaacagagagagaaatttctgttcttgaccctatgagacagtattatatttattagttcaatatcgggtcgagtggtgccctaaataaatcatgcatattttcatttagcttcctagttggaaatttagcttttaggtacaattaatttcaatgtgagcttagagcattgttgaacctgatatcccagaccctgataactctataaaatggatataaaatggtagaaagggatggaaatggttattttgatagctggcaacagagttttcatgagaatgtttatattcaggaaactaccttaataatgctctttggtggtaaaaagtaaggccttagaagccttactttttaaaaagaaaccagaaagaaaagaggaatggtaaactgctctgcatgagaaatgaagataaatttggggataggaaaaagaagaagcagagaaggattgagtctataaaaatacactggcgtcaaggtggccagaccaaagtagttgtgaaagtaaaaatgtataatatcacatttgaaattcctacacacacacacacacacacacacacacacaccccttgtcttacattgcccaaaccatcaataagttcctttgatgtattgcttgtaatgcctcatgtgacaggtttctaggcaaatcaaggaagcagggttgagttgcatatctgggttggcctggagaagaaaacagccatgaaaattgaagtataagtgagatcaagagtttggcaggcaggaacttagagctaaggtatgactttgtgaatgtaatcctccaggaactcacagaaacctgagttagggctcagaaactcgaagtctaacattttatgaacatttacagacttctaagattgagatataaaaatcaagaagatggtgactccagtttcgcttctcacatgacttcactgctacttaggaccaacaatactcacatatctattgctatagcaggaagtagttccatacgattccagacaagtttctaaatactaagaagccttaaaaaaataagtagagggcaacatattatatttttctgtcctcttttatttctaatttatagagtactgaagttattatattgacctctggtaacactatagagtagcatgataaggtaaaaattaaacactgtctataaaatataagggactaattacagatcaaagaggaaaaaagggaggcataaatccttcaggaagctgaattatgtgtgtgagtgtgtgtgctgtgtgagaaaaggccaaaaagagaaatttcctatctacatgctgtaatcagctagaagattcttcaaaggaatgtcaaattgaatcaaataatccatgatcaaagacaagtcagaaatcgaaacagcagcattgactcagttgactcagataataatatctgttcttataagagaacagctgaagtgactcgatggtgaactcatgcggctttttttgtctggatctggaggatgcttgttgaaattgcacctctcaacttgacttgactcttaactgtgcctcatatcaactgtctagaaaaatctcttgctaactacgagtctaccgtctcttattggacatatatggaacttctgtaatatcttggtgaccaagaaggccttaatgttcccctcagcttgactaaactttagacaggtttcttcctgactatagacccccgacctcccttttcttagaccatttttctttagagaacttgcaaattgtaaattcttttttgcccttttgagatataaatcttctataacccaggaatgtctttttttcacagacttgggatccatctttctgaaacgtagtaagaaaggtagggccccaactctcagtcttggtggaaaggtaggagcctaactttcctaagtaccaattagcaaacccaaatggcttaattacactgacaaaattcacccctcccacctcctccagtagttttccaccagctcaccctagtgtttaaaaatcctcctgctttttgtttcagggcacttgagttcaatctcccttattgcagtgatcttgaataaagtcttccttgcccgtttaattgtaaactccacccagtgcaaattttctttgacaatgaaccaatcttttttctcatctttgtaaatcttttcatctcctgataccaggcaatactttccagttacttttaaataagtaaaatgcttttctttcaaatatgagatttagaattaatgtgtctaaaaatggatattcatgacagagctagtgaaggatagatgcaataaagaaatgaaaaatccacagtgcagaatatgaacatttaggtgattggataacaccaaggaataattcagtgaaaaaacattctaaaacgcttacattctaccctgaacaacacacacatgcatgcgggtgtgtgcacacacacacacccagaaatcccagaaatactaagatcttttcaacctaatgctatacacacatacaaaatgcttaaggttgaaaacttgaaacatttctctgccaagtgtagaaatcttcgtgttatatgctgtgaaatgcacaaaaatgtttttgaacacagtaggatttcatctatagaatgctaagtgttgatattctggtaagaagcactatttgcatcagtcgaggtaatgggagctagtagtttaccaaaaaaggcatgatattggctgggtgcagtggctcatgccagtaatcccagcattctgggaagctgaggtgggtggatcacttgtggtcagcagttccagaccaccctggccaacatggtgaaacctcatctgtactaaaaatacaaaaattagctaggcatggtggcacatgcctataattccagctacttgagaggctgaggcacaagaataatttgaacctgggaggtggaggttgcagtgagctgagattgcaccactgcactccagcctggttgacagagtgagactttgtatcaaaaaaaaaaaaaaaaaaaaaaaggcataacatttaccatggataaaaacacaagcgcatgaacacagctcaatcactgttgatcagtgaagcaaatgtttaagatccagaactctcaaggtaaaacacagcaaaaaaaaataacaaaacaattcaaaacaaaaccaaaaaaccatgtaggaacatctttggtttgtcagtttttctcttctaagtaaaaaagacagtaacctctacattttgttcataaatacctgattgcatttgatttgtgcagttttctgcctcaccattgtttttctgatgacaaaacctaacctgtaaatataaaatgtatggaccaataccatcgagcttgtttggaaacagtaggttctctaagattctccagagaaaatctttcacttctttttcttctgttaataagggcaattagaaacataatggtccgttgtgactggaggctttctacttaaactcagcagcagcagaaaacaatgtttctaggttcctcttccaacaaaaatactctattatctacttacttcagtcatttttaagtacattcagctcaaataatctctcacaaaatagattataatatattgtcaatcttaattaactaaaattagttatttagtgtacagatctgatttttaaatcatttgttattgggacttgggaaatgaatgcagtgaaatttaaaaaatgtataatcagatcttgtgtttttattcacacaattttttaataaaagaaaaaatggtctggagacaatcaggttcatgaaagtggtctagttaaatcattcagattatactaaaattctaggcaatatttgatgatgagcagcgttaattctgagacaaatttagcctactaatgacatccgggtccatcatgatatttttaggttggaagtgacatgtgacatcattatccacacatgattgggagaaatattttttggtaggacggctaacttattagcagtgaatgtttaagtagttttctgggcatttctggttcagggaaacaagatttaagtttatgtatattatttcctatgacatcctgctgcttaatatgatgtcagtcagttctgagaaccttatctttctcgctgtcatagtcaaatgtaaaccagggcataagactagggaaagccgatttcctttctctgtgtatttacctcgtaagttcttacatgacaattcacatgtcagcttctatctagaatggtttcttatttccattcctttgaaaaaaaaaataaaattttctaactctcaagagccttagctttgtgaaacccgagggtgcttttagtccccttcgcaaaagaaacaaaattcctggagactgaaaacaccaccaacaaccaaaaaaaaaaatcagtacttttcgggatggatctgtagcatgaggaaaacaaaatggaaggacagaaggattccccaagcagttgggaatcatcaatacgcaccagcaaccttgaccttgccacaggtattgaggattgcaatctttcaacccctaagatgaaatcacttaatattttaacttgcatttctttggtaatggcttggctacacattttaaaattacgtttactagacatgtgaattcttctctccctctgtctcctctctctgtctctctccccctctctctctcattttgttgaaccaactcttgtgccctgttagtgctctgttctttttagacagtctttttgtgtaagttcttctatgctttattcccgttacatatattcagaagttttgatagtctcttatttttatctttttagatttcttgtttcacttttcatttgaggaagactttatccatgtgcttatagttccttctccttcttttaatgggtaaaatttattatagaatacatcgacagctgttagtaatttattttaaattttatagaatttaagataaataagtattttctcctctttaaaaatggagacaataatacctaccacacaggactgaggaaagtatttaaacaccttgtagggtgtaagtggagtatgagtaagcagttacaacattctatccctttctcccttcttccctccttcccagataacaggttagaaaatggctttttttttcaatgtgtttctacttgtcttgttgagtcctaagtcctattcaacctctagagtgcagaggttcccctcttctatgcctttatcttgctcccgatcctaacagaattactgcctctgctcccacggcatgttctattacaaagattctcttatattaaagttatttgtttacatacctgtctcccattactatgtattccttgagaagtccagcactgtgcttgacacctaggcatatgtgtgtgtgcccacctggggggtgtgtgtgtgtgtgtatccacctgaggtgtgtatgtgtgtctgcctacctggggggtgtgtgcgtgtgtgtccacctgggatgtgtatgtgtgtgtgtccacctggggtgtgtgtgtatccacctagggtgtgtatgtgtgtgtgtccacctggggcgtatgtgtgtatccacctggggtgtgtgtgtgtgtgtgtccacctggggcatgtatgtttccacctggggtatgcatgtgtgtgtgtccacctcgggcgtgtgtgtgtgcatgcacacccatacatgtgtcagtcccattctttcctccaatttatgcatttggaattttcaactaatatcatgctatacagtcttattcccaatggtgttacaaagtttatgataatattaagtatttgctgttgcatttcagtagtggttggtttcttcctaggcttttaatgtgtgaagctgatgccagataaatctaaaaacacagattaaacttataagtcaaccaactaattttaattcttgctcaaattaaatagcaaactagtcaataattacaaatgaatattattaacttcatgtattaataattgttaagcacattaataaatttattctccatatacttggataagtatattggtatacacaacatatgaaaaatttcatgcaaatatgtaatatatgagaaaataccattaaaggcaagttttaaaaatatattggtataaatttaacatattacttatcaaatttgattttcttattaagtctttttctatgacatatttgttttaaacaatcaaattaactttttttttaaaattatacttcaagtcctgggatacatgtgcacaacgtgcaggtttgttacatatgtatacacgtgccgtgttggtgtgctgcacccattaactcgtcatttacattaggtatatctcctaatgctgtccctcctccctccccccatcccatgacaggccccagtgtgtgatgttccccttcctgtgtccaagtgttctcattgttcaattcccacctatgagtgagaacatgcggtgtttggttttctgtccttgcgatactttgctgagaatgattgtttccagcttcatccatgtgcctacaaagacatgaactcatcctttgttatggctgcatagtattccatggtgtatatgtgccacattttcctaatctagtctatcattgttggacatttgggttggttccaagtctttgctattgtgaatagtgccgcaataaacatacgtgtgcatgtgtctttatagcagcatgatttataatcctttgggtatatacccagtaattggatggctgggtcaaatggtatttctaggtctagatccttgaggaattgccacactgtcttccacaatggttgaactagtttacagtcccaccaacagtgtaaaagtgttcctatttctccacatcctctgcagcacctgttgtttcctgactttttaatgattgtcattctaactggtgtgagatggtatctcattgtggttttgatttgcatttctctgatggccagtgatgatgagcattttttcatgtgtctgttggctacataaatgtcttcttttgagaagtgtctggtcaatcaggcaggagaaagaaatgaagggtatttaattaggaaaagaggaagtcaaattgtccctgtttgcagatgacatgattgtgtatttagaaaaccccatcatcttagcccaaaatctccttaagctgataagcaacttcagcaaagactcaggatacaaaatcaatgtgcaaaaatcacaagcattcctatacaccaataacagacaaacagagagccaaatcattagtgaattcccattcacaattgcttcaaagagaataaaatacctaggaatcccacttacaaggattccttgtaaggacctcttcaaggagaactgcaaaccactcctcaatgaaataaaagaggacacaaacaaatagaagaacattccatgctcatggataggaagaatcaatatcgtgaaaatggccatagtgcccaaggtaatttatagattcaatgccatccccatcaagctaccaattactttcctcacagaattggaaaaaactactttagagttcatatggaagcaaaaatgagcctgcattgccaagtcaatcctaagccaaaagaacaaagctggaggcatcatgctacctgacttcaaactatactacaaggcaacagtaaccaaaacagcgtggtactggtaccaaaacagacatatagaccaatggaacagaacagagccctcagaaataataccacatatctacaaccacctgatctttgacaaacctgacaaaaagaagaaatggggaaaggattccctatttaataaatggtgctgggaaaactggctagccatatatagaaagctgaaactggatctcttccttataccttatacaaaaattaattcaagatgggttaaagacttaaatgttagacctgaaaccataaaaatcctagaagaatacctaggcaataccattcaggacacaggcacgggcaaggacttcatgtctaaaatacctaaagcaatggcaacaaaaaccaaaattgacaaatgggatctaattaaactaaagagcttctgcacagcaaaagaaactaccatcagagtgaacaggcaacctacagaatgggagaaaattttgcaatctacccatctgacaaagggctaatatccagaacctacaaagaacttaaacaattttacaagaaaaaaatcaaacaaccccatcaagttaactcgttaatggtttcttcctttactgaggaactgcaaacaactggggttctttgacttctaaggaactgcttcccaccaacagcattttttcctaaaattttggagaatttcaggcaacaaatttgcatcagttttctagagtggaatatagattcaactttttaatttatgcaaacttagcttccttttaggctaacaagcactacttacatactatttctgtcctcaaatttatgttagatactttctgagaaatctctgaaataatttcattctgaaagaaaattgtttttggttctaacagtcatttcagtgtggataaaatcaatgagttaggcacaaaccttaaaatagttataagccagatttgaatgatagtgtcctgtcttttgaccactttctctatgaaattaagtaagcttcatttgattttaaatatgctttatattcagaactcacccaagaatatttcaaaatatacaaggtaattctaactcaaaactatggaattttagctgactctcttcagcttgtatactacatgtgtcaagagcagttacgaaatactagagatacctaagcaattatagaaaatcttacaacattacctattagagtttaaccttaaacataaaacctttttagcttttttaaaccaaaaatattcttatttggagaaaaacactattcatcttaatacacttaaaataatagacgatgccttcacaaactcatatttttacacatttaaaaaattcttaattgtgaataaaccttacacatggacttttttgcatttctatgtttgacttgcaaaagtctattaagcacaataaatagacaattgtctacaaaaaacaataagccttttaagttagtatctgtaccatgtgcctagaaaatatacatttttgataacaaattactataaaatgcagagaaatggggagctggtgaataatttcataaaacatcagaatttagtttacaattgccttcaatcagaggaccacagaaaaagtgcctgtttagttattagcttatatgtaaaagtttgaaaaataattatatgtctaaatgacctttgttgaaaatgactcgtcatcctagagattccaatgtattaaaaagacagtaaattatagatatattaatgaacaagaaaaaaattgagaccctccaaataagcattttaattctcatttacgagcaaaacagtccatgacctgtcctccgtcttttccatgcctccaactctattctaacacagatggtagtaacttgcttcaaataaataacagtatttaaatttaacctttgtaactaggagctgtatttccgaccttgctttgtaagtttggttgtgtttgtaaactttaaacacttatacagggcatgcatttttcctttaaaacatggacaaaaattaatcacatattttcccctttggactaacaaaacatagcacagtaaaacaaattgtgatagaaaaaatatgattttaaatggtttctgccggctgatatttagtgatttatgagtttcctatgacatgaaagatagaatgtcattttccttggaaattttgatattagccacctcatagattgctataagtctgtattatgatcagttagcattccttgcatttcctacattatctaagctaggctttacagtcagctaccatgatagattcatgttattattctctcaggagagccattttaccacatgccaaacactttacacagctgtaaacttattgtagctatggtaaggataaagctgtgagctctaacataaacatctggaagagtgaaagggatgttcaatgtctattgacatataatactacatagcttcctaaattcatgaccatgttgtaatattcattgtcactgtataagattatacacaccataaacattttctaagtgtttccttattgtgctgtaaattcatggacatgcagcacaaaaaaagcccaaaaaatcctcttctgaagaagcagtgataacatcctaaatattcagatccagaaatatgtgttttatacattgattttacaaacacactttcagaagcaatcattaaggtaaaaataagactgtgaatatatttttgaagtaagtcttccacaaactcaatgcaggtgcaaattctttgcttatgagaaaggaaggatccgaagtcatgcagtctttctcctttagggccaagtcagatttgggttctgttcacaggatgctctactcactgagttcagttaaatatgcatctgtcacaggatagcgtgcttagtgaaaacagctgatcggtgtacatttttaccctatgtttaactttccattaggtccctagactttgaaaaatatcaaataaaaaaaaagtcaccttttgttaaaaggtgtttttttatcttcccaaatccaagttatgaataaaaagtttttgaagcattttcttttatggatctcacaatattacagaatccccctcatgtcatgaggctaatggactcaaaaagggaatgatgctgatcttcaaaagctttccagtggagttgagtaacgaattggtcaagttaccaacaaatgggtttggggttaacaagaaattgatctatcaagctgctgcagcttcttctactttttttttttttttaaattccaacgtatttactcaatattattggctttaacatctttgaagagggatttgcatattgacaaaaacacaagaaaagtccattgcagccaactgaaacaagtaggaagtaagtcaggtcagggtgtctcttactgaggtgcctttatgttaattctaatcacaggagcttcagggctggttttcctctaggatgccagagatcattcctctaggatgccagagatcatttttgttaccagacagacccctcctcggaaccttgtactttgttgcaggaaataagccaagaagcatattatttattgaagcaggggaacctgacatagaagggatagtctaacttttctgccttaaaatgcagaccattccagatatttccaggtaatttgcaactccctcccttctatgcttatcatccaatttcatacacattttccctgtcttctatttcttctgtaagaatattatatttattaaaaatataaaaacagtatatatttatcatgtacaaattgacactctgaactactgtgccattgtggagtggctaaatcgaggtggaatggctaaatcaggctaattaacatatgcatatacttctcattttttacggtaagaacaaagatctgtcagcaatttttaagaataaaacacatttatactttatctgtttccaagcaattataatatgttgtaagctatctactcattggtttctctccttcactgtatagtgaattggggatgggagtgaggggcaaggtccacagcctgcagtttatctttgatacccagtacctgagaaaaggagggatggagaaaggatgaaaatggtgctggttaattaattaaagatctcttagaggcttactacagtacctacagggcactgcttcttaaaaagtgtaaccttggtcaattagtaagcagagacctgtaggatccaatttggcagtctagccacatgtggctactgggcacttgaaaggtagctggtttaaattgcgatgtgctgaaaagtagaaaatacacatcaaattttgaagatggaaagtaaaatacgtaacgcaaaaatttaaaaataattttatgttgattatatatgataatctttttgaaatgagttaaattagatgtattattaaaatgcatttcatgtttctttttactttttccattgtagcaactagaataaatttgaaattacatacatagttgtagctaatgttgtatttctactggataatactactacagaccatctatgaatttaacttacagttagaaggcatgagagtagaggatgaggttagaatatcaacagagagaccaaagacaacaattattattgagcatccactaagatgggcactaccatacactcttctacattatttcatttaatccttgtaatgatttaattttcctgtgggtttgcatagcacctttctatcacaatgctttttcatgatgtattaaatttgtctgtctatacctatttatattcccaactatattataggtatcatgaggactaggaccctgtgtctttttttaggtgttaaaatctcaacacaccgcatgatttctacagcgcagaatgctcaatacctttctgttgaatgaataaatagatgcctgaaagaatgagcaagaaatcactctcgttttatagatgagaaagtgaagtcctgtagaagtgaaagaacttgcctaaactcacacagtagtgctttaaatccacgcccaacagattccaaagcctgcgctttcgcactgtacttcaggggcatcacaaaaaagaccagtctactcaaagctaaattaactttgaagaagtaagaggtaggtttagtgaagaaaataaaaccatcaagactaatccatttactcttgaacaaagacctttattacacacattgctcccatcctttggtacattcttttaaagagtcaaacagtttttcaaaatctgtgtttaaagtctcatttttgatatttgttaaatgacaagatgaatgacagaaagctatcataaaaagagtagtgtggatatagatgagacacgcagatttaggtacatgtttcttgaaggaagcttttgcatatgttcccagaccctgccccgacccgagtctctggcgcattcctaataaaagaactaaattattttgtaagctttacaaatttgttattcaattaaactctttttctgtcatattaacaggaaaataatgtaaaatgttaactagtttgctatatttgattagaaagagtagaaaagaagaaaagttgtgtactgcgccctgctgtgctgggatcctgaaaggaccgtcatcagctaatggaacatggattccatgcaaagaaggaaagctgatggtctcagtccacgacccccgggaaagctaaaagaatagtaaggggagccatgggtgcttccactttgtgctctcacatcatgttgcttccaccatttgaaaactaaaagatttgttaaaatgtgtgatacaggcataagtaaaataggtattgaaatataggaaatagttggcgaagactttacagaataagcgggattaaaactcgaccctgctataaataatctgctgttataactatagtaaagttatgaatataaaaataacattttacatctgcaatgcaaagtcaccagaatgaatgtcttgattctctacgacacagcttacatttgtcaacatgtctttctcccttcttagattaaatgatcctagaaggccagggttgtgtttcaatcatctttgtttccatggcagcatttctcattgcccccttttccaggatgtggattctaaatactttggctttaaaaaaattagtctcagtaactatggatactcttccatttgatttccaccacctgcctggtatacagttgatgctcagtacatagttgatgaagaaataaatccataataattaaatgatggatgatggatacattaattgcccttctttaaaatacacaggatgcaaagctcagggagaaaaagagtaagatgggaaaggaatcactacctgggggaaaaaaaagcaagtgaagaattatggcagattctgtgggaaagaagaccatgaaagatgatgactagacagtagtcagtcaaaagatcaaagataataaaaatcaaaaagggaatataatatatataaaccttcataattgctcgggagctaatttataaatataagcataaacaatgtattgtcattagcatattgggataattaaagatgttatcgttgatggtcagtaacatgccatcaacaatgataaaagcttaatattgaacaaataaaatatccagaaaaaaatagcctcagagaactatacattattgttacaaaatagcatgttacttaagcatttcagtaaagagaatttggccattgactcacaggagactgaatttgtttttcttttaagtattaaagaaatgagccctatgtagcagcctcattttcaaagccagtcaagggagggttgagtgatattatctagaatttggcataacacaacttcacaacacagcatttcactttacattatgcagtaagatagcatctcgtactgtataaattgaattcagtttcagaagatataacctggtgaacctgggttattgaactgagatttcttactttatctttgaattttccagcgttaaaaaacatggcatcatcaaatgcaagaataaacttttcttaatacttagaatggttgtcgtataccaacaataaaatgatacacatgttatagctaaagtttgacagtaggctaataactaatactggcagactgaccaactagaattcactctgtcataagctcaagaaaaaacaaaccagttaaaatgaaggcatttttttggtaagcattctcagacgaaagtgataatttatcacttagggtcatttcttgcgttgggtttgtgtggaacaaccaatagtcttcatattttcctgtggagctttagctgaaatataaattagaacatggataagtttaagtatcttttggccctttaatagccttgggatggaaatagttcttaaggtactatgcataaagctttttgtgtacacttatgcatatcaaaccctgattcttgacttcatttaaatgaataaggagaaaggaactaatattccaagtaagactagatattaccattttggacattataatgattttactgggctgcaaatcaacattacattttttaaatgacggtataaattttggtcctaaggctttggcaatttaaaactgttttctttattgtaataaaatcttacattaagtggagataggtaattgttaagtgcaactttaaggcattgtaagagaataatatgtttatcgctttcaagtctataaaattattgcaactaaccaagtgttatctaaggagattcctcttccaatgcattgataaaactctataatcaatgaaaagagtcatttcagtattccttgaacaatcgatcctctaagaagggttatgagttagctttggcactaggtgcaggagctgtaagagcaaataagagccagcaggttctccttgagtagattcacagcctgtggtcaaaggggaagcagtagacagacaggcaaacagccatctctaatgaagttggcataaatgatcacggtgcttgaggaattacatgaggaagggattccttttgcctggggcactccagagtcttcacagaggaggtaatgggtgacatctgagctgtgctatgcagaatgagctggagtttagatgttagaaaggaaggataaagtaacaagtaatgaaatttaaaataaaggaaacaacatgaccagcattagcggggtgtgaaatgttactctgggaaatggcaaagagttggatggaactagggcaggttctagtcactgtttctctcactgggttgagagaaaagggcagtaacagaagatgaaattgcaacattaggttaggcaaccatccaagttgtgtatgtacaaaagagcacttccaaaatatttgagaacagtttgttacctgagggagaaaatactgttttcaagcttttaaacctaaattgttttataagacctcctatttggagaaatatcacaaatgtgaactgcagccgtatgtttctcttgatgatttataaatttccaatttttgaagcctaaaatataaacatatgaatgcttccgaaaggtggctaaccaccatctctactctctgtcttccttcagagactgaaagccttctcaacaaatgggaaccttttaatatttcaataattttattctgcaggcagagggagacagggtttaaaggaaaagtcactgttatctgaagtcaggtgccaggtagctgtgtgactttgacaaaaccagttttcttctttgggtcttagttccctcacccgtaaaatgagaaaagttgtattagatagtcttttaaggttcttctctttctaggttttgcacttagacattttaggactctgatctgtgtaaagaccaatttatatgtccaaacaaatgacactggccttatatgtaattcgggtcagctgaatttgacaaaagattcaatccattagtggaagaaaatggtgtctgaaattatccatattcatttatatttcacaagtatacagatttgcatttagaacatgatgagaaatggcaattaaattatcacaacattagaggaacattagaggtttgggtgaagtagaatggaagaacaggagagtaagttcagctctgcatatattaacattaagatcccattagtggaaatgcctaataaacagttggaagtgtgattctgaagctcaaaaatattttactctggaaacaaatttgggagtcattctacaaggggttactgaggcaatgggagtgaatgaggagatcttggggaaaatgtgcagttttgaaagagaaggcaagggagaagaaaaagaagatgagaggtaggaaaaaccagaagagaatgtgccgggaggctcttgggcaatggtattggacatggggtcaatcctgtcacatgctacacacgggccaaggaagagaaggaatttttggatgttgcaattccagaagacgaaagaaaatctcctataactgtttcagtggaaaatgggaaaacaagattgcagaaggctggggacttattttaatttttactcagaatccatgttgtatttagacataatgaaggattgtctggctattataaatagtaaattcataatggcagatttttaagttaatgggaacatattccagccatcacagatttttagtaaaaagctacataaataatagcaaaatattaaccagaggtgcaaatttgagcatctgttccctcagtgttttacttctgaaggcagttgatgtatggaaatatttatgtccaagagtattcactgaagcatcattttagtaagttggcaacgacataaatgcccgtaaataagggaaaggttagattgaatatgataaaatatgaatgacattgcacgaaatatttagtggcatggggaaaagaataaggtataatatagaaatatttattattttataaaaagaaaagcagaatatcagacagaatatccagaattgactaattttgtttaacaaaaacatgaaaaaatacatatacagagaaaagactggaaggaaatgcactaaatataagggtagttgctctgaatagtaatattgttgttgggctttattttattctttgtactttatttttaaatttcatataaatatatattatgcttattagtaggacaaaattcaataactcctaattttaaaagaccaagagaggggacaatagaaataaaacattagatttttttttccttaacacacacatgctgttgtacacatacatgagcgtgcacatgtgtgcatacacacacacacccctgccccccttcttttagcttagaagaggtagaaatatactctatttgctggtatggaaatggggcagacccagccctatgcctcctgggtttggtgaaaaagtgacttcagagcaaaaataggcttgacaactgtttaaaactaaccttgtttaaatatgcttttaatagtactcaaatggaaaatacatgaaataggtaaatactaggagttggtaaaatctctcttcagaaattccaactgataattatttcagacatttaaataatgagttttcagtgattctattatctaaaaactgtgtgccctgatttaacctaagtgagacaaggatggagctatacaataatagatttcataaaaaggtccaacttagcaagtcatgaaactacctatcagtctttcaaaaatttcttaatgcctttattcatacacatccaagaattattttaaggtttcatttaaagcctgtgccttaccttcctttatgttcagctcatgataaacaggaataagattaagttatatcttcataattaattgatttggtactaagcaggaaatctcaagacctatagagttgtataaattctcattgaccttaattacatctaaatgagctacgctgcactgctgtgtagagcactgaggtggagagaaggcatcaaaataggacagtctccaaaattgggtagtgtattccaaaaggtttataaaaaagacaaaaatgaaataaagacattatcctaactctgaatacataatatactaaatagagagattttaagaacaattctgtctatctgtatgtatacacaaaatgcctttacataatgcccccaggtcaaaataataagtctaggttgatggaagggaaatattatataatttagtatgaaatatattttctctgctcccattttctgatctgaaggtatcaagtggaaagaggcatttctggcaagtgtctcaagccatccccaagcaccaccaggcaccattcagaagacatcctcagcttcacacagaagagcaagtagatttgtcagcagtggtggtaatagagtagatggggttggagcctatgaagaagtggcgtcttttaaatgtctgtaagcagatattctgtcagaccttgaacatgaaccacagttactttaaaaatgatcaagtgaattttaaatgctgttagatttaatatttcaacatttcatctttgcagctgggacacaatccaatcctttgtatgatgatgaggcattatagttccaagatggatagaaatttctgggaggcaaatctattggtggaagtgggtggggtgactcccagttccagggagcagaatggagaagaatggactgtacaggttgggtaaaagtgagcatggatttcggctgcctgaggcatgaactggccaatgtgtggtgacagcgaaggtctgaagcaacaacatcaagggagttgctgacaaggtataacatggtctgaaatgaagtgaatatgttggaacaatgaagattagctagtggaattccaaaggagggatgcaaatgattcctacagacaatggtatgatgagaggcaggtgccataggataggtgagttaggcagtgatatggcaagctagggctgagataaaaaatgcagaaggtatttatgatgaaagaggaaattggtttaggtttacatactaaataggtacaatttatgttacatacatgattggaaaataaatattgaaacttaatttaataaaatgtgttagcactatataaattattcatatgaaatgattgtattccagggcctattacagtcaagtaaaatgttttattctctgtaggtttcttaagttatagtaattatagttcatgatgttaagttctaaaacacttttttgcctcctaaataattttaaacttgtaagaatcaaatgaagtatagttgtaaaccattgaatgtctgtgtccctccaaaatccatgtggaatcttaatccccattaagaggttggggccttttgggaagtgattaagtcataaagcctccacctttgtgaatggaatacatgtgttataaaagaggctttgtagagctgtctgactctttcatctctcctgccatgtgaggtcacagtatatgtcccttttcccctttatgccaggtgaggacatagaaggtgtgattgataagaaacaggccttcaccagacactgaatctgctggcaccttgatcttggacttcacagcccctagaactgtgagaaataaatttctgctgcttaaaaaccacatagtctgagaattttgttataatagcatgaatggactaagacaagtggtcactgaaagcctccaaatatatcctcacttttcttgcaaataaaggataaaatcctaataaaagaagataacaagatcaggaagtataaatccattctctactatttctggtaagtaactaaataaagctgctttgaggaagggccagagtgaagattttgctatctatcatctaatttcttgaattacatataactgaaagactgttattttattttgaagcaaattaaataaagactcctgaagtgacccattcttgctactgacaatccataaaataaaaccattttctaaaaaaaaaaaaatattcattgcctctgctctgagctgttcactcatgattgacgggtgtgtgggaggccggggggaaggaattcacattcacagatctctctgatagccttccctgagctgcctttatccctgtcaccaaaagtttatcaatcactccctcgttagtgccacatctacaatcttttacttagtaactataatacttaatattctacaatatactatttattttcatgtttgtttcctatccaagaccatgagttatttgagagcaaaaactaaatcttattcatccaatgtttccaacctactgcacaatacctagtacatgaaaagtgtgcttaataagtgctgagtcatttacatgtattattttgttgaaacaattatcctgggggacagatattactgtgcttattttaatgattaagaaataggattcaataggttggataaattgtctacagccacacggacttcagtggtagagtttagattcaacactttcacattttacccattctaaggtgaatttttcttttcatacttaaaaagctctgaaattaggatgtgtccccattgatggcaagtttcaatcaccatctttcaggtaacagttgtgatgtggttctcatttttgtgtatttgaggacctggtcatggctctccacattgttttcactccatttgagttaagggtatacttggagttgcacctgattgagcttaactgttgtttatcatgtctgccaagggagaattgcttgagcccaggagtctggggttgcagtgagctatcattgtgccactgcattccagtctgggcgacagagtgagagctcatctctaaaaatgcagaaaaatatggcaacagaaaagcagaacataactggatattcgtgaaacaaatattcactattggaagaatggctgaaattgtgtattttcttgctaagcaataaccatatgcatttagaacctatcaaaggaacatatacccacaaatagataaggctgtgttaacatttttttgagatcagtttgcaggatacaagggcactagaaggcaggaaaggtgaacatagcaggaaaactcagggcattgatgctctcagctgaaaggagaacagtggtaagggagaactaccagcacaattcaacagaatcttctatgatgatggaaatgctatataatctatactgtccaatacagtagctgctagcacatgtggctattgagcatgtgaaatatggccagtgcaaatgagaaaatgaattttaatttcattttggttaacttaaatgtaaatagccacatgtgcctagcagctgctcttttggacagtacagaactagatagtgctatgaaaaccaatctccttctttagggaagctgatgattactgtttgatggcaaagtcagtttcagtctcatctgaaaagggcaaatatagccatttcacaatgctgtagggggttaatgagatgctatatggaatgtgcttaacataaagcctcgtacatagtaaatgagaagaaatgaaggtagtagtaatagtgaatataggaatagtaatagttgtgataaatatattatttttgtctttgctgacaaacagcaataaggtctgaatattgcaataaggaggaggtcagcaagaaattgcccctgccaaaatgataataaattgcctggaaattaggaagttcattatagacagttaggctatacataaactcagtaaatattgatcaacctgaaaatttcagaaggtgaattactgcatatgcaatgtttccaggtatgtttctgcattttaaaaaatccaagttctagtgtcttggcccctcatctaattcttaaaagaattccagattagtcctagcatactatagttctcataaggataggatctttttcacaaactacaaagaggggtattttgtttgccaagaggaaccttggacaaatactaataagaaaggatgtccctgctgagctcatactaagggcaagcctgcgttttataactggtgtgtagcccttcagagaatttaccggcctatgttaattagttaatatgcaccgagcttgtgtgtgtgtgtgtaaggagacacaggactaataaggacaatgaagactgggatggggtaacatcatagcaactctacccacccaaatctttgatcaagtttaaagaaactagggagaaatgagttaagaagagaagctgaaagagctgatttgaggaaagatatcattccctgagactgagtctgggattgagcagtgatttttttttttttttttttttaagggaaagggcccaagagagctaagcattttttcaacctttgcagagaatccaaggccacttaaacatctggaaaactggcagccttgggatcagtgaaaggtagcaccttaagcatatacgttagcagtttgatgtatactatcagaaagggctgtggtgaggctgcctcaagtagaggacatggataatgggacactcaagtagcacaggaagaactgagttgaacttgcttggagagtagcattgaagaaccaccctgtttatagcatcccagaaacacttgttgggggttgaggtcctcctgatcagatgagttcagtgtaagcaggcattaaagtgacctaatttgtcctcacaggatagtaatgccagaggacattggggtacactagctgttttgttactttggagttcctgttattattcaaacctttttgagtttctatagttgtatgccacaacgatttagggtggagttagtccagggtagcattggcaccaataaagggctgtttgttgaaagcctgctcatcatttgcctttttattgctaccagaacaacagcaactagaatcactaaatctaacacttgaataaaggctcttcagagggcttaacagtggcaattaccaaacagtccacaccaactgttcttggcaggaagtgaagaacaagaagtaaagaattactccatgaagtgaaaaatttgggaagtgcttcaaatagaaaatatgtaaattgacaaaatgggaggaccatcagcacaaacaactgttctcttgagaaataaaaatccaataaagtttaagaatatacccagcctctttcaggagctctctattcaaaatgaaaccttaaactacactggaagataaactgcatgcttatctgcattgtttgactcaacctacaatggttgaaatgagatttttttttttttgccttttctgacaaaggtcatattgatggaaaatcctatttcattgacactttccaattctctggaaatggtcagttatcataacataaggatagacagagggacattgatttccttccatccctttaatttaatgtttcagttctgatgatcactatgccaaaattttacctagcagtactgcccatatcctggccatatcatttaattaacaaaactgaaatacttagcttggccatgtaatttgagtaaccaaaatgagaaatgattgtaaaccgtattgagcaaagttcttgaaatgaattatttttgcatgatgactttgaggaataaaaaggattagaaaagagaaagaaaggaataaagttcgagttgcacaggtcagaggtaacggatcaaaaggtaaggagtacataaagtgttccaagttgacaaattggacataaataaatcactaggaccagatggcattcatccaagagttttgaacggactcaaggatgaaattgtggagctgttggccaaatgtggaaactgttgttgcaaacaatcaccttgtcagagtactgggagattgctgatgggattcccatctgtaagaaggactctagagaaaaccctaggaacaagatatagatcagcaagactggctttcctggcataaaaagatgaaaagaataaaaaaacagggtcagtgccactgaacacctttatgtaactcacttactggggtaaaagctgcatagtttgggtaagaagaaatcatacaaccactatggccttgttgagttctctgaggtggttaacaattattgtgtggccaaattgtagacataatttacttttccttttaagggactttgaaaagatttacttaaaatggctactgaacaaaatataactgagttagcatgagattattttcgtcacatataaaaaaataacaatgatagacaacacagaatttggtcgggcatgctggctcacgcctataatcccagcactttgggaggctaggcaggaggatcacttgatcccaggagttcaagatcagcctgggaaacatggtgagaccccatatctaccaaataaaaaaattagtggtggtgaacacctgtagtcccagatactcaggaggctgaggtgggaggattgattgaggctgggagattgaggctgcagtgggccgtgatagtgccactgcactccagcctgggtgatcaagtgagaccctggtctcaaaacaacaaaaacataaacaaaaacatcacagaggtcataaggaacattttccttggtgtaacctataggagttgtgagacagtcttatattcataaatggatttgtgtggaaattttaaatttatatatcctcctaatttctagccagcaaggatatatcaatacaaaatactgaaagtgggaaatttcaaaaggatatttgaatgggaagaaatatgttgggccaatttcaatgtgtatttcaaaactacacttacaacttgcctctcaagcaggtcctggtagtcattgtagtttaaagctctaacagaactgaggatgccattagggagaatgccttaaacaaatcaggagcagctgcagggcacagggctttgcatgcagaatggagcagggatgaactcacacagagtgcctataccttatgccagctgcggtacatgcgtattctcatttgtcacactgattgtaaagtagatgatattataaaactttggatcctataattagcaatactgtattgtacacttaaaattgtaatgttaatagatctcaggtgaactgatcttacaataattaaaaaaggcaatagacctgatgttttagaaaatatatatttctacaaaacaggcaaacacttgttataagtgtttttcatgacaacataaatcttgcctgagtttctttttacacatatcaattgacttcattattttctctctccttaggataattttctattatttctagaaggtgaatgtaatgtgtaaaggcaaaaaaaaaaaaaaaatctactcctgtgactgacatgcattttcttctgttgcagatataagagaataaagtgaagagaaaggaactttctcaaagttgtattgcttagagggagtagaaataagattaaaaaccaatgtcagtttgacactaaattctgcgctcttgaaaggtggtcattaatgtctaattatttgatttaaatttattcccattaaaaaacctagtcttgcacaaaacagactcccgcttttctgatagtattgttccagctgttactactcagtcatcttagtctcatgctttttgctctcccaaagaatcattaaccatttccatgttaagcttcctttaggtcaattctgagagctgaaaaagtaaataggttcaacaaagatataaacaattagttttccacctattgttattatttatcaaaataaattaaaagaaacatttttgttctgttttgaatcagaatggaatttcagaaaatgttcacgatatggtgtggctgcatctccacccaaatctcatcttgtattgtaactcctacaattcccatgtattatgggaggaatttggtgggaggtgattgaattatggaggcagatctttcctgtgatcttctcgtgatagcgaatgagcctcacgagatctgatggttttaaaaaatgggagttttcctgcacaagctctctctttgcctgacgccatctccgtaagatgtgacttgctcctccttgccttccaccatgattgtgaggcttccccagccatgtggaactgtaagtccaattaaacctctttcttttgtaaattgcccagtctcaggaatgatttcttaaagtctttatcagcagcatgaaaacagactaatacagtaaattggtactgaggttggggtatggctgaaaagatacctgaaaatgtggaagcaactttggaattggataacaggcagaggttggaacagtttggaggactcagaagaagataggaaaacgtgggaaagtttggaacttcctagagacttgttgaatggctttgaccaaaagcctgataatgacagggacaataaggtccaggctgaggtggtctcagatagagatgaggaacttgttgggaactggagagtaaagatgactcttgttatgttttaccaaagagactgccggcattttggccctgccctagagatttgtggagccttgaagttgagagagatgatttaggatatctggcagaagaagtttctaagcagcaaagcattcaagaggtgacttggatgctgttaaaaacattcagttttataagggaagcagagcataaaggttcagaaaatttgcagcctgacaatgtaatagaaaagaaaaacccattttctgaggcgaaattgaagccagctgcagaaatttgcacaaataacaaggagctgaatgttaatccccaagacaatggggaaaatgtctccagggcatgtcagaggtcttcatggcagcccctcccatcacaggtctggaggcctaggagaaaatggttttgtgggccaggccaagggtccccctgctgtgtgcagtctacagacttggtgccctgtgtcccagccactccagccatgactaaaaggggccaacgtacagctcaggctgttgcctcagaggatggaagccccaaaccttggccgcttccatgtggcattgagcctgcaggtgcacagaagtcaagaattgaggtttgggaacctctgctgcctatatttcagaagatatatggaaatgcctggatgcccaggtagaagtttgctgcaggggtggggccttcatggagaacctctgctagggcaatgcagaagggaaatatggggttggagtcccctgcacagagtccttactggggcacctcctagtggagcagtgaaaaaagggtcaccatcctccagaccccagaatggtagattcatgaaaacttgcaccgtgtgcctggaaaagttgcagacactcaacaccagcccattaaagcagccaggagggaggctgtaccctgcaaagccataggggtggagctgcccaagaccgtgggaacccacctcttgtatcagcatgacctggaatgtgagacatggagtcaaaggaaatcattttggagctttaagatttgactaccctgctggaatttggacttgcatggggtctgtagcccctttgttttgtccaatttctcccatttggaatggctgaatttacccaatgcctgcacccccactgtatctaggaagtaactaacttgcttttgatgttataggcttatagacagaagggacttgtcttgtttaagatgagactttggactatggacttttgagttaacgttgagatgagttaagactttaggggactgttgagaagggatgattggttttgaaatgtgaggacatgagatttgggaggggccagggacaggatgatatggtttgtctttgtccccacccaaatctcatcttgaattgtaactcccacaattcctacatgtcttgggaagaacttggttagaggtgattgaattatgggggcgggtctttcctgtgctgttctcataatgatgaatgagtctcatgagatctgatggttttaaaaagtgggagtttgcctgcacaagctctctctttgcctgatgccattcatgtaagatatgacttgctccttcttgccttccaccgtgattgtgaggcttcctcagccacgtggaactgtaagtccaattaaacctctttcttttgtcaattgcccagtcttgggtgtgtctttatcagcagcatgaaaacagactaatacagttcagttcaaatggaaagatatggaaatgtaggcatagggaaaatgtgtttacttgaggtcacagagattatacatggtagagttggaaatggtaggaggagctagacatctgtatgtgctcactattggtccttttctaaagattggtctgctgatatatagggtgagactgtgtaaggcctagaagagatcagttgctacagagataagagatgaatagtgaaaccaaagtctgtatagtgctagaagattttgtagtccttgctcagtcagaatggagaaacctcacaaactttcttgggcaataaaggcatctgagatgtcagaaaggccacagcttagaaataagaatgattccttaaagtaagaggcatatcattgggttaagttcaaagtcaaaatatactgccctagcaaataaattattccaaatctgacagggtcaataatctgctagtaatttaactccctgccagaacaaactgagcactctttaaagaaaaataatacaataattcacagtataataaaaaaaattggaaaacaataccaaaattgtgacctgtagttaagagaaaaatcagtcaacagacattaaccccaaaatgattataagttagaatgagcagatgaggactttaaagtagcttgactacattaaggaaagtatgaccataatgaatgaacaaatgaggaatcacagaagagcaacagaagttgtaaaaaggaacaaatgtaattcagaactaaaaattataatattcaaaatgaaaaattcatgaaattgcattaggttgaagatagaataaaaagggccaatgaatgtatagacaaatcaataggaagcatcctatttcaattacagagagaaaaacaaatgtcctttgtagggacatggatgaaatcggaaattatcattctcagtaaactatcgcaagaacaaaaaaccaaacaccgcatattctcactcataggtgggaactgaacaatggaacacatggacacaggaaggggaacatcacactctggggactgttgtggggtggggggagcgcggagggatagcattgggagatatacctaatgctagatgacgagttagtgggtgcagcgcaccagcatggcacatgtatacatatgtaactaacctgcacattgtgcacatgtaccctaaaacttaaagtataataataataaataaattaattaaaaaaaaagaaatgaacagagcttcaataatctgtgagaaaatatcaagcagtctaccacatatgtaattgaaattcctgaaggtgaggagagaatgttcctaaacaatccaaatttggtgaaaaacatacttaagagattcaaaagttcattggatcccaggcaggattaatataaagaaaatctaacctaggcacatgatgattaaactagtgaaaagcaaatacaaggagaaattttgaaagcagccagagaaaagcaacatattacgtacaaataaaaacagacaaataatggagtttatatgtacgcacgtgtaatacatatgacaacagtagcacaaaagacatgtgggtggcaagtagaactctactgtttcaatgctctaacattttacatgaaataatataacattaactctaaagtgtggcaagttaaggaagtatattgtaatctttagagtaaccactaaaaacaaatgacaaaagccatagctaaaaattcaattagaagaggaattcaaattcaagagagcagaaatagaggaaaaaagaaataaaaaactaatggggcaaataggaagaataacaaaataagagatctaattccaaccacatcagtaattatattaaatgaaaatggactaaatattttaattaaaaacccaatattaccaggctggataaaaaaaggcaatccaattatatgctgagtataagaagcacactttaaatgtaaagacaaagaaaaagtgaaagtaaaaggatagaaaaagacaagtcatgcatacagcaaaagaaagccatactgatacgaggcaaactagactttaagacaagaagtgctactagagataatgaggaatatttcatgatgatgaaaagctgaattcatcacaattatgcatttgtatatgccttatatcatgactgcatgacccaaaatgaacagaatcagtcaaaaatagacaaatgtataatcatagtgaaagattttaataccactctttcagtaactgagagaacaaaaagacaaaaaaaaaaaaaaacagccagaatatgaatttgaacaacattaaatgaaaggaagcttacatttattctattctattaaaatttaatttatataaacttccaaattatatcctatttccaatctctctgtattggctgtataatcatatctacaatgtttttacacaacttttgattaatgagtactgtattttgtgtctgtcagtggttcaagactcctgaaaaagaattataaattgggctggtctaggccaaaagacaaccatgtagtaggaaaaatctgtctccaccccatgggaatttttcatcctatgccatctcctgtgaacttccagccacaatccaaacgcataaatgagaagttctcagagacccccttttattcccagaaaacaggaacgcatcgtaacagagtcttctgtaattatatttaatgattatttagttgctatttaacaaaacattaaatctaataatgggtacttcaggcgaggacagaaaagaggacaagtttatggaaagccagtgaagttgatattgctatggaggaattgggaaaagggtaagagatagtagaagaaggtgggagcaggttctggtactctccttaaagtatatatgcttctttataaatacaaagtcattatttgaaaacacacttttaaaaaggaataaatgcagataacatataaaatttgttaaatgcaaatgtttatcttgaaaataagaatccttgcttatccttgttccagtgatgaattgaccttattattagctatcttcttaggataattttagtgtcttggagctagaaagtgaagataaaaatatttaaaaattgacatgtaatttccttcacaaactggccttttcacggtttgtcaaaaagtatatttaaaaaattcatgctagagtcctccacatccaggtcctcatcccggaatacctgcaaacacatgcagcccatttaaggctggtgcctttacttgctaactgcctgccgtgcccaagcactgagaccccataaaaagcctgacttggcctctcaccttccattggaattacctctggtttctagcttattagtttcacacgtatatttctcttccctccataggctcaattgtaggacaaacactcaccaatgctataggtcgctgcctatcagactgccaagctattttccaagggacaagtgattcaagcttcagagacacagtagcttagttcagcttgtggacctccacatttctgggacagggtagcatgctcctgtatacacatttaccatatagcgtaatggcagatataatgctgtgttactaacaaaaagttagtgactaaagtacagaagcattaaggtagcacttcaaagcacaattattatcataaggtatctagagactgtcttccaaataaaagacgtgaactttattattggtttctataatgagtacaggagggaggccattctgtttcaaaacataaagtgggaaaaggtacttcaaaaaccacaagtggctgcaaaactgtttatattaataaatcgccacattggtttttgtaactgacccaaacatcatcagaactcccatcccctcctcattgttttctctggtctttggtgctatgcttgacagatttttcttttctccttttctgatatacacctttaggcaattccaagcatttgtgagatggcctcctggggtcagaggtaggctgaggagggcttacaggcagcggtttcagaagagggtaggggaggtagaatttctccactgaaaactcccgtggaaaaaaatggatttcgttctttgtttcattttttcctatgagaagctaatagactgataaagggattaaacccacagccttggcctcattcacaccacacaatttaaaaagatagaataaatatgtaccttttttctctaactgctgctatactactattttcttagtaatttaaatgccattattcaagacgttttttcgaaaggcacaaaaaagaaggctttttctttttaaaaatggtgactatacctaataatacttaataataatataaagaaaatataattttatttagaaataagcaactagctttgtatagcacttgctatatgccagtatgtttgtgttttactcatatttattttgacctcatgagtacccaaagatataggtattataagtattcccatttttatagatcaagaaatcgaggtattgagaggttaagtaatttgcccaaggccacatgtctagtatagtgatggagttgggatctgaatcaggcattttggatccagaatcccttttcctaaccactgtgctacattgcccttcttcattcatgctccagagtggcatttcccacactttaatgtgtgtatgaatcatttggctatcttgttaaaatgcaaatgcagattccaattccatattcagcattctggggtgaggcctgagattctgcatttttaacaagttctcaggtgattctggtctttaagctacaatttgagaaaaatattacaatgctctaactgtattactgtctgttctggaaaagcctttttttttttttttttttttttttaataagaggggctaggattgatgagagaagaaatacttaggaattaaaagcctgcatgtaaatatgcatatatattctacagctaaaaaattctacagagggtggattttattttaagtaggcttaatacaatcataaattaccttagatgtctgagtgcagttctaatttaaaaagttaagtagtattccaggaaacttattaaaaatagagaaaaaacacccctctatttctgaatatacttagtttttgagttttaattataaaccatttcttctgataatgaaatcagaagttcattactttctctcatatttgatgaaagtaatagtatccaacaccttttaaacagttgttataggaggaaatcccacagataaggctggaagtggacaaaagggaaacttggtaactttctgagctggaagggacatgccccaaaagtgtagtaatttgtctatttcctgagattccccctaagcaaccactagtcctttacgtcttgaaatctttaggccttcgagtttgctgtgaaaatacaaataatgtgtttacagttaacaccgcaaagggatggctttccaaccaggatccctagttgactcaattctctaagtccaacaggaggggttactagtgaaagccagaaattcctgagagaaagttccatcaagttcaatgtgtcagacttacaattttgcacaggtttgcctgagcatatattatttaattcatttcccagagacaggtattatagacttatagcttctctatgagctgaattgcctgttggaatcagtgaggtaggctgtgtgtgtgtgtgtgtgtgtgtgtgtgtgttttaagcaaaagaaaacacctacttggtttttgaatacctttattacattccctgctgattcagtgaacttttgattagcctccatgattactaacttcatttaggaaaatatgtatgtgagtgaaggttcagtaattatttgagacacttgcagataggaggactttcaaagactgactaaaggtgtgaaggcagatcacagtttgtccattttcttttgactttctttcgagctaatacctgctatttagggagaggaagcaaagcagtggttggtaactcacttttaaaattcaatatgattatcctatggaagcagactgtactttctcaaaggctaaaggaaagcagttctgactatttcttgggtattttattggctttgcaaatcacattagcagttttacatgtaggtatttaatcagaagcttattccaaaagtatttatgcaactggtcagtcaaaagcaagagaaacatagtcttggaagaaaaagaaaatgcagatggtaaatggcaaagttgatcccagaatctatggcaactaccaacgccatgacccagagactttcagcatgtagcttgcattttgttgtgacctgaaacattatgtatcttaaagtatgttctcatagcttaaagctgatgggttgagtgcatatactcacttaagttcttaagcagactagcagtgttttttttcaaggtgtctcgtaaataatactaggaggagaaaatagacataagtaaaagttgaaatccataagaaaattaccaaagattccatgaaatagagttttggcatcatgtagataaaatttttagatagttaagtgaactttcatatttcccacagactgtagccaattttcaagaccatcaaataaaaattataccaaatcttaagcgttcaaatacttaatttaaagaaaagcataagtgaaataaaattgatttttaaaaatcaggtaatttcttcatacaacacatgaggcagtaggtttaaatattaaattattaattttttttatctgacagcaaatttggttgagcctagctaaacattctgtacattagaacacataatccagtgcaggccttacaaaaaaaaaaaaggcaaaactagcttttctttttgccaaaaacaatttatacttggcctcacaaaaatagaagcataattttgaaattaattgatgttattaactcctctgatatttagattgaaataattgtaaggctgtacaattaaaacatttttcagattgtagttctaaccgtgcttagacacgtagtaaacaaatgccccacacatttcacatctagtcagtgaaacccaggttttgtcatgattaagattctcaagaaaataagctacgtgtgattttttcaaatgtcctaaaacgtgtctttcttcgttgttgatttgtgtgataattatgccttgttgacttcttttgaacagaacatattagtattttgtatctaattaatagatttaataatcaatcacctctggtacaactactgagaattcctcaaatgataaacagagttaatgtctaaatagaaacaatctaccagatttattccaattgtttcttgtatagtttatcgacctcctatgaatatttactgtattgtgccatatagtttaaaaattatacaaagaaatggactgaaaatgtagctcatattaaaaaaaagaataacctacttaatatgcatatataaagcactcattttcattattaatgctactagccagggggtaaagtataaacacaatgtgacaaatatctaatatcagataatggtaaaatcttactttagtgagaaactttaatatgtcccctaagagttcactaactaattatgtataaaataacctgggttggtgttttatttgcttgcaattcccatgttcactctttagagtagttgcttataaacagcacgaaagtccaaagatagaaggtggtcaaaataagaattgccattataaagtccaaagtttttctctctcacaagacattgaataatcaatgttttcccttaccattaaaattacacatctgagaggtatctatttccttcttttctcttaataacccaattacagcttaactacctaagtagttttaatggatacatttagcattggacagctttgggggaaatgagtggctattaagtgtgtttactactccttatttgtataaaatatacctttcaagcatttaaggacaccctctaattgttgtattgcaggatttggtgattcagtcattgttcatcttatctatattcttcttggtttcataggtttgaatttgtttcctctcagcctgcaaactttaggaccaatctttctatcgaaaaatcttcctatttctttgtaattttaaatatttcctcccccgaattttctccatttacattcagtgtagtaaaggatgtcccaatcagaacagcataaagtggtttgtctgagtgacagcatctggtggttttgcaggaaagagtgttttctgttttattttcaaatcttctggatgacatcagcattcatgagttctctcagttgcagacacatctggcttaagagccagtagtgtaaggtacagaaaagtacaaaatattatttaaggggagagaaaaaattttattctgattctcttttcaccagttttagagccagaatacgatttagagtctatgcacatatagtccaacaatataaaatgtgaggatattttacattttagggttccagagggccaaatatgatacaaatataatccttagctaatcattgaatgaatgattgaatgaagcattgtaccacagtctcgtctagccaaatactatggtcaagtgattactatgccataggaggaaaatatgtattgataaaaatatccctccatattctctctttgctttttgcttcagttgtttccacatgctctctttttttcagatatagattcttagattagatgatgccaagatcaaagcctaagtacttagctctttaatgcttgagcagatttggctgaatccaggcagatattctgtgcattggtagaaacagtactagatcagaaacacggtatagatcatctcaattaaacaaattacaatgattgtatagagaggagaacctggaaaattgaatgaaaaggtctttatggaggaaaaatagaaccatatactcaaatttaattgttacacagaagccttcaagggcatcaggaagtcagcgtatatgtctagcttttggagaagagatgacagcctgctgggataacttgcaacagataaagagatggatggaaacagggtaggggttcactggcttgggcagctccccctggtgagggaaaaagaaacacttcaattcctccctcttcttcataggtgaaggaacatttctctagtttcttatggaaagggaataaaaggggagagaaggacaaacagggatgactctactttactccatctcctatattatccttttaccctcacataaaatgagacagtagaatttagagtagggcaatgaataggttattttagaacagcatcaagaaagatagtgggatataaagggtaaaactgaaaatattggagatatagaaaaattggggaaatgaatggaagtacagatatatcaactcttgcagaaggaaaaataaaggtaaggaaaacaagaaaataatctttgaagcaaaatgaaaatgcaaggctgaagtctgactgaaaatccactccatcctatgagggagttgctggctggctggctggccattctatcactcattcccttagggcccgctgcctcctatccctctgcatggaccagacaaagacctaaactcaatccctaaatgcctcacaagtttaagagcttggattctggagtctgccttgggttttcatcccaggtctgccactttgccacctgtgtcatcttggacaattgatttaacctttctgtgcttgagaatcctgatctataaatgggggtaatctaaagcacttagcgcctagggacaattgggagaattaaaaagagagaatgtgttaagaaggcctagcatagtttctggcttataataaatgttcactaaatgccagttagtattattatgctcttcattgaacagatatactttaagaagagttgctctcccccacaccttgaaattagtggcatagacacttggtcagaaattcaagttgttaacctcactcttcacgtctgtgaaggacactgccttcctttacagaggaccaatggatttcagctgtgcctgcttctcaccagtggacagctctctgccagtttccccaagatttccttttagtcatctccagctgagcctaccctggtacattctgtgctacttttacaactccataagccaagaaaacaaaacacacacaagtgggctcacaagctgagaactgcaagcagaagtgattggaacccacatgcctgcaggcaccaaagctgcaaataccaccttgttctaaagttgtgcccgaggtcacagagaatcccgagaaaggctcctgtttcagccataaatctcccagcactcacattcatccccggacacattaggtacatttgcctcaaccagcagattgaaaatctggagcccagaaaacaaacagttccttgctaaaggcaaaataaacagatttctattggaaaggggaatttttccagagtttttctgctatcccttgcctaaaaacacatccaagttggtaggtactacagacagatgaaaatgtactttcctcaagggttttgcacattctcaaagcagaggacaaggtcaaatgggaaacagggaaatgccattttgaacaaggtccttcacacaagtagatatctggagatttttcagggaaagatccggggtgagtgcatcagtttcacaccctggaggtttcttatttttgaaaaaggtacaggtaaagaagttggcctataatcatgtttatgtttatacagagggtcaaactggtcaaggggctgcatttgcttaataggcccacttagggttggagaggaaggccctgctttagaaatgagccctttttttgtaggttcctgccagtgagacaatagtaacccaattaaacaattcccgagaaagccaggagcaatgaagtgaaaaccaatgaggtgaaagccacttggatcattcagggtgaggctgccaaatcagacatagagagccctgaagagaaaacattttaatgaggagaaagtccttgcaacagacctctgtcctcaactttcaattctacctggaaccattattagacaagtggtctgagaagtttatgcatttgaagagggtgaggctcctcacctgggaactcaaaccaaactttcatgctcattgctaagaacaaataaattttaaaaacccaaacaaacaaaaacctagaaaagtttcctgcctatcccactttacatgatttcatcattagctttcactagttgatttttcctggttgatcccatctggcagcacaggttgctgattataattgccctctcatacttctccactcacggaccctctctatatgcaacacctctgtgtgagcctaagacattcccctgatacatcacaactcatagctcccagccgcatccccaagctggcctgtcctcagaagccaacagatgactttcaaagcccagatccaaatagtctgttctgagatatgcatggggcctgggtagttaggctggtccactgcagggggatggaaatggcatttaggaaccaactatgattgtggggtggcaggggcatgcaaagatgccagcagtactctctaaggctgatctataccaaacgcagagtagagtcagagtgatgacacaggattacttgagaaaggttcagactgaggtgtgggagcctggaggatgcaggaaaattccctatcataatggaaatcatacttctggctcctgttagcgacagaaatgctattgctctgtggcagtgagaacattctcgtggtgctcatggtgtgtcaggcaatccacgaagcatcatggctgccattcacagctttgtctcagttgcgtctgtaccacctcaagagacagggcagctcacacgtgagcaggagctcctttcaatagacaaggtcttgttctttctactttctactaaatgactcataaaagcattttggaattgggggaagaagtcatgcaaaaagaatttgtactttgcaacactttcttcactgagggcataacagattctaaatagaaagcagtggtacaaagcagggcaaagtctgcttaccagaaaagactcagtttgaaaataaaattttgcttccactcacatgcaggaaatgggccttggtatttcattcaccttttcattcagcctctgtgccctcatcttgacagcagatgggagtcaagggtatatgaagaggtaataccagcaccagagcagcaacaatggagccaattgcattagggtaaactgtcctataagacgtgactagagccctaggaataaatttcaagaagataacatgacatgaccactgagtgttctcttagcatttgttttacattcacaagtgacataccatggtccacagcagttaactgtgaagttaagaaaggggcacttatgaaagtttataatttaatatataggtagaaaataattttccaaatataacctttagaatataaatataagcttcatttacccttatcattgactgcacctaatgaaaattcttccccataattcctgagaagtttcagaatgtcaaatgaagtaataaaatgccaaaaatcactcaggagcaatatcaaaaccaacagtttgttattagttgttgtttatgtcacatgtaatgatactttgttcccttcatccttggtggcagtgtacacatggtgctatcagacacaaggtaaggaatcaactggtgagaataaagcaaacagataaccactgaaacgtttttgagactctgatgtgtaatattatcttctgtattctgataaactctatactatcaaacttctccactcacagacttttcctaaaagcttagtcatataaaagtgaacccatgtcataagtacaaaaaaaaaaaatcctgagcccattaggttccttgagatatgaattttttaaaagcttaagatgtgaattcacttgtattggtgacaagtttgtgtgtttaggcactctacatcatctcccaaatcagcctctagaactttaatatatgaatctggtacgagttccctggctaagtcacaatgtctgcaaggacatttcaccaaaacacttcaccagaatataggcagaaaccagctctgaccttcagcatgtgtgtgctgcggttcctttatgagcgtgctgttttacggtggagatgctagaagcggggccaaagtcatgaaaaatccgttgctgtcctctcagtgattctgtactcactccaaacctgggttttgtctttaatttctctttaacgaaccacagccaaggagcagctggtactgtttactcacttgctgcacctgtagttctgctttgcaaggcacagaaatggattttctccacaaaacatgaatttctaaagcctggattttgccccatcttttcatgggcgcacaatacatcaagagcaggaaatgggaaaatggcataattaacgggctgttaagacgcttctattttgcttgcctttaaaattaatctcttcctgctcactactcagtgatgaaaacatcttcctccgaagatgaattagctggaattaactgcaagtgcatcaagacatctaaggtttataacgtaactaccttgaactacctgttcctggtgaacctgaagagtagctggaagcccatactgccctctggattacccagtttatgtcaaaaatgatttctgagtctgccattccaaacacccacatgcaaatggaagcagtttgaccattagcactgagttaaagaacagtgtttgtggaattttcagttccttggatgtgccttcataatttcggaagctgaagcttgaatgttgcccgagtcagtcactgtttcaacaatcatttattgagcactcaggttctttgattctgaggtctgtggaaacagaaatgctcctggttttcaaggaacttacagtcaagctatgaggacaaaagatggtgcccagagtaattacagtgcctaactgtgtaaatagtaattttatgtacagcaggatttgagggataagataaacgtgacaaaatagttggaaaagccttaatgtaagaagtggggcaggcctttgtatgacagcatttggagaggtgcagagtaagatgtgggacctttgaggagggggcacagcaagagtgaagtcatggagggccccacagcacaccacacatcaccaggcaatactagtaagcaaatatttacttattgaggtgagctaaaattaaagcatactttatggctagatccttggtttttggcttctgaaatgtaatctctaattctgcctattttagaactctatttctcactgcttattaagatattttcacccgaattgcttacataccctaacctcactgtgagcaggataaatgtatcatcttttctttctaagcaccttcttgaggttttctttcattggttttgacaatagtattctccagtgtcataatctctgtggctgcttggtccagtaatgggagccaccagccacatgtgcctagtgagcacttaaaacgtgtctagtgccacaagagaatattttggctatattggactaaataaatattattaatttaacgtatttttatttttttactagaaaatttaaagttatatacacatatatatataatggctcccattatatttaaagtcacatttaaatataaatatatttatatttaaagttacatttaaatgtaatgactcccattatatttctatcagacagccctgccatagattctgactatctggattcatacctcgataaagctaaggcttgatcatgtaatttttcttcttcctcctataattcaggcatgcattcatttattcatttaaggtaggtgctttcattttccacattttacaaacaaggaaactgaagtgaatagaggtcatatggctgatgaagtgtgctgtagaatttgaactcgggcaatctgacatacacccacatgttacactgtagtaattcctatgagaaaccatgagggtctgggctaaatgaaaggtggtgggttggaaaagaaaggatgaactgaagagacaccgtgaaggcaaaattaacacatcccattggccagtttgctatatggaataaggacaaagaaaacagacctgatgcctagcttcttggctaggaaacaggtatcaacaaacaaatacataaaaacacatagaaaacatataaaagtatatgtagggggagaaagatgaatttgacagtcaagtttaaagtacctgagagaggatgggcgtggtggctcataccagtaatcccaacactttgggaggccagggagggtagatcacttgaggtcaggagtttgagaccagcctggccaacatagtgaaaccccgcctctactaaaagacacaaaaattagccaggcgtggtagtgggtgcctgtagtcccagccactcgggaggctgaggtgggagaattgcttgaatctccgagtttggggctacagtgagctgagatcgcaccactgcactcccacctggcaacagagtgagactccatctcaaaaaataaataaaataaatacccgagagaagtccaagcggaaatgtccagtaggcagctggatacatggatgtgggacttgagggagatatttaggttggatatatcaattcttacttgttagtcctcctcccctttgtaattttgaattataattcatggtgtaatgaaacatagttcctgacttgaacattcaagatcctgcacaatttggtctcaagctgccttctaagttttctacttgtttgcttaacatacactttgctccaccaaattggattacatacataaccttgatattagttgcattctctatacacttgaagattgaggtaaaagggatctgacctaccatgccacgaaatgtggaatctgtggctttctctaagatttatagaaatttgtggggtaaagcagagaaaagggttacattatcagaataacttcaattattaaaaactttcaatttccacagatacataaaaaagctctgccagccattaacagatggcaatagcaattacttgtgtggagtcactttggatttatgcacaattagggattttggttacctaagctgtttgtaactagaggagcatctgtgattagtttacagctccacttaccttcctgctaatgtggtccctctattacaattagttaacccagtcatggaattcagttctctttcttaattttaaggaaaaaaaaaagaaagaaaaaaactacaaaacccaaacaaaaacaaaacaaaaataccatgaccaaagcatcccacctacacaagacatttagtagaggaaatgaaatacagaggtctggggagaaggaagtactcccactacaggaatgaaataattaacatttccggttagatatacctgttgcagactgtctctcagttttagctttagcctcacatctctttcatactttctctcttcttttcctctcgtcctcctagtggcaaatcccaaatctcacatttccttaaccagagtaattcagctctctccagctcctagcccagctgcagtttcagggtcccctctgcatacctctgctcatccagagccctaggaaaataaaagggatcctccttctttagaaggcaactatgactatgagcctttgctacacaaactcttcttccaaagtgtttgcttctcctctgtttcttgctcaattaaattcaaggaagcaggactccatttcaccttccccatctgaacatattctcctcgacagcccttacactgctatggagacctccattcttctttgtgttagagttattgtgcatttgtttcacatacttcctatctgattgaaaatcatttgatgatagattctatgtgtcttatacgaatcatcatcttggtacaaattggttaagctgacctcaagtgtgtacacatggaaagaataaactacccatatacacttctcttatttcattttgggtaaacctacaaggtgatccctagaatgaccttctttggagatgaaaatggtgaatcaataattctgtaatcatatatctgaaatcctatctaggcttgttatgcctcataagtggatttcagatttgcatgggaaacagattgtgctttgctgctgcatttacccagtggatctgctaataatttaggaagtttggcaaatatgatgcagtgtaacttgtaatatttatttgctctctcggctgtgattttaatcccctaaataacaagctcagacaacatattattgatacgctttgtgctatttatcaatatttacttagatttattttggaaaaaatccaaatgggggctatttagcataactgagcattaaaactatttgatttggtattcactgtttttgaaaatacatattaaacaaacagaacagtaattgatgcaaacctgtttgctcctgtctataatacaagattagaaaaggcagtttcctcattcaggaaaacactagttagttaaaataccatttgttttctttcttttatttgaaagtacattttaaacaagtcaaagagataccaagtggcctgtcagttaacttgatactaaagaacaatacatggtttgtatcttatttccagttattgcacagtaagcatgtggccctgtgcgtcccttcttgttgacaaatactctatctagactttgaaaactactaagcagagccatattaatgaaaccatatttcgtagcttaatcacttgagctctgtaaaatgtgtttgggtggaacatttttgattgtttcaaaatctctgtgggcttattatgacataaagaaatagcacaaggtagtgatgatttacatttggcagtaatacactggggagttgcactggagaagtggggtcctatcttggacctcacatagtggtagcaagcagtgtttgaaattcgaaaccctgcttctgagttagacacacttggtcatcctttcttctcatctacaaagtagcacaagcacagagcctaatattttcagttcatgatgctatccccaggctttaaaaatgtgcctgaaacataataagccctctataaacattttctaagttgataaaatctaattcactcattccactattattttttgattattcctctgttataacatgtaactaatcctgtattattaaagccatttttgtatttttctcttttctagaggaaaatcactaggtatcttctgacctgtatacatccatcataaaaacctcatgaagacttttaaaacatccgataattttcttcccatctatgtctttgactaatctgtacatcagactatgcagtcaagaattatttgagttagtgtgaattgactctggaatacagacatcaaagatgtctcaaagttagactcctgggcttcagtttgacgagaggaagaacatgacctgtcattcctctttcttttcttaggaagtaatatatatatagaaggagtagttgtgggaggagaatattcttcagagattttctttatgttcttatcacatggaggtgttgtttacttgagcgccactagagtgtagactctcacatgtttttcttaaggccattttgtgggatgaaaaaaaatggcccacttagtatcgcagctcctatctacctggtgtatgtcacatttcaactctctgttcagggttgagctttagtcagaacactgaacgggaaccttcagtaaactgggataatgtacaaaggtcagtttacaaatttagtaatcataaacaactcagttagttggctatatgtatatggctttaaatcaaggtgacactcagtattaaccatcacaaatcataagtgaaaactaaaacttatggaatagagagccacgcagaacagtgaaaaaagacttccaatcttagatgcattttggtccatcagtaggtccctcacaattcattaatgggctttaggtcgagttttaatactctctgctctaaaggtgaaagaaacccacactcatacccagcaatctttttctgttgctctggctgggcagaaaaagaggaagagacatgtgttacttaactgcatttctcatgaagaataaatacttcattggcctaggatttagattcatcaaaaaactgattagtattattgtattggagagccagctgctgcttcaaataaatgttaagtgaggaataaaaattgtttcataatatgatcctgatgtcatttattttatattaagtgcttatctcttgaaattttaacttttgaactttctactgttctgttttcccggctctccctcaatttatatgtatgtgtttgtgtatgtgtatatactgtatatacacatatatatgtgtgtacatacaaatatgtacttatatatttatataatgtataaatgtaaatatataaaaatatataaatttatatttatatgtatacatatgtgtgtatatatacaaatatatatgtaaactaatatataaaaataagtatatatatgtagatatagtacatataatactgtgcattaaattctttctctattcaaattcccctgtcttgatacattggctctatctgggcagggggcaagaagatctccttgggtggttacatgtcttcccagtgcttttaggaaaatgtctaaattccttagtgtgtttaaaggccctgagcaatcagacctaacggctctagcttacactttagtcacgtctagtgaataatctaggcaaactgaatctcttccagtgccttgcaagcagatatcatgcaactatctgccctcctcaaccagaatttttgatttttaaaaattttaaattattaggagctattatatttatatgctgttgttcaccataattcacacaatgttgaaatcaacgaacgattataactatggattttctatcctgaattctttatactgatccatcttttggctggctgcattgtaaaattcagaaagattatgaaaaaagggacctatgtgctgtatacttgtttgagaatgtctgttggttgatatataatcttcatatacccttgcaaaataatttggatgaatacaaaatacttgggtcaaatttactttacctcaaactttagtagacattattctatggtccaatattgactgttgctaccacaaaagtttaggttcacctggcacttattcctcctgaaacgcacatataatttcatgttctggaaaattataataatttactgggattcaccttaatgtttattttatatcagattttttagatccatctctttttatttgtaagcttaaatgtgacaatttcaggacagttttctatttcatttattaatgcattttcttccttgaaaacatcaattatacatgtgtgaggtataccatgtttcttacatgtatcttcttcatacaatttttttctttttgtatttctttcatatatttgtttccttaagcctatattgtcttttttatttttaaaaatattttaatgctacttttattgcctttactattgcttttagaatgattgtgctttttcctcttctcttgcttttccaagctctgccagtttctattttgtgtttcttttgtcttgtaatttcgtctttaaaatctagtaggtactttttaaagatttttttttaaagaaattatgtttctctgaattttttgaatttgaaatactatatgtttaacttattttttatgatggtacttttctccttcgcatgtatttatttatggcaatttttaatgagatacaaggaaggagagtggaataaaaacctttttactcggccatacttcagtagatgttctcaagacttaatttttaaaatttttaaagttttctgtgatggaagtgatcaacttaaactggcataaatatgatgtgggactttcaatggtaatcaacatatcctggaaggacatataaaaatgagagagagaggtgtgaacagaaggatctgaactgattaaacatttcactagtttctcataaaaaggacttgtccatatataccactgaggcaaatagttatgagttatctcaacagcaaaatggatacatcatcaggcaaccttttggttgtcttcataaagtatcaattaaaggaactctaccagattttgttaccagtagaaagctatgccttgggtcctgcatgtcctctgcagtcaagttctgatgttcaaagtggggcaaaccagagaagcagcactctttacagatggtcattttaaaaggttcattaatactcacatatgaactaaaaatgctaacttgttcatagtttttccaaggttttgctcttcaaatgaagcttcagcaatttcatcttattttaggcattgcaattatgcttataagcatgaaacaaccaggctacaaccatatatcagccgaagagttactaaacccatctaagttgtgactattatacttaacttcaggtcaaaccaatcaactgtggcccgtttataggatgcacagttggcagtttctcagaaggatcagtcattttgattatcctattcaaatgatggttcatcagttacaacaaatttttcatcagaatgattttggaaagattgtagcactgcccagggagagactatctgtatattcaaatacaggataatacttggtattaataataccgatacatgttatccatcagaagtgcagctaggaaaatggatttgtttttatttatttacttagagtctctttttaaaaacttgacacacaataattgtaaatatttatggagtacagtgcaatgttttgatatatgtatacattgcgtaaaaactaaatctggcatttggcatattcctcacctcataaatttaccatttttttgtgaacaaatgtcatgttaaagggattacattttttgtgtttccagatggctaaaaaaaaaaaaaggctccctggtctcaaatataaaatggcgataattttactaatcctctgggatttttggtagaaattatctgggataatgtctatgaagagtttagcatactgcctgacacatgataactgttcagcattgcactggatacccaatggggatctggaggtcagcgggggaggtatggctgggaagcatgtcagtgacatttcaagtgaagtgacatttgggcaagttgactagctcacctggggacacaaacagagcaaaagagaagaggcctaagaaatcatctgcaaagactaggaggaagaattagccaaggacattattgcaagaaagcaatgaatagatacaaagcttttgccattctggcaggtacctaaagccaacagcctggggaaatccttcaaaatcctttcttttttgaaatatgcagtgcaatattgttaaccatagttacccactgtgcagtagacaaaacttattcctccgaactgcaactttgtacttgctgatcaatctctccctacatacctctctgcacccttcccaggcaattgataaccactattcttttctctgcttttataagatcaacttctttagattctacatataagttagatcacacaggtgatttgtctttttgtgcctggtttatttcatttaacataatgccctccagttcatccacattgctgcaaatgacaggatttccttctttttatgactgaatagattccattgtgtatatgtatcatattttatttatctactaattcactgatgtacacttaggttgattccattatctccatatcttacctactgtgaagagtgctgcagcgaacatggaaatgcaaagtttttttgacaagctgatttcgtttcctttgagtatatacccagtagtcgaattgctggatcatacggtagtcctagttttaattttctgaggaacttccatactattttccataatggatagactaatttacattcacatcaacagtataaaagagctcctctttctccacaaccacaccagcaacgagggggctcaccagaaaaactgatttattcacaggcatctggaaatgaattactctgagcaagaagttactaaatctgaacttggtatgctactccaaatcccatggccaacacttctattattccagcccacattcaaataggtcatgagatatttggacttagctttcaaacacaaggtgccatttcaaaaaattctcttgtcttaagacagaatttgggtcctcaaaatgagaccttctcatgttagctccattctctatattttatacaataatttaaatatgtatatttgtatgcatatatatttatgtgtaggcttatgcgcacactgaaacatacacagacacccatacccacctctgcgagaaaactgctcattgtgtgtatcattaaaactcaacatgaagaggttaggacagataactaaagacaagctttatcaaggagtcaatgacccacagagaagtaacacacagtgtctcgtagagcgaaatcttttaccttgccatttaacagtgtgggcgattcagcaggtgaagatatgggtcaaagggcatctgatctggcttaaaaacagtcactcaatctgatggttactaggagatattagacataaaacattgttatctctcaaccctttgttcagctctgtgacatcattctgctgccctggtgcccctttccatcactatcattggcaccttgcttctgtggctaacctgataagggctatggaaacatgtgtaggcccctgagcaccagcagctgttgaaaggagtgggacaagagagttagaagagagactgtatgtttgagcccagaagagccgtatttcttgaattttggtcattaatacactaccgtcaggatttttgtcacaactgcatgccatctgcactattgtttacttaatattttctttgaattgatccacaattaaacttacaaaatataaacaggaaaactttgtgccattccataaaaggaaaaacagcatgtctcaacagaaagggcaaacaacaataaatataaatacgatggaaataaaacaattggactcaattttgactcaataccattgtcttcaaaagttctaagcagagtcttgctccattagtttaattgctgcctgtggcttggaagtgttccaacattaaatactgattttgtatagaataagtacctatttttgtagccttcctgttcttcctatctgaacgcgtgtggcttcaaaatttttttgaggagcttactggcctaaaaactatacttcctaatacttcattacaatgagggggctcatttgctaaatataacaattggtaagagtttggtatagacattatcacttaaccgagactttcagacctgaggtttgggataaccaggtaatcagaagagaattaaaagtaactttctcactgtgatcttatttaatctacagctgcagtttctttgcacttcaaatcatccctcatagcatattttacaggctttcgataacactgtcttagaggattacatctatagcagcagttacataaatggagcttcatatttttcttgaataattatgaacatatttgattcattcaggacaatatcctttgtagaagtcaatggaattttttttttaaaatgtgagaatgttcctttaacattcccatgactttcttcataattacttcctagttatctttacaatatgttatttcctcctcccatgttatcaaatcatactagtatgagggctgtattgtgatgaacaatacaaaatattgatgcataacattcatatgatttaaacaatactaactcctttcaatcctgggaattcattaaaatgcaagacattttaggatatattcttttgaattatttataaccttcacacaccctcagggcagaataaaggggaaagaaatgtcttgttagaaatataaaagatgggaagttattcatatcttgaaattgccccatttaggaataaattaatcaactcaaataagtgttccataattttgctttcattaataagatgactaagttgaatgcagcatgcacaaagcacacgcctcattgtgatgaaagtgttttttagacaggatgctgaggcttctaggagttgaaaacattcttaggaagactgtgtgattaaaacaggtctttattaacttgagggtgacaagaacatttctcatcttctctgcttacttttttttcttgcactttttgtcacttttgttggcacagatagcaaatacagtctcagaattggaaggagagtaatttccacaaggtgacgaaatgattagtgatgcagcagggatgtggaactaaggtcatcccaactcttcatctagtttgttttctagcatgggcagtcattagtctactcattcattcaatacttggtctggcatagtgatatattcaagcaatagcgagaagaacagggacttcgagcttcatgctctaattgctgaaccatgatacatgttgtaatagcgatatgattttcacataatgatagggcatgacaagtaagaaaagacagaaagcggcaggtggtagtagtagtagtgaaatgttgacatcaaggtcatttctagaaatatttctacatgcaccagccacagtgcaacccgttcagaattaaagtgaactcactgctttgctgaacttctctccatcagtttagttcccacttgtggcttggaagtgttccagtgttaaatattgattttgtgcagaataagtgcctatttttgtgcccttcctattcatcatatccaaatgggtgtgacttcagaaattttttgaggtgcttgcttccttaaataatatacatttctaatattgcattagaaacgagagggttcctcctggtgtttagaacgcaaaggaaaaataaaaagggaactgctttttaacctacttaacatttgagtgcattagaataatgcagtgtcagtctccaaaggggtttatagttcttgatggggagattgagcatagaactagtaaatttcagagcttcccgtgagaatgacagaagtaatatgagtagtggttgggagaccagaggctggtgcctgcctctttggatttgaatcctgacattgcctcttaaatagctgaggaatcttgggcatgttatagtttacctatgcctcagtttcccaatctgtaaaatggggataatcatggtaccagcctcacagagatttgttgtgaggattaaatgagtttctgcataaagcactgggaattgtctggtacagagtaagtactacatgactgggcacttttggcaacactgatggatggtaaagcttctttcctggatcagggcttttgatacacaaatatatgttgtatcattcaaagggtgacaggcagacttttcccacattatggaccatgaacttccctttctggaggatatcattataggactagtatgcttgggatatgtgcttgaggcatttaaaaatatttcacaatggagaatcacatctatcacacgatcttgacttcaaggtttcctttatttccaagatctggttgaatcctgagggatactgatgtaacaatatctttgtaatataatggtgttgactatgatgttgatgatagaaactaacgttgcttgggccaggcactttactgagtgtggactgtgttctatttcatttactctagacaaaaactctatgaggtattattatccatactttaaaatgaggaaatggagacttagaaggtaaaataacttgatcaagctcacaaattaagtagcagaatcagtacataaatccagttttatttgaccccaaagcccatacttccaagcaggaaatggtactctctccctgattttggtggtaataaccggggaagtgatagtaggagcaatgcatattaaagagctttgaaaactgtggagcacagtatgaagacaggctattattaatagcactaaaattatgcttatgattatttttgtttaattctaggataagaacactatactatctatgtgctaatagttttgaaaggtccctaaaataaatagttgaaaatataaaacccacagttcttaagtataaaaatgtacctttttctgggaaaaaaaccaagtatgcagtgtttaattaatttttataataaagacataatcttttcacaggagactttgtatgtagaatgtaaaaagcaaccatccctttaagaaatatagagaaaaattcagttaaacaggtataccgggccactagataccaagtaccaggtacacaggctataaaatgtctagtaatttgaaaatgccttttgaataagtactaaagttactgaagactaatacaaaaatacatacttttgatgtgaacattcagatgtaaaaaagttatgttagtatttattagcatatttttaaaatttagaaaataagatcattttagtctcttgcatattattagctgattgggtttctcctgaaaaaaaaatcacacttgcttttatgtcaaaactaaagaaataatttttgaaattttttttacttgtaatgtatatatcatcatgttcactgtaagttgaatgttaatagcctctttcctctgttctttgtattctctgaggttttatttttagttttcaatgggtaatctcacaatgtcacagctctcctgactttgccacatccagacctaaatctgccagatctcctttgcataatgaacaatgtgaatatttctcgacatgtacagcagttaaaacaccaaggtactgcagggacaggtgcaatgcaaatacacagatggagaaactgaaagacttcattaacatcatataatctcactaatgatcaactctttaagggaagctctttcttcagggataaaaggagagaaagcaactggaacaattctgtataaaggaatcgctgtttccccaggctcttggcattaggtacctgccagaatggcaaaagctttgtatctgttcatttctttcttgcaataatgtccttgggtagttcttcctcctagtcttttcagatgatatcttaggcctcttctcttttgctctgtatgtgccctcaggtgagctagtcaacttgcccaaatgtcacttcacttgaaacatcactgacatgcttcccagccatacctcccccgctgacctccagatccccattgggtggccagtgcaatgctgaacagttatcatgtgtcaggcagtatgctaaactcttcatagacattatcccagataatttctaccaaaaatcccagaggattagtaaaattatcgccattttatatttgagaccagggaggctttctttagtaatctggaaacacaaaaaatgtaatccctttaacatgacatttgttgaaatatttttatagatttcctttgttctgttcctcttttacacaacatttttttccgtttttattggtatataatagtggtccatattttggggatacatgtgatattttgatacatgtatacaagtataatgataaaatcgggataattgggatacctatcacccaacacatttatctttcgtgttgaaatgactgatatcataaatacaacctccacatccggattaacatgtcagagctgtcactgtaccatgtgcccgaaactgacctgtctaccattctctacatataccctgactaacagagcataatgtgattactccatcgcatgagtaggaaaccgacaggatcaacatacctcaaggtgtttttggttttgttttgatttttattagcatttgcatcaggcttttgatacatcgagcttatgatccatagactctaccaagaacttttccccctatttgagccatttcttaaggagatcccttcctttctctatacatgaaactcatttttaagacctgatttcagtaccactacacagctattagaatgattaaaatacagaacactggctacaaatgctgtggagcaatagaaactctcattcattgctggtaggaatgcaaaattgtacagcctctttggaaggcagtttggcagtttcttacaaccctaaacacggtcttatcatatgatccagcaatcgcattcctggttatttatccaaatgagttcaaaacttatgtccacacaaaaacctgcatgtgaatgtttgtagcaacttaattcatatttgccaaaaactggaagtaaccaatatgtctttcatagttttaacggataaacaaaccatggtgcagccacagaatagaacattatttagagataaaacgcaatgagctctcaatccatgaaaagtcataaaagtaccttaaatgcccaccactaagggaaagaagtctgaaaggctacatactatatgacttcaactatgtgacattctggaaaaggcaaaactatagagatataaaaagatcagtggttaagggttggaaagggagaagggatgaacgggtggagcacagggggtttctagggcattgaaactatattctgtataatactttaatattggaaacacagcattatgcatttgtcaaaaccgacagaactgtacaacacaaacagggaacccgaaagtaaacaatggactttagttaataataatgtatcaatattggcttatcaaatgtaacaaatataccacattaatgcaagatattaataaaggggaaactgtatatgtgtgtggagggagggtggggcaggtatatggaactctctgcactttctgttcaagttttctataaacataaagctgttctataaaacagtctatgaattaaacaaattttttaggaaacttgaattcagaaatgtctacttatctgttgttatactggtttcttactagtttctcattgggtaattaagaaatattgattctgtcattttatcctattaatagttatttctagctctgagtcatctacaattgtaataaacataccttgcttctagcattcatacaatacaacaatgtagacagaataagaccatcttacttcagactataatctctttaggtacaacttttcaaccagttttaaatatgcccattatttaaccccaatttctctcacccacaaaaatatcctgaaagattatgttaatattttaatgaaaataaaaatatattatgcagagcacattacctggcccacagctgttacttattaaattgtggctattgttagtattttcctgccataatatagtcgctataccaacacataattgttagtttgttatttctcatgttcagtgatgttagtctggcttctaaggatcaccatattaggtgctaagtgctcaagagtaatctgtttaattattttttttcgtcttttctttcaaaggttgacactaagtctacctattttttgtttacaaaagctacccacatttgcccttttaggaatcagtaataccctaatgttttttcccatttcaatcactttcagaacctgggtctgggcatttgaactactttaaagagacccactcgatattttctttacagctctcagggccatctttgtcaacttgagatgaaagatgcacctagtcaacttgtttcagttgcttctacatgatgtacttttttttttttctactctttgccctttgaagacaatgtccattcaaggagaagatgcaacaagccaggagtcatagttctgctttctattttacctttaatattagagtagtggtgaatttcttcctatacatgttataaagagtgagttttgttgttattggtggtgtggcatttgctgtcagctcagcttatgctaaactttaaggctttttataagtttgtgccatattaaccctgggacatattctaccttccatctcccttaaacgtccttttaaaacctctaattctatgtaagaatccttcattctctaataaacttgagtaaagtggcatttttcagggacttttgcagtcatcacttatgcatttattttttaaaaaattactgagcacatactctaggctaagcattgtgccaggcattgtgaaaattgacattactaagacccaatctattttcaggaatttgactgtataatcaatactccataaacatttgttgaacacctgctatgtgctaggactaaaagacttgtgtaaatttattccggtataatacaataactatatcaacaggaagacatacaaaatacagtggtttcagaggagggtgtgatgaaccctacggacgtagggatgggagcaagccaggaaaatcttctaggaagacaatatattcaacctaggtttcaaaaaggagaagttcacaggtaagaagaaaggaaaagggagtctagtggagagtatgataccaaccatagttaaatactaggatgggtcattttgctttttgaattatcctcttttagtattctgaagaaaggagatggtttaccttttcctacagggaacatcaaccaatgtaagcgtgaacacatctgtaagagacatacatttagcaacaatctgcaagtcggtgcaaaagttttctggaagatcagatttctacagttattaagatgattgcttttctgagcagctcttaggacccctgtgaactgcaatgaatatcctctttgctttcagttcaccgtgtttgaggatgtcagggagagctgctttccacctactagccctgccccgctttaggtgtcagcaaactagttggttacttgtagcaattggcacatagttggctttcacagtgtcaaactcaatccttcttctcaaactcttttacatctgcagaccatgatgaaaagttttctatgttgttttattcccttatcacagagtcaagaaggatgctttgggaattcttttggaggaaaagattaagaagtcagattctcctaggttcaaatccgggccttaggttggaaaccagaatctaccatttactggctgatggacctttgaacaagatatttcagctctgtgagtctcagtttccttattttccaaattggaataataaggtctactgaggtccttctgaggattttgtaatataatatatcttaaaatgtttagcagagttctagacatatgacatattaaaacatgatagtccatgttcttttaataaaagtaataaaaaggagaaagggagagaaaaagaccaacacttgcacagacctttcagaggtagcaggtggtatgttagacattttacatattatctcatttaatcctcacagtaatgtaataatcaattctatttttatagactaaaaatacagctcatgacaatgatgtaaattgtcccagggcacagactagtcagtgtaagagctgagattcaaatccacttctgtatctccaaagcctatgtgtgcttttcaatacattatacttagaaaaataaagatttttgcacaagtatattcaataatctccaaagcctttaataatatgcacaaacttaagaaattattttcatgttctggaatgctgaatttatagtctacacatagtttaaatggaataaaagagtaggctgggcgtggtggctaatgcttgtaatcccagcactttgggaggctaaggcgggcagatcatgaggtcaggagatcgataccatcctggccaacatggtgaaacaccgtctctactaaaaatacagtaattagctgcgcgtggtggcacacccctgtaatcccagctgctcgggaggctgaggcaggagaatcacttgaactaggcagtcggaggttgcagtgagctgagatcatgccactgcactccagcctggagacagggcaaaactcggtctcaaaaaaaaaaaaaaagaataaaagagtaaaattgaatcaagtatcttatgttcctgttgaaaccatattgttctaatattttcaacaccacaggcttgaagggcagtcacatagtaaaactactaattttgaaactactggcaagatgaaggattgctttatgaagtttatgtatttgttttgatgtatgtttatgggtgtgtgcatatataagtttatatatacttttcccattttccattttatacaattaaataatagtttaaattatgttacatgagtaacaaataatagtttacaaaggtaaaggtaaatcatctttgctgcaatctgttttttgttaggtttttttttttttgagacagagtctcactctgttacccaggctggagtgcagtggcacgatctcggctcagtgcaagctccgcctcctgggttcatgacattctcctgcttcagcctcccgagtaggtgggactacaggcgcccaccaccacgcctggctaattttttgtatttttagtagagacggtgtttctccgtgttagccaggatggtctagatctcctgacctcgtgatccgcccgccttggcttcccaaagtgttgggattacaggcgtgagccactgggccgggctcattactttttttctgaaggaaataaaaatctaaaaattcaaatgtaagagcaaccaaagttatgattgtctttaacttagaagctgttgactgataatactgagtttgataaaagagcattcaaagtacatttgcactttttaaacagtaaaataattgagtatttttatatttcataagtaaacatagaaactgcttctacacttctgtcaatccatgtttaacaaatgtataccagattgataattaaaatccttgagatatggcaaggcaacttttgaatataatcaatataaaacatttcattaagagttgcataataatctgcagtagatagaaccatttaaaagcagaattctcatcttgtcattattacctagatacactttgcataaactttggtgagtagagagtcttgagcaaaaggtagtattaacacgtttatggctcatttccttttttagttacatctatgagggctctaaaaatggagtctttaaattaattataaatgcagaggctgaatatttaaaacctcttaagagcaaaggtattttcaattacttcatacttacatattttggaaaatacactgatatgggacatattccacgaatttaatattcctccattttcttgttaaatgagcatggtgagcagtagagataaagattactttaattaagtgtgcaatgaatcccataaaacttaattgaacactttattttcatgcagatattttctcttactcaaatgtttttcagctatgctgtatgcaatcattttaaatctaatatttcaacgaataagcaaaggttttaagacaattcagtgtcttcaaattccttatggcatttgagaatgacctttagattctgaaaaggtgagtgttttacatttatttaagctgacaagaaaaacatagaagtacctctaaaccaaatcagtgtttagaatagccagagccattttggtgaatgcagaaatagtgatggctgcagatttcacaagtgctgaattacttaccatgaatggacatctgttgggctgcaccccagggcatttattttgcctgtcttctagtgtttcccaaagagacaacacaagacaagaatttaatatccaacccctgtgtatagctggctttcactctgccaattactattcttccaataaatgtgatatggcatcatgtgatcatacttattcttccaataaattacacagaaacatccagaaacaaatcctataaccatctgaaatttggttggttagccaaaaggtctgctggcagatcacagaaaacaactgagtgcgcgaatcaatgtagtgaggtaacttacgcaggtcacacatgttcactgtgaaacttccctttagctcagcaattagaaaaagaattctacatttaactgcatggttactacatttggtaaaaacaaggtacttgttctaagtgtcaaactgatagttcttttgaaaattctaactcagatttccatgttgttaatgaattgtggcaaaatattgccatttaagttgccaacacatgtcagagatagatgatatacacacacggtatggcagatgcacctgccagcaataacttaggcacacactgagaatgacagtgtggtctaagaaggggtgttcagagtttcaagttaaggaatctttgaatggccaacctggaggtttactccttatttacaaaggatatctgaatacctagcccatttcttggaacgcaggatgtgcaaggcactgaggccctttgctttgggttaaatggaggttgctaggtggaggttgctaagtgaaaatgctatataacctgcatactttttacaaatggtagctgttatcctgtccagcctgccactcctggacactgccctatatgtaagtcctcaataaaccttatgtcttattcactggctttgggtctcttcttcaacctctcagacagggtgccatcactattggagtcaataaggatctggtaaaacacacacacacacacacacactctcacacacacacccttctttttaaaaaatctttcctggcctttcatgctttgcctttcttcgttctttctaacaacctttctatctacctatcctcttttcatccccccattgagttttttttaatctcttttaccatcttttctcacatctttctgcccatatttcattctatgtcagtttatccagttattgttttaacattcaatatatatttgagtgcctactgtttgcgaagaggtggacatattacctgtgctaggtcaataaaaatatttttaactcttcgaataatttgataaataaaagcactctaagagagggtttgtttccttattggtttacattttggtgagtaatttaagtgtataagtaagaaaacattaaaaatacaaaaaagaaaatagattcctggacacgtgtgtgtgcgtgtgtgtgtgtgtgtgtgtgtgtgtgtgtgttgggatatattgctcttggttagaagaatcagatttattagtttttctgtattttcatattttgtatagctttaatctttaaccagtttagagtacagtaattttatgttgctagtatagcctaaaacaaagatttttcctggttttggatttagagcttttcaaaatttcactgaagagaagtgatgtaaaaaagaaacagcaggccagacgcagtggctcatgcctgtaatcccagcactttgggaggctgaggtgggcggatcacctgaggtcgggagtccgagagcagcctgaccaacatggagaaaccccgtctctactaaaaacacaaaattagctgggcgtggtggtgcatgcctgtaatcccagctactcaggaggctgaggcaggagaattgcttgaacccaggaggcagaagttgtggtgagccgagatcacaccattgcactctagccggggcaacaagagcaaagcaaaattccgtctcaaaaaaaaaaaaaaaaaaaaaaaaaaaaaaagaaagaaagaaacaggaaaaattaaatgattataatgtaaaattaagtgattataaggtgaggtttgaacctgattttcaagcacttatgattcaattttgtaaagaaaatgttgaaatcaaatatgtgactccatggcactgatggtgtactcttatttaaaactcaatttttgaaaaaatttacttgaatgaagcatatgttgtgccttgcctacacaatttacattgattcttcatcttctctcacaaatgtctcccatatcccactactcattttttgttaaaattccaggaaaaagacaatagtcatcagacaaaaaccagtatacaaattaagttaatggaaaccaagagtgaaggtggcaaaggtgcattcagcattgaaactaaatagcaggatgatggcataaaaatagagacaatgaaaaatgtatcgctattctgaaataaacttcacattctcttgatctaagggaacctgggaacaggactttaaaatctaacactagaaataatgatgagaggaggagagccctcaaggcattttaatattgaaaatctattgccatatctagcagtattattataggtatgttgaaattactgtacattctattaaatctaaagaaggtgcctctgatttcactggctgatttagtggaagcaaatcaatgaacatggttattgcaaaacctttttcgcaaaatgtaattaaaaatccttatcagtttgcatattaaatgaatgattaatattttcccaaataggcagaatcaaaagcttcctagaaaatccgggtaaaattgtaatgctgctgtgtgaaggtatattcacagtcagcatgcagcaacgaggaagcaggaagcctcctgccttgacaaacccgcgtggttcctgaaaacgtagtcttttggtgagctgatggcagaattcacaacttaacatgaagatattctgctctcattcagcacacgcaagtgaaccttggctataactttctacaaggtttctaaaattgagaaacaggtggatttaaaaccagagatacagtcaatggagtgtagactactcagagggctatggctagagttaaatggcagcttataaaaatgttatctggggcccaccttgaacctttgaagaaaaaggatggttcttgatgtaatttgcccatagggcctggtgcctgtggtgtgctctgaaagagagcatctatatccaaaaagatgtgcctgctgagaagggctgctggcagctgtggtgagcatacatgaggctgtaccacgaaagcaggagagacaccaacgaggcatttgctgagcactgccgtgacagaaaagacatgtacagggaaacatacatagtagacagtgagatgatccaagaacagagtgcatagattaaagacagtaatgtttaaagaagttttggaagttcctgggataggatgttaaaagaaccaacccagaaagagagttttaaaaagctttgtcttccccactttcatttagatgtattctaatcagagactctctgaggccttttacattaagcacagcagcctttgtggagaaataaaaatatgtattaattgtacagccctcatagcaattaaatatctgggagtagatgctaccatgtgaggtcctggaatataagcgggagagcaaagatgcaagaataacattctgggaaactccccctcgcaaatggaggtggtttgatatggagaaagtgatgagctagagaaattgaaagtaaacaaggaaaggcttccgtttaggaagcaaggaagaataaagactgtcattatttttcatgtctactatgcatactaagtagtgttttagtcaatgttggatttgttgcataatatagcaaaggacctagactctaaaaagagttaaataaatgtttgctatagataataggaaggaagggggaatgaaagaagggaggaaggtaggtaggagggcaggcaggcaggtagcaagtagggaagcagatgaacaagagtgagttaacccatcaatgtctcatttatatgtaaaatgggaattgttgcaaaggttgtaagagataacacatgtaaattgcttattgcagtatctgatatactggaggtgctcaagaaatgctaaatatcattatcataattattgctatctttagcatcatcatcctcaccaccaccatcattatcctcggagcatttctaaaaaggatatttgagaaatgcttcagtttgctgggacctacaaatgcatctttcttgataatcctcccactcatgctttaacccacttctatttagcttctactctgcgacactccaagaattaatgcctgccaaatttactaataacatctttgttgtgaaatccagtggacaatttttagttcatgccttacctgacttcactgcagcatgtatcattactgatgacttcttacttttggaagcccttttgcttgtctggcttttgtgtcaaccctactgctcatatccccctatacctgtagcccttttaaaggcttcttcctgagtttctcattctgggggttttctccaggaaccaacagcaagtaagactcaaaagtgttcataaaatttagctcattttcaagggaacagaaaaattaatattgttcaaaagaacaatattaatctacaggccagattttagaaaaaagttattctacatattaatgacccacataaagtacatagcttgtgtttttaaatcctaggtcaaatactttttttacaaaataagaacctgatttttttttttttttacaacaaatacatgcaaaaaatgtatttcgttaagcagggatagtcagtcattctggatggtacttgaacttttcaaattcccataccattattcagctttaagaaatgcttgatgatgagctaaaggcaagcatgtgtgttttagtctaagaatattaataccattgctatcaaccctcaggaatgagtttataaattcaataatactatcatagtgcgtattataactatgcttctataatcagttttcctcatattatttcagaatacgaattgaaaaagttacctattatgacatatgcaaaataactatagttaacctggggaaaatacaaataatttatcaggcaaaaaaactcacaaaacaacaaaaaaagttttctgtgtcctcagcgttaattcattaaattcagtgaatctgggcttcacatacacacacatatggcattagtgagctaacccagtttgtactgatatgagcaggtgtctgtaggtaggtcattcaaagtcatcataaaccagggcagggttcctagcatatgaatcttaaattatagacactggtattacagaatagcaatgggcacatagagactatgtctagatagaggacttttggcatgttccttactagagagcatgaggtttaccttgcacaatagggtttatcaagccatgtactattaacacgtgcatttcattatgagaaatccttaggctattctctggagaagttgctgtttcagaaattttaggtgtcccatatggcatggataaggatgtaattatgaaaagatgtagattatcacagaaagatatacctttaagttattttgcccaaaactagcaaatctgaggtttcttccagaccatgaggacctgataaatagtttcttttctgaaaaagaaatggaataactctatgaaagaggctctaaatgggaggcagaaaatgaaagaaaaatgtatgttattccatggctatgatttctctgcttaactttcagggttaaaatattagctagctccatcatcatccagtcaaatccgtaaaccaaatcccttcctctttcagaatacctcttactttaggttctcatctcctgagtagactattgccatcatttctctgctttaacttagtctatgcacttcggccgtaaagcaagacaggaaaatacagtttgggatagatgaatgttcagcaccaatcatttaaaaggggctgtcttacctataggacacacttctaaatattatcctgacctctttcatggaccactccaatccggcttcaaccacttgctcttaacatcctccttgctaatcagggcctgcatcacagtgaaatggaatttgttaagccactttgccctcaatttgcatgaaattccattttcctgactgctttcttacccttaggaacaactccagcatcataccttattgagccccttttccgatctgctatttgctcagcccctactttgtgctccctttccactcagcctaacacggagcacagtgaactgtaatcactgattttatttctctagaaagaggacagattctgtgtcccattccactttgcactggaagtgcctcacttgggcacaggtgtgaacacaagctgggaatgcaggaggtattttaaaatcagtgattgcgtccattcaaatttgtcccaaaggagaaaaaactgtttgtgaggatttatgtgtttgcatgcgcctaatttaagtgtgttattttgaatatatcagagataaattgttttataaataactaaaataggtggtggctgccaaaagaggtgttagaaaaagctctctacttgccttttgtgctttaaaatgacagttttaaatggtgctgctgtagggaaacctggctggaaagtaaactgtgaaaaggtataggcaggaaaattgctggtacttactgagggcatactacgtggtggggtggttctaagtgttctgcaggtattaactcatttaatagacaggataatcctacagtgtagacaagatcatggcatagggttgcgtgactgggctgcttgttgaaaggcactcggcagagagtgggatggggcagaaatccagccctcactcactgcatcctgttctgtgaccttgcctgggactctttctttgcatcaagatacctttaggtagtaaaattaatgggtatctgtcccggtgatatacttttcccaaattcacacaaaagcacagaataagcaagtggcgttcctagtggtaggcactataagtattcaatttacagttgaggaaactgaggcacaatgaagtcaagaaatctgccaaagtttatataactagtaagggacagcgaggagatgcaaacccaggctcatggctcagagactgcatgcttattcactgtgatatgctggttctctgtcacatttggagtgctttgcccatgctagtttacattcgttaaattttacatctattaactaacttaatcctcaaaataaccttaaggaatcagcccctaaggataaacagctatgccttggcccctgtaatcctaagagatgcccctttgtgggcatggctgtccctggtgaaaacagaggcaaggagatacttcactgatcagaactaattggctaattgatatgcttcagacattttgccaagaaaaagagagtttaattaaaacaaaaaactatcagtagtactgggagttaaactagtgggagctgagaaatgtaagtcagaactgaaattaaaagagatctagaaagctccaacaatatacttagagggtattattggcagagtgatatactagataaaacatagataagaaagagttgaatttgtcaatataaaatgcaatttggtgtgagataaaagcaacacctcatattagaaaggaaaagtactaagataactgagctgatatttgaaaaaacaagttgaattcttatatatgtgtgaaatgacttacgtactaggttgtttactataataacatttttaatagcagaacattaggagaaacctaaatagacaaagaaagtatgtgaaaatctcataaggaaaactgcatagctatttaaaaacaaaatttaaaaaaaggtctatataaattgtcacaagatatctttcttttgcttttttatgcaaaaaacatatctctagaatactatatgagaaaccaataaatctggatatttctggagaaatattctgggtagcagagggacagaagtggagggaaaagttttcactgcttatcattttgggccattaacaacttacctattcaaacaacctagaaaaacaaaacaaaacaaactttggtttgacttttacttagtgcaactttgggctagtttactaaatttgcagagactaattttcttatttgtaaaatgacaattataattcctgcctcacatagttttatcaggtttaagtaagataatatatggaaagattctataacataacctgacacatagtagagaaataatggttcccttgactatcacttttctttctcaggggatgcaaactccagtggctactaactagtccaggcagacaatataaatgcgtgacatatgttggctgtatgagattagggagtggtagggcatgtgacaacttaaggcattcaaattattctatgtgtgtatatcaaatataaattatacatatgcttatatattatatatgtatataaagtcttatggctgtcattcttgcttttacatagggatctgcatgttataaaattatttcacaatgtctgtttcaagccactgaaaaatcatttcaactatattgcacaattagaatattatttttttaaattggtttcaagttataattttctctaagttatttaatataattggctttgctttttcatagaaaaaaatcatgtccatggaaatatatagctactggttgccaaaccacaattgggaggttaaaagcaaaggacgcctctgatatcttggctactattctttgtgacagacttgatggataaggtggtgctgcttgcagctaataaatctgattgaggtaggagtctggcagaggtgacacaagtttagccaagtcagaaggttaataatagcaaaatcacacacgggtgggcaggatcatggtcaacagttacgagaggaatttcaggtaccatgttcagatttaaggaagcaatgattcaacaacattccttgcctaaacaatccttctgtttcaaataagtcaatgttaaataaacaataaaccagtgaccaaattaacatttattctcaatcgtctggggaacttcatattctcagaaaacaagtttaaatacagtttatgatatatatccatttgacaccttacacaaatatgtatactctctgtaaactaagcacatcattattaatttccatatgaaaataaattaagacttgcataggctaacgtaactgactactattcatgaaatagcctagaactagaatcattagccatatggagcaaatgggaagtaaagcactgcatcattttatttttatttacttattctgtgtggacaccttcctaaactctagagagcagagagagtctcaaagatgagacaaggtccttgatgctgtgccatatgaaataacctccacttaacatcatgtttctttagtcaagaagaattgaagaacatgtgctacacaactgtacacaaagtcgcctaagtgaaaagctatccttagtccatactaatgagacagtattgcttttctctctttgggattagcccaggtaaaaaaaaagactggttatgccacatgcaaatttgaagacttctctttatgaaatagttaattttgtttctcccaattatctttttagaggcagactaccttgaatagtagtgcaggtctggagcctactattttggccttatgtgggaaaaactgcattatattaactttacctctgggatgagattcctgatattccaatttagaatcctgagaatactggatctcagcccactctcaaatactcctgattttccttcccctcatctttcctgtaatcatcgcaggatgggataataaaacgaaaggaaatcctttctttatttttgcgtgcatgtttttcttccatgtctacccagtgcctagcacggtgcttttaaaccaaggaatagtcaataaatctcatgcagaatatataaaatgtggcttcgctaaatgccgtagacacatgcagtcttcctcctctgtgttccctaagcctgctgtggaaatcagcccctgcattttctttgaaagactccagtcatgcatctttctcactgtcaagttgaaaaaccaccttaaggatcatttctcatttttcacacccaagtctctagcacagtgcctagcatgacactggtggagaaataactgttgacccaaacacaactgaacttagagatattgtcactatctttgtaagtaatatgctacattttgtaccttttgttctgaccactgtggaatctgtcatttatatccaggccacccattaacaatggaaactatgtttaaccagcactgtttaacttaaaatgaaaataacaggaaattgggacataagtgataatgacaaattggttggaacattttaatatgaaacaatgcattgtttctcctttatttagtggtggggattatgaatgactgactgttgaaagatgtttaaaagatcctgtatgtttttattcttaatggagtaaagctaatataattcacctttttcgttcaccatttccttctgatgtaacataattaatgctgtagatcatttttgggcatgcagtgatcaaaaaacaacatgaattttccacttttaggatgctacacagtatacatgggcttataaagtaatttgggccagtcactaaaattattgcttccacagaaaatagaaacatagagaagtgataatttttcaatgcttatgtgagcaaattttgaaatgaaaagaaaattccaatctattggctgagcacaatgggtctgttatatggacatcatgtaactaagacataaagctgtcatttcaatgagataaaatactttacaataaggttagctttactgtcaagctcaggatatgtgaaattaacataaaatatatgttaacgtgcctttgaggtaagccattagtggcaggagtaaattttagtggttgaccaaaatgacttcacaagtccacacatatcttgttcttgcctaagaatgaaacatttatattgttttatgtatgtttctcatggccaaagtaagctagagtgccaattatattgtgttagaagtgaatattttttaaaaggtgaattatgcttatcagttctattccattaagaagaccatacataggatgataccatctgttgatcttttataagaggaaatttatcatgctgtttcagtactactatcaaagacaattaaagtggagtgagacatgagaagaaaagtctgatgtgaatggagctatattttcttagatttaattttcaatgccttctttcctagaataattaactgatcaaaagtttatttccctgttaaacagtgatagcactgggctgttgtggagattaaaggagacaatatatgtaatactcttagcacccacaaattactcaatacatggtaactattaatattaaatacagtaacataaaactagtgatgaagtagagagcaagaatgtattgaatcacctctggggattttatttatgattagacatacttctatgtatatttcaaagtattttcttccatatcggagtctaaagaaaaacagttaaaagttaaatgatacagtttacttaataatagtaggaggggctgggcttgtggctcatgcctgtaatctcagccatttgggagaacgaggtgggtgaatcaatgaggtcaggagttcgagaccagcctggccagcatagtgaaaccccgtgtctactaaaaatacaaaaattagccaggtatggtggtgtgcacttgtaatcccagctactcaggaggctgaggcaggagaatcacttgaactcaggagatggaggttgcagtgagcctagattgcaccactgcactccagcctgggcaacagagcaagactccatctcaaaaaaaaaaaagtaaggggaattacagaacaagttcacacactcagtaagtggcaagttcacacagccagtaaatggcaaaaccaggatctgaatccaagcagtgtggctccagagcctatgttcttacggactatcttggtttcctctctgtagtcacatggctgagcactctctggatagtatcaagtgtttacataaactaggtttgcagatgatcatctcttatccttttaaatgttgcatcacaaatttttgctgctattatgaatttgctgtcatgtaaaactttatttttccaatctgtattaatgtcttaaaactgctatctcacatttagtttaaaaaatagtcatttctttgctggatttgcctgcaaatttatatacatataccatacacaaaaggaaaacatcctttgaatagaagtcaacaactttcaagataaaacaaatgtagacaataaatattaataacctagaagcacttgataatatttactagatcaagaaagttacactctgttttccccaaggcagtaaaggagccaatgaacatcttttttaataataagaaaaaaatttaaggattgcacattgcccttgaagaaagctaagcatttaataagttgaagacactttttaccattctttagggaatactgtatttctaagaatggcaggtaacatgtgctctgaatgatactagcaaatggtaactgcaatatcattcctcttaaagtgatgttataaacccagtggaatgttgggagagcactcaagcattcctctaagcatgaattcccaagttgcacaataatgctaagtgcatcatcctaaacatatgctgttgtttgtgttttcagtttctgcttatgatagctatagtggtactgatgcttgggtatcttctaggagaggaagctggtgagcattataaattctagggactcctgatggttgtctatccctgggctctgctgcatgcctagtggcgaggtagtataggggaaaggtcaccaactgaggaaccacaagggaaggattctaattgcagttctatcagcaattagtttgggggaaattattatacctctcagagccgtgatctcttaaatgtgaatattaatttttattatttcacaaagtgctcattaagataacaattgacatctgtgaaagtgctttagaaaaaaaatgttttgtgaacaacagatacccacaaaagcaactgagccacaagatcacagagcccataaagtgactcaaagtgtttctggattgctaccatctgatcccattacttagctatttttcaactgacctgcaagcttcttggctggggcccaggactacattttccatagcttaagaccatcatatgtaggataataaattgaatctacagatttttttgatggcacacaagtgtttgcctctgttctcctacaactttgtaacatttctgcctttcatcttcactatgctcatctatttttatatttacatatgacaatacacttgcttcaacctcagctttagtcataaaaatctactgttctctcccatctataaccttcctccaagtaaatccacatgtaaaacaagtttctttctctctctctggtatgacgtacttcttcagccctgtaaaactcagtgcaaacatccatcttctaaatgaagtccttcctaattgatccaggtgcatttaccatgcacactttttcatcatgcccaatgatgtataatacacagacacacctgacatacatacacacatatttcttcccttatgcagttatacaaggatgcagtggtttccttctggagatctaaacacaacacctcttcagccttcctcattccaaataaactcactcatagaaagctctaagtcagacacagaccaaatgaaaaagcccaaaagtgggagggaataagctagggaaaaaggagagtgaggacaaatcttaaacgacttctctggtcagatacctataaaaagtgaactagccatgaaacagctacaacctcccctaactcaatgctttgggttttcgttaccatctgtgcccctgtcatcaccagagaacagtctctgacatatatcaggttacataccctgcagccccacaataacaacattaaccggtgtgttttaggctttacagtttacaaaggctttctcagacactatcccatatgctgatatgactataagattaaaccaatgggaacactatcttatttgagaaaaaaattatcacgtatatctctatttatatgcaagttgggcttcctgtctacaaatcgtgtaaaggaaactgttggctttacagaatcaggtatctggtaagttgcaagttgtgtaaagacagtgaaaaaggaatctatgtgatagtgcatcagcttaggagatgggattttcattcggctatgctcccaagaaaacccacaagctgaatttcaaactggttgggaaaggtaatttcaaaaccatgctgcacaaagagctaatatgacacaactctaggtactaggattataacaaattaaatataatagtgattgaggattgccaagccctataggtggacaaagcaaaaggcagtacactttcaaaattcagagtgagatctatacattttaaataaacctcaaacaagcttccaattctatgaagcaaaattctctgtacaaaataaagtttccagtagaatctgcatggcaaatagacaaataagatcaggagattgtcaacccatacatatactaatgaagacataatcttctacctgtagaagttaatgaaaacttccccacataaaggtgagaaacaaataaaacagatttgtttttctagaaaatatagtgtatatattatttaaataatatttaattttaaatattaacttaaaacgtgctctcacaaacatagggaagtcaattcaaaggagaatactctaatgtttttgctaaaaactcacttaaactattggaaagctattattttttgttgtaaaataaaaaaaaaccctggaagtccacatcatggtacttcaagttttatgttgttcatctatccctttcttgggtcataatcttatcaggagttccctcagtacttgggattcaaatacatattctatcaacataccaagttggcgtttggacctttttgaattccagccctgaggaagatccatgaatgctactatctgaatcttgtgtgtatgctttttaaatgggaacaacacagttttagtaatcagagtggaataaaggaaacaatagcaacagctggctttgctctcaagaaaaaaaattaaatggagtgatacaaaaatcatgcagcatcttgaatgcaaacacatacaccatggatttatgctgaatatggaaagcaaggtaaaagaatagctggatagtaaactattgtgagcagtgaaaggtgacatccttttaggaaaaggcagttttaagagaacatattttattaagtataagaaatattttcctccatgaaggatttcatagagaaaagtatagaataaagattagaagaacacaggtaagaatatagtttagtaatagaaagaacttgaaaggaaaggtaatataacaaatacagacctggctagagtagcagcagaagatggagtgaactgaaattatctagaaataataacatcatagaaataaagcttaatagaataatgagaaatgaatatagcacttaaatgtattcataatagcagacggaataaatcagagttggaaggaaaaagagagtcatcagcatctagatgggaagtaaagccacaggattgggaacaataacatagggacaaggggtgaggagaaaagagaaggtcaccaaatgaagcaatctagtagaacttgaacatttaggagtgactctaaatccagcccatctttaaaattctgctcaaattccatctctttcaccaagtcttctcggaacatgcctgggttcacagtcagttgtttttcatttcattcttgttcggtggatgactcctcacatcattgttaaactctcctcttcatttttgaggagcttagcatactatcttccccactatactgctctttgaaaactgggttcagaagttgtattcatttgcatttttcatggcaaataatttaattctacaagcagagaggttatccaacaagtgtctgtcatatggacaaccagatcaacttattttgtttgcagataaattgcattaaaatgagtaaaatgacttacgatatcatgtaagaactaagtactagattggaaggaaaaggccactcttttttgtagcctcgaaccactgggctggggttgagagtaaatcagcctcaaaggaaaagtttaggttagttaaaccaaagtgaaggcaaagaaagaatataaattagaaaaagttgaaaagataatgcgggagaaagtaaaatatttcttaatgaacacaaatactgggaaatcagtaaaaaatgtcaagggttaattttgttggccaaatatggaaaataatataatctccaagaattacaacttagtagtaagaagttcagggacaaacacaatcaacacaatttcacattgattttgcattgctgatttgaagtagtaccttgggaattgtggttctaaatctatttaggttctttacatagtttaggtatcaaaacacaaaataatgtttgctctttgttgtctgagggcaactttatgttcaaggagttcccacaaagagcacataaaatcttaagctgttggaaagataattcctggtagatatgggtctttaacagtaacatggatagctgtgtgactggcatcactcaatcgatattattccagacactttgagaagcttggtggttaggtcacaattatgcactgaattgtatcataagtgctcattttttatcttcactagtaaaaaaaaaaaaatgctttttaaaaaatcatcatcagccttggaatgcactgttttatgatgcatagcatttaggaaacctcaaaattacatgtactgagagggaaatcagatcgtctcacttcagcaactgaaattaaacccctcttcttttttccaactaaaagccatagttaatgttcaattacttggctttgggttgatgatctggatctgtttctcccatttctgagagaactttatatattcagatcagtgcttcacctttctattttgctttctgcattgttgagcaaacctaaccaccgagggacacttaatgcctggcagtgtgattgacagagactcacatttagcacttacagagattgttccaacattatgtggactacagtgagcatttatttttaaaaattgtgaaggcatagaaaacaacagaagctaattcttttttaaaatgttgtaagaacactgaatgtaatacttattttataatacctttcagagaggtaaatttaccctgtaagtttaagaattttattagtctgttctcacgctgctaataaagacatacccgagactgggtaatttataaaggagagaggtttaactgtttcacagttccacatggctggggaggcctcacaatcatggcagaagatgaaggaagagcaaaggggtgtcttacatggcagcaggcaagaaagctcgtgcaggggaactcccatttataaaaccatcagatctcatgagacttattcactaccaggagaacagtttaggggaaaccgcccccatgactcaattatttccacctggccccgcccttgacacatggggattactacaattcaaggtgagatttgggtggggactcagcaaaaccatatcaagcatgtaaattatatgacaattaaaataattataaaattatattgatctgcctatttactgatatgatgtcctagggaaaacactgagaatatttgagaatatttcctttcttatgggttttaaatacaaagttttaaaggaaattttatttttatttttttattatactttaagttctggggtacacgtgcagaacgtgcaggtttgttacacaggtagacacatgtcatggtggtttgctgcacccattaacccatcatctacattaggtatttctcctaatgctatccctctcctagctccctatcccccaacaggccccggtgtgtgatgttcccctccctgtgtccatgtgttctcattgttcaactcccacttatgagtgatttggtatttggtatgcggaaaaccaaatatgtggtatttggttttctgttcttgtgttagtttgctgagaattatggtttccagcatcatccatgtccctgcaaagaacatgaactcatctaaaggaaaaatatttaatctagtttcccttaacatgtttttaggccttaatgtctctagtttaagcgtcttgtggtattaaatggtggacacacattgatatccattttaaactcagatgacttggatccaagcctcattttctatttatatttattagatcagacccctaaatcctttggactataaaataattatctgaaaaatgggagttcaaaatctctacctacatcacagagtagattcaacagagataatgttacgtgagaatattttcaagttttaaagtactgttatcagttggtaccaaaggtcatatttagacatctggttccaaacaagatggtgtagacccaattttcccatttcctcctctccaaatacagctaaataccctggaaacaattcaacagacattcacaaaagaccctgaaaggtggaaagaagaaggcaggaattaggaaatgaaccacagcaaatgtgtaggattttcttttctctcccgtatatcttagagagcacaccaggaagaccttcagcctggaatggacaacaggcatcaacaaacaacaaaagcaagaaaacaaaagagaaaagcctactctccctggccgaagggcaaggaaagggggagagtaactgggacgtgggggcagcctttttcctgacccatacctagaagcagtgtaggttcctttaacctataagtggtggcatcagtagatcccagaaagggtaacacatcttgtgtccatagtggcagctggaagcacctgcactggtgatgtcagtgaacccctgacatcaatcctggtcaaatttggaaaataatataatctccaagaattacaactctgtagtaagaagttcagggacaaacacaatcaatacaatttcacagtgattttgcattgctgatttgaagtattaccttgggaattgtggttctaaatctgtttgggttccttaaatagtttttgtatcaaaacaccaaataatgtttgctctattttgtctgaaggcaacatttattatcaattggtaccaaaatcccatatgggtgacccatcctcttccccgtacctgcctatatcatgtgggcagagataagaggccagagaaaatactttccatcctacagatccagtgtctaacatccctactagtaataacaggtgacctagggaagtgctttctgtaacttgcaagtggcaccagcaggaatgtatcaggagctcccaagtcaggagaactaagcagaccaaaaatagcattgggaagagctctgcaagctaaatgcatctgaaaccacagcctacgaaacaggccagaacctacataccaaaccaaaacagggacattcttggctaaaatgatagattttattttaaatgtccatttaaaaatggtctgtataatgaatgtccaggataaacataaatataggccatgagccaggaaaaacaaattggatgagaaaagacaataaactaatcccgataatcaagaaaaatcaagtatcaaatttatctgacaaggattttaaatcagccatcataaaattgctttaacaagcaattatgaattctcttgaaacaaaaaatctcagtaaagaaatggaagttatgaaaaagtactaaatagaaattacagaatggaaaaataaaataataggaattaaaatcttgctgggtgggtcagtaacagagtggatataacagggcagaacaatgaaattaaagacagatccacaaagtttattcaaaaaattcaaaaacttgaaattgtttctaattcaccaacttggaagcaatgaaccaattcctataaaactataaactaccaaaactaacaagatgaagtgcataacctgaataatcctgtaaccattaaagcaattgaacttgtaattaaaatcctcttgaaaaaaatccccaggacagttgttttactggagaattttaccaaatatttaaagaaaaaattgacaccaattttacacaatcttttccagaaaacagaagatgaaggaatgcttatctactcattttatgtggccagtattaccccgataccaaaaccagataaagacagtacaaaaaaaaattacagaccagtatttctcaatagacacaaaatcacaaaacatagacacaaaagacatagacacaaaacacagacacatagacacaaaaatcctcaataaaatattaccaagttaaataaaacagtatatgaaaagaattatttaccatgtcctagttggacttatcccaggtatgcaaggttgatttaatatttgaaaatcactcaatgtaatctaccatgtcaacagcttaaataagaaatatcttatgattatatcagttgaaaatagtctatgtagaaattacaagaaatctaccaaaaaatttcctgcaaataaatgaattcagcaagtacatgagatctatgaccaacacatgaaaatcaatctcatgtatatattctaacaacaaacatacagagactgaaattaaaaacacaatacccatttacattgctcaaagaaaatggaatacttaggtatacactaaacaaaacgtgccatatatttttgctgaaattacgaaatgctgatgaaagaactcaaagaaggcttaaataattggaagggcttatcatgttcatggattggaatactcaacacagtaaagatatatattattgtcaacttaatctggaggtttaatacaattcctatgagaatcccaacaagatttttgtagttctagaaaagcttctcctaaaatttatataaaatggcaaaagacctaaaatatctaaaacaattttgataagagtaaagtaggaactatcactgtattagtctgttctcacactgctataacaacttcctgagactgggtaattcataaagaaaagcagtttaattgactcacagttgtacatggctgaggaggcctcagaaaacttataatcatggcagaaggggaagcagacacatcttacatggcgacaggtgagagggagagtgtgtgtgagtgcaggaaaaactaccatttataaaaccattagatctgtgagaattaactatcatgagaacagcatggggcaaactgccccataattcagtcatttccctctcttgacacatgggaattacaggtccttccctcgacacatggggattgcaactcaaggtgagatttgggtggggacatagagccaaaccatatcagtcactctacccaaatattaaggtttactatatagctgaaaaatcaagacagtgtggtacaagtgaagggataaacccatagatgaacagaatccaacagtttatgacaaaggtgcacacacaattccatggaagaagaatagccttttcaacaaatggtgctggaacagttcaacatccatagggaaaaaaaaatagagaaccttaacctaactcttatacatttaacaaaaattaacccaaaatacacaacagacttaaacataaaaaataaaactatacaatatttagaaaaaacatgaaaaaaaattgggacctggggctagattgaagagttcttagacttgataccaaaagtctgattcataaaaggaaaaatgataatctggatttatcaaagttaaaaatatttatctgtaaaagatcctgttaaggggatggaaatacaaactgcagacttggagaaaatgttcgtaagcaacatatctgtaaggatatgtaaaggaacatgtatacataaggaactttcaaaactgagtttaaaaagcaaacaactggcaaaagacatgatcagatttgccactaattaggatatagatatgacaaataatcatataaaaagatgtgcaatatcattagcaattagggaaatgcaaattaaaaccaaaaagcagtatctctacacacctgtcagaatggctaaaatttaaaaaatactcataacctcaaatgctggcaaggatgcagaggaattggatcacttgttcactgctggtgggaatgtaaaagagtataaccattctagaaaatagtctggcagtttgtcctaaaactgaaacgcacttagtatataatccagcaattgcactcttgggttcttagagaagtgaaaacctatgttcacataaaaacctgtatgcaaacattcatagcagctttattcattcatattagccaaaaactggatacaacccacaagtccttcaatgggtaccctaaaacagactgtggtaccatccatgccatagcctactggcatattatactgcaataaaaagtagcaaactattgatacacacactagaatgtatttcaagagaattattttgagtggaaagtcaatctcaaaagtttacacacattgtgattccatttatagaatatttttgcaacaaagttactgaaatgaagaacagatcagtggctgtcaagggtcagggattggtcaggaagaggagataagcatggctatgaaggggtagcataagggagccctgaggtgatgaaacacttctgaatttctattgtggtcatacttatgtataactacacatgtgatatcatcacatggaactacacacacacacacacacacacacacacacacacacacacacacacgagtacttgtatacctggcaaaatatgatcttgtatatatgtacttgtatacctggcaaaatacaatctgtaatacaatacatgtatattgtatatatgtacttgtatacctggcaaaatacaatctgcagattgtaccattatcagttttctagttttgatattgtactgtatttatataagttaacattgagagaggcaagtgaggggtgtctaaaaccttcctgtaaattccttagtaacttcttgtgaatttataattatttcaaaatttaaaatgtttttaaaaagccatatttgaaaaattttgaaatcattctgctactgtgcaaaacagatttgatgatgtcaatattattttaaaagttgtatgcattgaggagaaatgataatatacaattcattgctctacatgcaagtaacttgagcaactaagaaacaaagtaggacagagttttgtaatccttacctaggcactactttatagccacatgaaatattaacaggtagaagggtaaaatacataaatcattggtgcaggaaggatatttaaaatacttaatatcttttatggtctggacatcaaccaatcaataacagattctgggaccaacgagaacagatgccagccacaacccaaaatttggtactggtgcacgacagtggaatatccatcctacctgatttattttggataaattgtattatttcctccacaaaagatttatattcctaaaatgttggtatttctgagtacttctgacccgaaaagactggaaagggcactatattattggatgaagcatatctcaaaatgttgctaaagcacatcatgattaataccagtcagctacaaaagaattgtttctattaagatatttgaaatttcattttttacaaacatatatgaaatatcagtacaaaaacaaaatcaatttttgaagttttagtacttgaatagttaatactgttaggatctttttatgagttcttccttgaggaaagattccaaggtgctttgcaaacataatcttagcaggtttatcagattagaaagataaatactgaaaggtaaaattaatttggtcatacttaatcttcttgagaaattaggatcactaattatcaaaacaaatttaatgagaaaggccaaagctcctatttaagggaagataaacaatgtaatttagaaacagaatctgaaatatgaacacaaaagtatgaatcttttaatctgtgtgtcagttttataaaactcatttaagaaatgaattgaaactaattagcgttttctactatttcagaaaggcaacttccttctcctgaaaaacatcctgtttaatatgtattgtaaagcatggcgtatgctgtctttgttcatgcacattttggacacttttttaaaaagatagattaattaattagttcaaagcattagttaattctaattgaaatgcactactcatgcaggtgaatgggttaagattatgtaattttttttcctgtagtaacataagaaaactcacttaaaattcatacatattgaatacagaaacaaagccacccagttcatgcagatataacttcatgaaaatttagagacaacttaacaggttgaagggggaaaccccccagtgtattactctcaggctggaataagctagatggataattttagcctatatggatttgttcatttccattttgcaaggacattctatagtaattcaaagttgttaaggtaggataactattctgaattttttcccagtcatcttctatagggctcatttactgtctcagagttttacctgaaggaaagaaaatgagcagttatttagaatttatggtgctagtcattgtgcttccaacatgtgaaggtaaatctgcatgaaagaggtacaactcccatttacaggtaagaaaatctgggctcccaaagattaagtaccttgcccaagaacccacagattagggtttggaacagcttttcctgactccaaatcttaaacaatttctatttcttctcctgtacattatagtgtgatcctactgggtttaataacatttcaacgttaagaaaagaatggtcctacaaggcttaattcacttttgatatggattctaacccagcaatgctcatgggatgtcagcacagaaatggttgtgattgaaaatatctcaggaggatcccatattaccgactctgagaggagaaatatgatggggctttatacacactttaaccaatcttgcatccaaggtatttagtggttaactgctgtttctgtggcattttaaaaaagactatattggcttgctaaacagcactcccccaaatactaatattagaatccagtagtaggtggagacatttttttctgccatgtagactgctgctaaaactccaaaagtgtacagagctatgacaaatgcacagaacataatgacttcagtatttccaaccctattgtgagagaaggaagtatgtttttatgtttagtagcagtattatcctttaagtaaaaaggcaaaatgattgctttactgtcagtagaataagtgcttgtttaatatatatttgtactgagccatccatgtcctgtttctccttaataccaatgagaaaacttttgttagttttttctctagtctagttagtatcccctctcatctctctttcacttgtattcctcttatattaatttaacaggaattaactttactcatttatgtaaacagatctgaaggtgcaaacatttccagatacatatctacacatacactacatacctccatacattcataaatagtaagcacacatatatgacaaaataatatataatcttcagttattaaaatataaattaggataacagtgaagattttatgacatccagcccagtaacatccaaaatgtacaattttaaaattactgcactaaaatttctgctaccagataggatggagtagcttattagacatgagaaaacagaaagcctagataaaatgtaaaaaaataagcagtttaaagaaatcagaaactagctgaagcagcgtggtctagaaggtctaagattctcaaaagggaaccctggagaggtgaaggaagaatttgcagctgctcttgttgtgtctgggctcttagaacagtatagacttggcctgggaagaaggccgctgctggacattaaagaaaccagaagagtgaggaatcttgagggactggagtgacaaacatagatgtgagagatttcaaacagtcagtcagttatctcctgacatttgtcaattctggagctgcaggatctagaggcaaaagagttaagctaaatctcctgaaaaccacctccgatttttgggagtctggcagtcctgagaagaaaaatatttaaaaatattggtgttcaagacctgccaagagtagagtcccacacaaacatggtaggatagggtttgtcctgtggatcaaattcagcccgccccaatttttgtgtggccaatgggctaagaacagtttacacattttcgagtagttgaggaaaaatcaaaagaagaagaatattttgttatgtgaaagtatacaaaactcgccctggcccaagatggcagatgaggccacctgacatgttgtgtctgagactctggcactgaagactaatgcaggaccccgagattgggagttgtgggtgcagtgattgaaggaggaatatcagtcccttatctggtatgtggagaacaacaacaatggcgacaacgatggttccaactggagtccagcaaggtagggactcggtggtttggaaaatgttggtatatccatggcctcctgcaatgtgagtttgacgtcaagtttgaaattcctatcatgtatcttactactgccctagaaattgctgtccctgagctcgacagaaagacagcaaagatgtacagaggtggcacaattgcctgacagatcatttcaaatctttgtgggccaggaacgtacccaaatttgaactagctcatttcatggctctggggccgggtccatggctggcagtggaaatccctgatctgattcagaagagggtattccagcacaaagagaaatgtaaccaacgaaggaccaatacactgaggcagggcagagggacttttgataggctacggtcctgttctcctgtgtatcacacttaactcatctaactgcttcccgggacaccttccacctctagttgacaggaagtagctgcagcaggatggggaaaaaaaaaaaaaaaagccaaaataccaaatagcattgctacggagtttctaaggctgcacagggaagggaaagactgggctttggaaaatcaagaggcaatttttatcctcccctcaagtggaacaacatgtggtcctggaggcatgggggtaactggaatagagtacgtagtctttctggtttcaggagacaacccatcaataaaacctgcttcctctgcttaaaagaaaaagaaaaagaaagtatacaacactcaaattctgatgtccatacataaaaccttatcagaacacatgcatgacctttgtatattgacatatggtgcttttgcacagtgagcgcaaagaaactggatgacctgcaaaacgttttctaaaatctttatcacctggccctttacagaaaatgtttgccaacctgcactaggatgttagctgaaaactctggtggccaaacactcaaagaacagggcaaactcaacccaacctcacgttggctcagttctggtttggattagggtaattagctttcactctatctggctagcagaggaagggcaaatctttgctggaaaaagatatcatcatcggagcctctacatttttaaatacacattttatatgtattcctgcattcagaaaattactgtactaacttttgtctgagccgaagtgtggcacatatgaagaatcatgacttaactggcaagttcaatagcaatccattaacatccagtgttgtaaataagtaatactaatctatgtcatttaaagaaaagtaaaacacaggtaacaatattacctaaaagcacttttcttggcaagaaaacttaaaataggtgtccagaataataacattctaacaaactagatgttagtttccactgtaaaaacggtccgataatataaagaatagagtctaggaattatttattttgtagtgaatgaaaacaaatagcagttgaccaagttacaaatcatcctgatctataaactgaattctagaacttgtttctcaatgacatttggttcagaggacaccagcatcatattttaggcacctaccatcctgttaagtctgataagcagagatgtgggaaaaacaaataacattgaaatattataattatgcaatatgttatgcttgcgtctctctcaggattttaaaattgactttaatagctttttataataaaaagaacaactcaaaggtgcaagacagctgagaagttccatatgtcacagaactgcaaaattgttaaattcactttaattaggatatattaaggttttacaactgtggcataagtaaatcataactcccagttagaacaggtcatgttaattttcagactatcacattttgtaacacgtttcattggtgtcaatgaaatataaccaaatcatgctttaaagttctgatcatacaataattttatgggattcaactgcatacagttgtactattatacagaaaggtacagatatggctatgaatacaaaattaaatatagactaaaactggatatttgtacatttatatatgttcatataaattacaatctctaatttttaatttaactcagtccctagcctgtgaacagttaccttataacataggaatgtggacagtatctgagaaagtcagaattatgcttgaaaagaaaggccttttagaatgagacacttttttaaaagttaactttttaaaaactttgtttaacgttcaaatattctctgctgttttcttcacctttaagagctcctcagtgacagaaacctctgaacagagctctaataatttaatcacataaagtatgtgattgtggtcaaataataaatcatcagagagtatgctattgatcatcttagctaaactgtaagtgctcctttaaaattaaactcaatattttaaaaaattaagagtatcatcagtaacagacttcacccacataatttatgaatttaaaaacaaggtttacattcatctagtcctcaaaattatttttaaaagattcttcacatgcacgaaaacggtctattttaaagcaggtcaatattagaatattgagaactggaaaatactaaggataatctaagacattcaggcaactggttattttatttaaatgcttgattcaaggaaagcatgtctttatatttctgagtccttaataactgctagaatgctaagcctttcaaaacaaaatcaaatattatagtgccacaaactgtttctcttatgcatcatatctgactccaattaaaagatcagagtcctcagagcgacgtattgcaaacaaaaagtccttagtaggtggtggaaagtcaggccaggagtcaaacagaaccaacagagatgacagagatgtgatattcagcacagtctcctcagagagaaaaagcaaaaccacatggccctgctgaaatgccgagttaattctctctcttatctgagcattaaacattacatcgttaaaattgtttcagctagattattgcctcttcaggtgagactctcatttaagaaacacaaacattctcaaagcacattgctgaaacaccataaaaacttaataacctaccattttctttgcactcttctggaggtttagcctttttcgcaagtcgtggatccagccatgatgttgtctttgtgttatggctgaaaagaaaagagatcactctgaacagacacatactaaaaggaatcaagtttattccttaagaaaaaaaaagcagggttagtccaacaaaattgcaatcgatacacttaatttgcttactggttctaagtagccctgaaggaggtgtaagagtaattgtgcaaggcagctgtaaatttggcaacctcagctccctgtcctcaaagcagctatttttattaaaatcaactagaatgttgccaagttaacctcattgaaaatgcagaactcatccagagcaaaaggaatttattacaaatacaggattctccagttggaagagcacagtccacaggctctgataatgtttcctgagttttgcaaaagaattattttcatcttaaacctacccttttcataaacagttgttttgttactctttagctacagagctggcagaggcagtacaaaagtgatgcagattatagcatgttcttgggattcctgcattttctcaataagtgattaatagcaattttattaactcacattaaactatctttcatccaaatactttcaacccagctcagaaggtaggggataagactgcctgcattctaatgtttctgaaatggcatttccagaaagtaatgataaaataatatttttgaaaaaaatgttttcttgtaagagttttgccagaaatttaaaaagtaaaggagagatattcttaaagtagtgttttttaaagtggttgtgaaataacctgcattagaattacctggtggacaacacatattaacaatgcatattctgagtcctcaaagaactatcaaataagaatctttgaggtggggctacacaatctccatcactggcaagcactcccagtacttcttatgcacattacaattcaagaaccactcatggctcacataactgctcattggagctaaaatgtttactgtgtacagctgtctcaagggatctcatctaccaatggacaaattatcaagaatgtgacatttatgaggggtttgggaaaagaatgagcaaaggcacaggtgtgggaaagtgtgaggtgtttctagggaacagtcagaaggccaatgaatggaacatgaaaggaagaatagaagagaggatggaaatagaaatcagagccaggtaataggcatactttactacagttgtaaggaggtcaaaatgataatgatgatataaatttcacatgtattctctttctttaatgaaatttaactatatgttgccaatcataaccataaatgttagctagataatctgataaaccaatctgtacttacaatgaagtttagacaattcacccaggcagtatatttaatcacaagtgtgtaaaaaccaagttccttcttaatggaggaactttcaagccaggaaagagggaggatggagtcaagatgagtagcagaaagctattccgaggtgttaaatcactcttcaaatagcattttctgaatgataatccatcccatctgtctaggtatagagctatctttaatttgagaactgtgacataacgacccttgggtcatgaagtttctgctcctgaagaagacgccattttatttctgactttcacatggaataaagagaaggtattctccatcacattcttaacatttaagggctcttcgatgataaatgcctctcaacagggctctaataaattgatcggataaaggctgtgaatttgatcaaataataaatcaacaggagagcatgccagcttttatttttcctcaatttgacccttgtaaagtctggtggtgcttcattatcaagttttagaaggatataaaatattgcagacactttcatctggttctggccctcgtttgcatgtcaatataagctagcttttcttctgaactaaagacttgaagcttgaggatgcaggttctgactattcctaatgtgaggataggggcaccgggttcagtgtttgctgctctcattttaaaaaagaaatcacttaaaaatgccctttatagacatgcctccgttcaaattgtgtgtgtgtgtgtgtgtgtgtgtgtgtgtgtgtgtgtgtgtgtgtgttgatgtctatgtttctatgaggtggggagaaatcttgggaagtaagcaaggaaaatacatttctcttccttttgtcctcacctgcttcttccaaatcctttcctcttttcggagaaaagtcatttctaggctccttagatatattcacaaaagcaaacacatccatgggtaagtattaagggaacattactaagccactgcagagagtcaaattaccattcctattgcacaccaccatgggtctcaaatactggctaatttagtagagaactgtgaattttccagctttcctgagtttatataaagcatttcattacaggctgattttttttaggttgaaccagtattaacggtgtgtcactttaatacattttgacagattgagtctcttatagttaacaccatttttagctgatcttcagaaatgattctgaaagcaatgtgggtagcagttacctccagtaattgtcttaaacatcacatgaagatccagcacagtatttttcaatagtggttctcaccagccttgtaatttgcatgctcctccaagattccttgcaaagaggattatttttaatgcattgggagacaacagaccaaccagctcttctacttcccttaaattacatattttaaagcttaataattccatttgaaaaccgaattaaatgtcaggcaggaaactgtgttcagaatgggataattgagggattcttccacattctgcgtactatctttcaagtttaaggagggtatttcctttcagttcctagctagggcagattcaggtgcatgacatcagttttctgtatctatccaaactgtgtgtcacataaataccaggaaaagaaaatgccaatgctatataattttctatttcaattcaagtttctttaacagagacacatacacatacataggctacatttgcacataaacttttcttattccagctggacaatgcaacagatattttttaggaactttgaatcatactaatatactacttcatgtatttttaggataaagctaatgtgatgatcatgaaaagtgagaggtcaagtgaaaaagccagtggatatttaagttcagtcactgtcatatttaaaaacctggatgaaaaccagaaacaatggtttatcatatgggcatatcccaaactcttctctgatgttaaactaaacactgggtctgtctagaggactaaagtaagccagaagtgaaatttcagtcaagtccgcatttctagtttaaattcatatcagaatggccttgaaaatatgcaataggtggatcagcaatgagcagacatttctgtacaatttgtaagcttaacttttgccaaactgacagaagcagcaggttaatatcctatcttctgagaaaacattcttctcacatagaacatgcttcatttcaacaagaaaagctatttacagtgcagcacaccattgcagagttattctcactatcccgtgtcatttctcgattgtctactgtgtcagggaaagcagcaggactttcagatatgtcccctcatttaatgctaatgagcctttgtggctaagcattatgaattccattttatagatggagaaacccaggttgggggaaggtgggtaacttgcccaaggctaaacagctagtgcgtgaaactgaaagagccagctagcattaaacccagatatatctggtttccaggtacaaggtttttttttagtggtctgaaaccagaggcatccggaacctcacacttggctttttatactgaggtgcttcatttcactccctggaatagtaatcaagagtctgtttcccagcttctgccagtagtttagaaacagacttttacctactgtttatggatagttaatcactacttaaattcctttttaagtgtaaatgctttgcacttaataagtatgatattaaagttccatgtgcatagagacaaaagagagcactgtgattgaggaggcattgataataccactggaaagttttctccttacaaacctaaattctgtatttgaatcactttctttttctttcctattcttttttttttcttttctagacaggatctggctctattgcccaggcaggagtgcaatggcatgatcttggctcactgccacctccaccccctgggatcaagtgattctcccgcctcagcctcccaagtagctgggactagactacaggtgcatgccacatacctgactaattttttgtatttttctgtagagatggggtcaaattcctgagctcaagcaatctgcctgccttggcctccaaattactgggattacaggcatgaaccaccgtgcctggccctgaatcactttcaaatcaaattttcttcactcaaatctgaatatttttctaaaatgaagtctttttagaaacctgattcatataatctacatatgaatatttggtcttagaagctatattaaagaattatgttattaagaaatgctatcaatggatgcagtatgtgttaggagcaaaattgaaaattttcttatagatcatgccatattctattcttctgttccagtttttcattcactctagtgtttgcccagtcagggtacaaaccttttttccatttcttaggtatatacataactagatcttcaagggtaacctaattcaaacctaatattaaaacatgttctcctttcctttctaatttctttctgttttcttttcttcttttctttcgttctttaatattgccagagcaaaatgttttcactgctgtacaactattggaaaaattcaatttcatcaactgaaattttcttagtgaaatgaaaagcttttattattaaacacattcctttcctttgctccgttttctctaaaactagaaacagacttaaaacaatgattaataagtcctccaaatagccaattctgaatctcaatcttaaactgatagttaaatggtatttcccagcctccccgcccccgggaaatactatgccataagaataacaagagattaaagccaatgacatttgattgcataaaacaatcttctgaagaagataaacaaggttcaggtaaatattctggagtcaacagcaactcaaaatgtctgtggatgacaaggtttcaatagtagtagtgatataagttcagagacagtagtaacagattgatgaattgactttacgtttacaaaacacttttattattattataagttctggggtacatgtgcagaacgtgcaggtttgttgcataggtatacacatgccatggtggtttgctgcacccaccaacctgtcatccacattaggtatttttcccaatgctatccctcccctaggcccctatcccccaacaggccctggtgtgtgatgctcccctccctgtgtccatgtgttctcattgttcaactcctgcttatgagtgagaacatgcggtgtttggttttctgttcatctgttagtttgctgaaaaacattaatttttaaaggtatataaattgagtagattttacaccatagtcaataaaatcatcaggatgattgtaacattttccaaaagactttctcttccttctatatcatcatttcaaaataattactaaaggcaatgatcggatatatctaattggtgataaacaatagaaacttgttccttcaagactccattcacccaaagtttcactatgtttttctatctatacataggtaatacacaaataaagctactgtcaatgagttctttagtggttgtttcctaaataattttcctacaatttctcttaagcatatgaatatttgcatttgccattttatctttcatgtgtttagaaaatatttttaaagaagtttcattacaaatattgttttggatattgtggatgtgtattgcacactgttttgtctaaaacatttattttctgtctggaaatcacaccagaatcttgtgcaggcacaagaaaaaaaatatatgaaaaaatattcaatgtatctcctgtctttgtaatatgattgacagtaagcctagaccagattttgtgactagtacgatatgtcaagtatagaatgagaaagtatatttctggtgttgctgcataccaaaaatttgattttatatttctctccaataaatttccaaagtattttatcttttctttaataaatgttgtttaacgttttttggaaatggtaattggtaatttaattaaaacttaaggaggtacagaaataggaacacaaaaagaaacataaactaattgtgtgtttgtttagaatttaaaagcaaattcagccctgacaaatatttgtaaaccatacacagctatgacatttttcacagatgtgattttcggtttcaaaagcctgcatttaaaaatctgtcatttaagatgacatagtgttcactgccgtttgggaagatggcagtaaacaaataggttcttgttgtctttttgttttttgccaaagcaatagcagtctcttttgtgtcactaactaaactgactcccaaacaaagaagtaatttaatgggattcccaaagcacgtcaatccagattaaccctgtggcagctcttcttttatggaacatttagcctctggagtagtgaattgctggccaagaaacttataaaacaaatactatttgtaatataaaagtttactttttttctcagccaatgtttgtttctattggaggtagtatgagataatgggaatgactctgtagagtgaaagagctctgtgaccttgggaatgttaatttgtccaaggatgcctcaaagtctcgtctatgaaatgtggataaaccagacactttatagggtggtgatgatgtgaagtaggcatcacagcaaattggttaagaacaaggaccatggagacagtctacatcgcgtgaaagtctgaatcttgtcagtttttttgactactgtattctcagggtttagaatgattcccaggacataatacatgaccaataaacctctgttgaataaacagaatcaaagagccctggctatgtctgactttttggcaagtatttacctctaaaagtctcagtttcataaagtaaggattaagtgaatggagtaaaaacgcttaacagatgaactattgttgttaaggtaacgcgaatacacccttaaaaaggtgggtccttgatatgtaataactcatttgaattcacatattctcatttgaatttacaattaatatactgcctatttcaaagataatgttaatgaagatgatgagtcaaagagattactggttttacacagtattatacatttaaaagtctcctgaaaattatgaaacataagacattattactattttaaagcatgtttggaagagtgtgttcacttgaaatttaaaattatgctgcataaaaatattttctcagcaattctccttttccaattaaatgtcattctataggatagaagaaatctgcttttatcaatcatcaaaagaagcagtttgagtagtgtgggaaacatagttggcctgctagtttaccagggttgctgagggcagaaaaaacctttccctcttaaatgcagaacctctaaaacttcacctcttaaattcagaacttctaaaggactcagccatataactattttgcaatatcacataaaccaataaatatttcaaaacattattgcataaaaaaagacaagtaaatggaattgcttgttaccttaactcaaaacctatactgtttaatacgtcttttaaaactacatatctaatgtttcactgtagagttcctttatgctattcagaaataactattctatctatctatctatctatctatctatctatctatctatctttctatcttatacacagaaccaaagaatcattctcctttgtttcacttattttctgttttgtcatgatcttcatttcaaaggatacagacttcagcaaagtctaattaaagggtgggacctgccagaggagagtttcattactgtaagcagctctcacaatatctgtacaagagaaaagtttttactgatgtcagcacttcttccctcacaaatctctctcatttttcttctcctttcttttccctctggtttaccttcctcttacggtattctacctttcctttaaaaaaactttttatttatttatttacttaattgataaacaaaaatcatatgtactagacttttgaaaatggctgagagtagattttaagtgttctcaacacaaaaaacgactagtatgtgaggtaatgcatatgttaagtagcttaactgagccatcccacaatgtgaacatatttctactttccctttctatcatgctttctggtacataactacttcaggactacctctgagacacatggtggctttgtccttaagacatgtcttattgctcaaccatgctccctccccaatcactgtctcgtattctacaagatctgcttctacgggcctttcatagtatacagtttgttagttacataagaattctttgtcatagaagcaaaggttctcacagatcaatgacaatgggtgggaatgttgatttaaatgtaattaggaaaggaaggaatattccagggcaaagagtgaaaacagacaggagaaaatcagtgaatactaaagaaaaagtaaagcacagtaaaccataggcagagagagaggaaactgcaacgttgttggtggtgatggtatggacatgaaggaccagacaaaaagacgctgatccactgcccgctctgtgatacctgcgttcaccacaccgaatcttgaggttcaaaggtaacctttatgaaagacagatgaatcacaaactgggggtaaggtggagggtgttggggagcaggcgggcagggatgcctccagtctatggaggaaccttagcaggcgtcgtagactacctcgatcctgcctcctctgttaatcaccttccagacacagtcacttccaccatgactccaggctccttctttcaccttagtctccctcagcatcagctctttcgccacagatgaaattgtttcctccattttgttttaattttccacctccatccatttctgctcctaatactgtccaccagtccttccctccaacattaggaagattaaaaaactacaaactcaaacaacaacaacaacaacaacaacaacaacaaaatgccactcctttgcttgcctttcaaaagcactaatgatccagtgaaacgaaaactaagatttaccaactaatacatacttctctagtagggtcaggggcttcctcaccattcctaatacacctaaggacttcgtctttgtaatgacagctcccatacctggaatgctctatctagccattgttaacttctcaagtctatgttatctcaccttctctgcggtgccccttttatatcttaaatctattgtaagctttggcttccctgaatagtatcacaaaattcagaaattgttgaccaagtgtttataactatttgtctctcttccccatcttgccaacaagtttgaaagcaaggacaaaatcttacacatgtttgaatgccaacactggctgactgacgagtcatagaatcattttgctagattctctcaagccctgagccagcctcactacttactatatacctggaacataagttctgtcttttgaagttatttttcttcacaacctcaaaacctgatgtagttaaaagaggaaagtttactttataatcacacacaaaaaaggtttttattattgcattattggaaacattgtaagaaaatagtctttaatcaacttgtcatgctgctttccttttattattttcatatagccttactccccttgtcttatataataaaactatgtatgtcatcagcttccttattccgaacatcaattgttctgaacatctatttgtgatctcatatctaagatttgtattttgacttctggtccgcaatgatgtcatgctgtctttaccaatatcaaaattatgtttctagatatgattatttttaataggtcacttttttaaacattctttctattttccaattaattgataaaagatgccttggtcattgattacagcaataagaaataatgtaagagattcttattccttttaaaattagaacatttgctgaaaggtgaatgctattgattcattttctgcaaaacattgtgtttctcatctatgttggagtcaagcagagcactgagtaattacctgattatgtagtcccttggtcgcatgattcagagtttccaacttcacgtgagaattaaatattggtatgtggtaacatttcaatttcacaactgaattctgcctatagagatctaagttataaatcactccaggttggaaaagaaaatccagtgttaatgtatttcttaaataatcagagttttcatatttttatccactgtcaacactaaaaacttcaatttctattattttctctctttgaggcttatacaactttgagaggataagggttgttcattcacattagtttcagtttttactcttactaatgaacattttggttgtcttgtgcaaatcaacaatttaattttgtgcgaagattttctattttggaatttttaaaaagttgttttaatcctagaagctaaagaaaagaaaagcctgacattattaataacatgtatacaaaaattatattttttaaaaatgtcctaaaagaaagattaggttgagtattaccaagaagttcaggatttgcactacagtttccttagcaagtcataaaaattgtaagcaactaatataatggaatatagtaaaagggagcataatgaactatacaaagccaaattattttactgacatctgacactggggtcaaatgctaaaagcattttttttggctgggcgcagtggctcacccctgtaatcccagcactttgtgaggccagtgtgggcaatcacctgagcccaggagtttgagaccagccttggcaacaaggcaaagccccacctctactaaaaatacaaaaattagccaggcatggtggtatgcacctgtggccccagctactcaggagactgaggcgggaggactgcttaagccttggaggttgaggctgctgtgagccgtgattgtgccactgcattctagcctgggcgacagagtgagaccttgtctcaaagacaaccaaccaaccaaacaaacaacatcaatattttttcttttgtgacctattactttaaatagttgcattttattaaattcctggacttgatggtgaatattcctccaactagcttagataataggaaaaaaatttcattttgacaagacgggggtcttaggaggagctgagtaagcactttctcatgatatctagactattcctaattcaataataacatcacatggagatttgtcttttttagtcataattataagagattgtagggtgctattatttaatccattatttgatttatagctgtattctaggaggcttaactgtattaaggcactatcccactattctctcacaaataaaaaagctgttaccagaatttcatgtttttttctttttttttttttttccacgtctaacttgctacatcatttatatcccgctatgacctttttggcactgttgaaagaaatgtgtgaaactcactcaatgaagtagacttcgcccttctctgtataggccatttcccagttatcaggcaatgggtctggttcctcattgtcttcaggtttagttggctttgtgtcatccatctgctccttcagctcctcaggctgactgtacactggtgcaggataaggctgggagggcatctcccctgaggcacctgcacttttgtcttcatgttcactggattctataagagaacaagagcacgtggttagtcactccaaccatggtaactctggactgagtatggagaatgctgtaccagggaataaacgtcatgaataacttctatgaaggctaacaggaaacatttctgaaaaagcataatgatcactaggcctatttgagctctcctttcactcgtcattgtcatctatctttcagctaattattattgtttacagaattggaggtttaaaggatgtaatgtaaggaccatttcataatacaggtatggtgagcagaataatgggcccctgaagatattcatatcctaatgtctagaatatgtgaatattaccttacatggcaaaagatgatctgcagatgtgactaagaaccctgagatggggagattatctttgattatccagatggcctcatctggatgattatgattaaatgtaatcacaagagtccttaaaagtgaaaaaagtcagcagaaaagaagggtaaaagggagaattgactactaaatcatggtcaaagagatgcaatgttgctggcttagaagacagaaaatgaccatagaccaagaaatattagtggcctctagaatctttaaaaggaaaggaaatggattatttcctggagaatccggaaaggaacacagctctgccaacaaggaacacagctcttccatagtttcagttacccatggtcaaccatggtgcaaaaatagatgattacagtacagtaagatagagagagagaaagaccaccttcacataactttcataatagtatattgttatgattattctattatttgttgttcttaatctcttactgcatctgatttataaattaaattttatcatagtttttttgtatagtatatataggatttggtaccatctgaggtttcaggcatccactgggggtattggagcacatccctcgtagctaaggggagctactgtacaacagagcaaaaactaccttaacagaagtggtaacaggcttggaggacagacccaagatccccaacatataaacagtatgagttccagaatgagaagaaggaacgcacaaggaagaaataagtcgacaaacaatagaagaaaatttatctaagatgaagaaacaccagtctgtagattgaaatagttcactgaatctgaggccagattaaggaaacatgcagacacctggatacatctagttgaaatttccaaactacaatgttaaaaggcaactttagcagcttccatactgaacagatatgattacttacaaagaaaagaggaacaaaagagcatcagaccttttatctgtaatactctaagcgcaaagagagggtaacatctatagtaacttgagaaaaaaaaagatatagtaatccaagaacttaactctaccaagatattcatctatctgggaaaaaacagtcacttttgaacatgcaaaagttctgaatgtatgctctccaagtatcttatctgagggcaaaatttgaaaaattactctaaccatatcatgatgattgaatcagagcagagacctcaagatacggggagaaaataaaaggtaggaagatgatatggtttggctgtgtccccatccaaaatctcatcttgaattgtaatccccacatgtcaagggcagaaccaggtggaggtaactggatcatggggaaggcttcccccatcctgttcttgtggtagtgagtaagtctcacgagatctgatggttttataagtgtctggcatttcccctgcttgcactcactccatctccccctccccctcctcctccccctcctcctcctccccctcctccttctccccctccttcccctcccactcctctccctcccctcctcttcttccctcctccttcattctctcaccctcccctgtcctctcctctcctccctcattcttctctcctccttcccctccccaccctcctcatcatctcagaagtacttgggtatttcttgcatcatatgaataagtgaaaataaggtgggccgttatgattgacctcataagtatacatcctgtgaacaaggtgcctgcttcccctttgccttccaccatgattgtaagtttcctgaggcctcctcagccatgtggaactgtaggtcaattaaacctctttcctttataaattacccagtctcaggtatttcttcatagcagtgtgaggatgaactaatatggaagaaataaattctggataatatagttaaatataaatggaagatgatcacatttctgaaaatttgtaatatgtgttaaagacagattctggaaagaagaaaaatacatgaagacctagtaagaccatgggttttagactttatcttaggaaagctcaggtactaggaagtggagaaaaggtaggaaaatagagacattctaaagctgtcatcagtaggcacttcagagagtgagtatatgagataattttaaaggccaccttttcatgggatgagattattgggcaaataatttggtcaaggtgtaggcttaattgtataatggggatatttttgaaatatctcctaatgtgtatgtttactgagctattcatggattcatttaccccacatttagtttttctgctgtcaaggataaacaatgagtcttatttgttggggaagagtagagcaggtaccatcaagagaaagaaataccgttagggtaaatacgaaggagaagttccttaactcagaaactagaaggagagcactactgagattcagaggggctgaaaggtagtgagaggcaatgtgaggataaggtggccatcttggaaatataaaattctacaattgtttgggaacataatgcctattaaaataaaaaaatacaaatacacagactttgagttatcttactttgagaacatatcctctagaaataaaggcagtattatataatgatgcctatataatactattttttgcaatattgtttgtagtagtaaaaccctggaaatgatataaatgcctatcaatgagattataattaaataaataaatagtgtttgtcattaccatggaaaactatgtagtttaaaatcaatgaatatctattgaccttgaaaggtgcttataattgttaaagagtaatctaagctgcagagaaatgtatagtattaatcctatttttctaaataagcatatattaagatctctaagtgatatatagttatatctctatataagcatgaaaacagactgcaaggatgtacaacagattgtcaactttgattacctcaggatagtaaatttggatgggggtggaagaagtttcttttacatatctttgctttcattgggtatctattatttttataacttcaaaagttaatagattttttaaatgagtaaattagaatatcatcttgctgtcactattaattgcatgggccaatttttcccctctctgcatcaatctaggagagcaatattaaagtatctattagaaatacttatctaatatctaatagaaataaagtatctattagaaaaacacaagaatactttacaagttgtcactgtattgcccttaagagggaaattatgaatataatatggcccttaatgatagagtctcctagctgattccttataaagatttgatctttgtaagttttgtaggataaaagcagtaaaaacaggtaccactgctaacttcagagtctcttttctgtggcatatttcaacatgtaattatacatactgtggtacgcacatggaacatacaaaatgtcacgttgcactgaaaagttcaaatgcaaggtcatgctctgaacatgttcagttatacaatattcagttaatcaatatttattatgcactcaactggtgccagacactgaggacagaagagtgaacaagagatacattgatcctttctctcatggaactccaaatatgtcaagatgtgtagtctttatacaataattttaagtgtgatgagtgctgcctaagggaatcgtatgtatatgggatcttctgtatgtatattcatctaatctcatataaagagtcagggaaaacctctttttcaatgtgctataacatctaagggttctttcagaagaaggtaagggagaaataaataaatgagggctggattaagtgaggctctgaaggtaagggagaaataaataaatgagggctggattaagtgaggctctatcaggcatgctcaggatttggaagtgtgtcctgagagcaaagatactgctatgttctactgaagcagatgacaaaattagattttcatttcccacaaagatctccttaactattctggggatttgagggtggcaagagtagatgtttatagagcagtggaaagttatttttgtgctctcaaaaagtaatgatggtggcacggagatggaaagaagcagattaaaaaaatatttagagggtagattttataacctgccatggtgggtggcaaggcttttcactgagattggaaacagggaaggaggagtaggattctgtggggtaggggtaggctatacatgtggttttgggcacactgagttagaggttcatggagacgtcaagtcagagaattcttagatggaaaaaaaataaacctgaaagaaaacagcatatggctagatggtactataattttagccatgagtaaatgaaattgccaagagacagggtgagaagtggaaacaagaatctggagcagctgtctgatgaacttcaacatttaagtcactgaaacaatggactggtaaaagagaagaggaaagggcagccatggaagcaatgagaaaattaaaaaaacttcatgttgcaaaagccaagcaaagggtgttgaagacaagacacttaactgtggccaaagcttctgcacagtccagcaagacaaggacataaaatctgtagaaccgaatgatgtgcagatcactggtgacactggctgccagttacggcagtatttacggtggagtggttggtgaagccagattggaataggtttaaaaatgaatgaaaggaaaatacagaattatcctaatagagaagtcattcaagaagcttggctttggacaaatgaactttccttctactgtataataccattaaattctcaagagaaatgtaggacatctcttaaaaaaggatctagtctttggagaaatctataatcatatttgttgatgtatcagagattactggacaaagttctcccagtttatctgtttattcattcatttctttattcttaattaatcaagcattaaagtagcaaacatgaatttaatatctatagtgtgtaagatacttgacaagaccttaatgggggagattatagacctttttatcaggctgctgtgaactaagctgagagggaagcaataagtagcacctacctctcccatcttaacaaaataagacaaaaaaaatgaataaggcaaataaagatccataacattcccatatttattactcacaaaggctcacctagggatacggtttaatgtgagaatcaagggcttctggcaaaacccagaggaccaatttattcattggcagtgtggaaccagggcagggcttccatgtaagggtagaatctgttcccagaagggcaaagtagaatatttaggggaagaaaaggggaactgagccaagaaggtccaggttcatcttccaagttgtgtcactcagataaatccctgcacctcttctgggcagagtgagtaaaagagatggtagaatgcaaattcagtactctcctagacattcaaggcaacatggagggtggagaagacatgtctcccccaactctgagcaactatatagagtactacaataatgatttgttaagtgatactcaatgacataaaatacctgaataaaattttctaggaagacagtgtagcaattagaaacaagggtacctaaagcagttgtctgaggaactccaatatttgtcagtgagagaagaaactggtcttatatttcctgcattattagaaacatttatttagagcatactaaccatcaggcactaagctaggcagtgtacagtcaaggagaatgtggtccaaatgatatgtaataattttctagggctgccataattaaacaccacaaactgagtggcttcaatcatagatatttattgtcttacattcaggaggttaaagtcctatatcaaggcgttggcagggccagctccctctggaggcactatggaaggatctatttcaggcttctctcttaggttctggtagctttttgacccatggcaacataattgcagtcttcacatggtattttccctgtgtgcacatctgggttccaatttcttctttttataaggacaccagtcatactggatgaagggtctacccctactccaggatgaccacgtcctaactaattatatctgcaatgatcatatttcccaataaagtcaccatctgagatactgggggtttggacttcaccatatgaatctgggggtgggggcacaattcaactcataaaatggtgtactggatcagttcactgtgcagtccactgaaccaatatttaacatctcaaggactgcaaattattgtttcatgctatatcatatttgtttccctgattaatatggaaaatagaaattaactttgctgcattttagataatatatctttcttctgtatcggcttaaattttttaaaaatgacatatattggatattgtgtaagttgttaagaaattacccgttaagaaccgagcaaacttcgtaataatgggagggaaataaccagaccttacacgccaaccaagcttgcctgtgtcagctactcctgcgagtattcctagtcccatgcagcctgatgagaaaaatgtgcatgtaagcatgctctcgcacacatcatatatatatcagatctgtggtttgagaatttctggactatttaaattctgactagggagaaggagccaaataacccatgcatgttttaccttttttatagtggcgtgaagctatatttgattaggaagtggctaagtaaaattgtcctttttgacttttaagatgcatttctcagtatgcttttattgttaaattgaaaaatagtctttttttttttttttgagacggggtcttgttctgtcaccagactgggtgcagtggcgatcttggctcactgcaacctctgactcccaggttcaagtgattctcctgcctcagcttcatatgtaaaatataatgttttccttatttactgctaaaacgaacagactttatcaaacactgacattttttgtgcattccccattgcgtttctgtgtctcttagatgtcgttcaaaccagaacaagaatttttttttttcactgacaataaaaacaaagaatatttcagtaaagaagaaacacctcttcttaaaggatgctaatgatgtaaaaattttctgtgggactaggactgttaaatagaattcctagaaattctatagaaacattggggcacgaaacagacatttataacatatagtcttataaacaatgatctataaaaacatattttattaatacctacactttaactgttgtgaagaattaagaaatttaattcctttcatcttgcctgccctgagggttttgttgaattcagtaaatataattttctcctttccataagaaattcagaagggctcaaagatctgtacatagtgcaggaactgaaagcgtttaattgggagagaataaatgtatgtatttgtgcatttagttcagtccttataaattctatggttctggtacagtctaaggttttgatattacaaaaatatgcatggcagccattccgtttgctttcttgtttattgccctgccagtatctaacatgttgcttctcaggtacaagaccaatgataagttagaatgtcatggttttcaacgttcccacccagtttcattaaagaataaccagaagccaagataaaaccatctcaagaagaagaatacacatttaatatcttatccatattttcatgtgacacagtctatgtatacagttaacatgcagctttctgtaactgccgtcttttgaaatgagggaaaataattgatttgtttttaaggtagatagaaaaatttattcctttaaactgtcataaagtttgaatttccaaaatttattttaccctgtgatttatatttataatggctatgtgacaacttttaagaaatccaataattttttctccttgtcttcatattatttctttggaagtaggcatggctggaaaacatttaagctgagagaaaaaaaggatcagggaacatatttgtagttcataaagagaataggaataatttgaaatgtaaactttttttacgtttcctttaaaaattccccgataacaacagtctccataagaagcagtagaacgtaatagttaaggcttgtgtcaggccacctaggtttgaatctgtcctttaaagtgggaggttgaacaagttatttaataactctgtggatgcttcaattttcttaactgtacaatggggataatgaagttacctacctataaggattagatgagacttatctataaagtgcttagagtagtaaactgctagaatatagtaggtgttcagtaaatgttgtatattattaccactgaattctattatttataatactaaatagagtagttaaattggtcaagcaatttaaatgatttctgcctacagaaacaaaaggtatggtcaattttctataatttttagattaggggttttcaaaaagtaatgcaaatgtcagaaaaggatatacataaaggtggtatttcttctttaaaaggtgtttgcatcaattgagcttttcttcctcaatagagacatgtaatggggttaagtaatttaaaggaggaaaagcaatcttcagaaaccatgcattcttttcaagttctctattatgttctctagagttctgcatttgcttttgttgggcaccaggggctgctaccgagctacaaacttggcatcactttggcacctttgagagcaactgatttaaagcaaaatcagaaacgcagctccccaattttatactggtccaaagcttggtcttctcatatacccccagagcaactttggctttctagtctgcttataactgactcctcctcactctggtttctgctcatttgtggtagtggccactgtgttggatgtggtggggcttaaagatttctccatgcttttgtgcaaacccaataatcccattaaaaagtgtgtttgttatattgatctaaggttttattggattgtggtgggaggactgtttgcttcactgctggaagctggcttagaatttgaactacaggctcttgtaaataaatcaacacttcagggttgatatttggacaaaagaaaaatatgattgtgttgatttttatatatgggaaattatgattattttatttctaatataattatttgtaaacttatataattgatttttcatcgtggctgtactatagattatactctgtaatgaaaagtgtaggacacatttcagtgtcttcagaaagggagcagtcacgcattctacacagtcagttcatcaagaagtccagattgtcaattattgctcaaagaatgctcttatccattttcttacttttcctaaaccttctaaaatgagaagaattctaatatgggtactaaaatatttgcacattgtatagtgacttttttttgctcaccatcttttatatatatatatataaatttttttttttttttttttgacacagtgaaacatgcacatggtacaaaatccagaaacacaatggaggaaaacagtgcaaagcaagctttaaaatccagggctctagccatcaagttagcagtaataattatctttgtgacccttcagagatttttctatgcaaattgattattgacttttagtcagtttttgactcttcgtgctctgaagtggttctaagtgctaaaaaaaaattcattataattaatatataagatatgaggctgggcgcagtggctcatgcctgtaatcccagcactttgggaggccgaggtgggtggatcacaaagtcaggagatcgagaccagactggctaacacggtgaaacctcgtctctactaaaaaaaaaacaccaaaaaacaaaaacaaaaacagaaaaacattagccgggggtggtggcgggcacctgcagtcccagctactagggaggctgaggcaggtgaatggcgtgaaccagggaggcggagcttgcggtgagcggagatcgtgccactgcactccagcctgggtgatggagcgagacttcgtctcaaaaaaaataaattaaaaaaaaaaaaaaaggtgtgagtataaagagggtgtggcctttaaacagtgtggcaaatatatctataccatatttttgcagatgtaaacaaccgcttccctttattatttgaggccagggagaaaacgtaagtctagaaggagatattagaattagggaaagttagtgtaatggttaactgtgcttctgatttttgggatgatacctcaatccaggaagcagaaatccccaagcctgtgaagaaatgatttatatatgtaattttttagaatttattttatttttgagacagagtcttgctccatcgcccaggctggagtgtagtggtgcgatctcagctcactgcaacctccgcctcccgggttcaagcgattctcttgcctcagtctcccgagtaactgggactacaggggcgtgccaccacgatgggctgatttttttatttttagtagagacagggttttgccatgttggccaggctggtcttgaattcctgaccttgtgatccacctgcctcggcctctcaatatatatgtaacatttataagcaaattacatctcttctattcagggtctagccaggggtatgtgaattactgagaatgcatatttcgtgcctcacaattatttttcttctatatctaaaacccataattagttacaaattgtttgaagtactaaaagaacaatatggaaaattatgaaaatagaaaattcaaagtctgtgggtagaaggtgacaaggaaaacatttcctaaaactaaattgaaaagaatcacagaaagattagtagaggaaattattttagattaacaggggagaagaaaatatctaaagatatttatcataaagaaacaagtcccccaaattcttaacaaactttggggtgaaagaaactgatacaaatgttgacatacttaaaaaaccacagcaaggtatgaaataaagaacatgcacatacaacatttcttagagcttgccttcaattttttttttaatcaggagcatagtattatataaaacaggaggccactttctgaagttccaggaaattcaaaggagatgaaagagaaaattaggaagactttaaatttgatcttgataattcaagagctattctttggggcaaaattggagtcaacgtattttttgatgagggcaaaaagtcaaacgggaaaaaacatcacaatactgttcccattgatagagtcatgtagaagcaatgggtgctcagagagaccttatgccctcttcaaaaagaaaggccagtcctcagccagaaataactagagccatcactgacaataaagtagctgtgatttcacaccaacaatcataatcactttcctgaggagaactataagaaacccagggacacaggtgaaaatcagacctacagagaatatatgactgtgattagaaaaaaagcttagattctaagaaagcctggagaacctgaagaaacttaaacattttcacaattccatgggctttctgtaactgctggagaaacctgaggtgctactctggttgtccttgttctgccttcctcactcatggatcaaatctccctcacacacaaattacgtaaacttgcagagaagtagagaaacactctccccagaggttgagtgcatgcaatgctgaatctgtttaagaaatgaagagggccgggtgcggtggctcacgtctgtaatcccagcactttgggaggctgaggcgggtggatcagctgaggtcaggagttggagaccagcctgaccaacatggtgaaaccccatctctactaaaaatacaaaattagctgtgcatggtggcacatgcctgtaatcccagctacttgggagggtgaggcaggagaattgcttgaacccaggaggcagaggttgaagtgagctgagatcactccattacactccagcctgggcaacaagagtgaaactgtctcaaaaaaaaaaaaaaaaaaaaaaaaaaaggactaaagaggttcacatccattactttcagtttaactgaaacatgactgtgccttgatttaaaatgacacttctaaaactagtcctgatttcccttactaaaatggtatgtttacaatcactataatagtttaatattaatagtaatataattaccattataattataaaattattaatagtaatattataattacaatcaccacaaactctaaagtgatatcattactttttaattacacctagacagtcagaacattttacaattagggcagttataactttcaaataattctttcaagaaaagatggaatgctggtcatttatagatggaatatctaattttagaaggctaatttaaactagccccagaaattttcccattcaatggagagataaaacccagtactctgggaacaagatcataaaattaagcccttctcaccccgctcaaaaaagataaatatctgggtagatacacaaatcgcagtctctgtgaacccacacaaaaataagcagggcattggcgttggggtggtttcagagtggggcattattcacaggaaaacagcgagattcactagggaggacataattcttctgacagtgacagggtctcattcacagaaccaggactgatggtgcatgcacagtcagcgtgccaagcagcacaggacctggatgcgggtccctaatggtgaactgagatcattgccgaggacacttggtgatcacataagggacactctgtttgctctctgggagatgcagttcatttgcactaattgcaggcttgggggcctggagaaggcagctctgtgtacacatactgtattctctttgttggcgaaggtagctctcatgggccctgttcctcttggcattgtgtgtgtgtgtgtctgtattaacagagagatttaaatgcttttaaaatatatgcgcatttctaattctttgcactaggcttactaatagcttgtgaggggaagctacaagataatagtgaattactttccggaaaagtttagcaggtaactcatgaaataaaagaaatccaagaaagcttaacctaattactctggtttacatgatcttgctttcctgaaggagagttcaatcttttaaaaaattcaattgacttatctattaaccatctatctatctttggtattgccaaagctagggaggctggctaattctcatctctaagaatatgtattttaaaatgcacttctgtatactttttttttagttatacaacttttgaaggaatataggatcagggatatatccttcaaacttaggaaacactgcatattgaatatactgaatagtgtaaaatgagcatgaaaggaatgtaatcagttgatacagtaaaactgacatcctctagagattagacaagattgactaaaaaataaagatttactaagtacttgaaatatttaaaggtatatgctaatcgctgaacaggcaaacagaaaaataaaaaaagtccttgtttggccaggcgctgtagctcaagcctggaatcccagcactttgggaggccgaggcgggtggatcacctgaggtcaggatttcaagaccagcctgaccaaatggagaaaccccatctctactaaaaatacaaaattagccgggtgtggtggctggcacctataatcccagctacttgggaggctgaggctggagaatggcttgaacacgggaagcggaggttttggtgaaccgagatcacaccattggactccagcctgggcaacaagagtgaaactctatctcaaaaaaaaaaggtccttgttctaataatgtttacaatatatatatggggatgccagacatgcacattatgaaaagttaccaacaagtaccaggctaataccttccaaacacatgaaaagtgcaaattgtattactgtcattcagagatgatcagtttttacttttcattgtgaaaagtcaacaagggattcccaggaaataagaaaaatttttattggattttgaataaagagaattcaaatgtgggaatggtctgatcacacaggtgaaaatgttttgcgtgtgtagtgtggatgagagaaaggagtttatatacgggattaatgggagcccgtgctaacagagatgttcttgtcaaatgtaacaggacctgagttgctacctgaggaatttgaaccaatggaaacagaagctcattcaagttttgaggatagttgcatgacctgtttttgttgttgttgttgtttgttgggatagggtctcactctgttacccaggctggagtgcagaggcatgatcatggctccttgcagccttgaccttcctgggctcaagtgatcctcccacctaagcctgccaaggagctgggactacagatgtgtaccaccaggtctggctaatttttatattttttgtagacacaggattttgtcatgttgcccaggctggtcttgaattcctgacctcaagtgatctacctgcctcagccccacaaagtgctgggattacaagtgtgagtcatcacgccctgccatgacctagttttggttcaggaatttttacctatggtggaataaaaggtaattggatcaggaaggatcctggaggcatacagatcccttagggaactatagtccacaaatgagttagtaaggcagtgctctaggatggtgcagtgatatttcgaaggcaaggatgggagccaaaggcccttttgtgcctaataaacaataccaagactgggggaaagaaacaaaatgataattctgaggaatatgggtgaaaagtagaattacagaaatcaggtaaagggctttgtgaattggtttgcttgcttgttctgtgggagaagagtttaagtgaaatgtgttgcatttaagttgcagaagtaatgcttaggtgatgctgtccagtgggcagcagttagaaatataccttaaacacaggagagcagtgaagggtgcagataaatctgtagaatttgaagccatggggctgacatcaactctaataagataaacagaaagatgaaaatatctaaatataggtgatgttaatgttaaggtttccgggggatataaattttaaacatcggttcaaaaacaatctgtaagatgatgtaaggatacatcgtacttgtcattaaatctaacatcactgctatgagcctagtaaaagacaaatacaatggaatacaatgtagactaaatcctctaagctgcaggattgcgatttactttggggaggtcagaagtccctttgtctttggcatggttaacagttctgggacatgtgttggagagcggatgagttcaggtattactagatccaaatctcaactcgccagtaaataaacttttactttagttaaggactttaagcaaaatttcagtatctcattcataaaataagtatagaattattatgggattagagataatatatgtattatatgcctggtacattgtttgtatccattagaggagagtggccattattatttattttcatgtttctcattttttattattgacaaggataaaactacatatctaaggatagaattgtattgatttccattaccaaggcaatgtgtgacagagggagaaatatttctgtcctgacactgaaaaatcattatatggttttactaggtgccatgggctaactctatgtgtctggtgcaattttgagcagaaggaaagaacactcagtaaaataaatattcacatgtcatgtgaatttcgataacattgataatgttagcagaacttcctggagaacttatatatttaaaggtggtcattgagtttagatagataaggtctgagagaaaaagaaaactgcagtttaagtataatctctagttcaaaggagaaaagatgaaaaaaaaaaataggaatcagatataaaccgaggaatcacctacaagctttatttacttagagcaaagttttggttaaatatatataaagccaaatattggtagatttaatgcttatacatgcacagaattttaaaaactaggaattttttatacacagagaaggatgtaagttcactgtacatgatttcaggaaataaaagcaatatgaagtttttggtaactagaaatttataatgccactttgaaagatatacaggtaaaatagtggttatatgtttatatatcactaagaaatatatttatgcttgtatttggttatataagactcaggatagcatggcagccacacatatggattgtggaccaagttttcctacatatgaactccagttactaggcaaagtatctcagtttcctaatctgtaaagcagtacctagttgatgggacagttaagatagttaaatgaactaatacctataatgaggttaggccactcctaaagcatggtaagcattcaaaagaagtgaattattttattgcttattactattatcaatattccttcgtaatggaataatgttacctcaatatgttttttatattctccaaatgtgcctcattgattataatatttatgctctgaattgaagtttgatattaattattactatagttagttgatatagggcagtgttaactaaaatttaagtgacatgtttctctctctctctttttgtttgtcttagacgaggtctcactctgttgcccaggctgaagtgcagtggcaccatcacggctcattgcaaccttgacctcctcgggctcaggtgattctcccacctcagcctcccaagaagctgggactacaggtgtgtgctaccatgcctggctaatttttgtgtttgtgtgttttgcagagatggggttttgccatgttgcccaggctggtctcaaactcctatgaaagtgatctgcctgccttgatctcccaaagtgctggaattacaggcatgagcctccgcacctggctaggaacatgtttctcagtcttctttgaaatctggtgtctggtgaatgtgaagaatgtgaagaacacgaaggcagggcagagacactgtgctaaaaaaaaaaaaaaaaaaaaccaatgtgatgagtttcaaaaggtgaagagttgggaaatgtatatcagaggaggtcaaagaaactcctaaagtctctactcaataaatgtaaagagaaacaaagacatttcaaggactgggattgtcaaaggacttctaatactggatgatggaccattttttggtttgagactgttcggctcatttttgaacagtgggtgaagggctgcctgatttgtatatctctcatctccccataacaggaaagaaaagcacagtataagggccacttgtccagcaggcttatttacagagccactgttggcagtatccattgactgtcttgaaaacctagagttggctaacaattgttctctactatcatcaagctgaggaatccagagatatggctagggttgatcaagaacagttcagttttatccagtttctctgggggtgatgaagacctcctaaccataaaagcacatcatccttatgcataaggtatgaatagaaggaaatttggctttctagattcagtaagccccataattaaacaagtttctagtttaaaagtctgtggatcaagaatacttcactttatttgccctacacagataagaaatgaaatagggatcaatgatcctggtttagcaggaatatactttttacatttttaaccacaagatgttaaccagtaagaaattttgcaaatgttatatgaccccagcctctgcttcttttgtggttattgcttcaacccagctgagttgttcggcttctcatatcaaagatcagctaagaaaacgatgtactatcgatgtaattctaatgaaattatataattaaaagcaaatattttgacacagatacttaagaatcaaaaaagaggaaggtatctaattgcttgaaaattgccacatcatttcataggagacaagttacattacttatagtgatttttagcatttgtatctagaaatcaatgatgctagagtccattaatatattttaactcacatatattaagggaggaggttgtcctcctctgagtaatcaagatgaaagcaccttaggttttataccttgattagcacaaattcgatttttggtctccttatgttcatcttatgttcaatgaagaacacctttataggcattttgaaaaaggaagataaaaagtaagcttatgaagtttttcgctgataaaaataacagcataaaaattccaatactatgttagttccttgataaaaataacagcataaaaattccaatactatgttagtagagaaacagcacaataaacctgaaaatatagacatcaaagtggtaataagaaatatcttaagaataatatgtatgaaaggtacacacactaacagtttttaagagctttaaatacggaccttagatttttttaatgcccactgctatgctaccattaaaaaataaataataaaatgaaattttggaaccttactccaagaggctaccaaaatgccacagttttgttgttgttttggtaatatttaattatgaataattttattttaaaaatctatttctgatgctctattaagtaataagaaaaatgcaaatccatactttgcacaagcacattttatatttgtgtctaattcttcacatatgtggtacaatgatcataaatcaagggcacagctattattttgcttgtacaaggtagtggcttcacattgttaatgtataaagatacattcttcatgtttccagatcaggtggtaaggaaaaagaaacaaatatatgggcattctgcagttgtagcgattttgaaaattatattcattgaagttgtaaactaaatcacatgacataacctctactgagagaagtgcaagcatagcaagatttcgaagaatagattttctctaatattaattaacagagagctcaaaactttacacaaccatatataagacttgcaatatcttatagaagtttcaatcattcactatattgctactaatattatataattgaaataaaaaattaaagtagttgaaaaaatatgccaaaaatgtttttggcatattctttcaacttctttaattccatgtcctttccatttgatatcataatcttctctctttgaagataattataataattacacgtgaacacacagatgtaagaaatatatatgtatatatttatcttactatgtatctgtatatatatcttactgtgtatatgtgtacatatatatcttagatctaaaacagtaaatttatgaagccataaaaaatgtaaatgactaacctggtgttactactactccatttccattgaccacaggcctctcttcctcttcctcctcaggaggctctatactggctttctccatgttgctcactgatttattcctcttccgttttccttcagcacttggagtggctcctggaagtatctggtctgttacatttaacaataatggtgctggttctgctggcggctttggggtaccgtagtaattgtctgcaaacaataccaaaacattcttggagttaaatatttcttctaccatgtacataatttgtgaagaatggaaattatattaacacatttttatcctattttatatgtacatacatagacacatacatatatatatatggttttctatctatgtgtctctctatatatatacatatttatttgttccttctgttgcgttggactttaatgcttagagatatagatctatctttattctcatctttgtgccaaaccaaaatatagtcttatgtattattcccaagcggtacatagttaattttaaaattatccgaattttttataacaagacttgattataaccttttaaaaaataattatgttaagagtacaggtaatttttttgtagtggggtaatctcacactattctgaaaaggcaaagcacgttctgctattctgtagctttcaaaggattatggctattgtccttgatgtgcacagcatcctgcctagagctgtatccccgtgccagtctagtggttcccatggctgctgacagtgcgcctgctgctctattcactcttcagattaccacagcttttttttgcccatagctccattatctgagctatggaatcatctgtttcacccaaccatctgcagcacttttttgaaaagagaatcattcttatttattcccatattaaaacctagcatataatcatggaataaatgtttattaagtgatcatctttattatttcattttattgagacagagtcttgctctgttgcccaggctggagggcaatggtgcaatcttggcggactgatacctccgcctcctaggttcaagcaattcttgtgcctcagcctcctggagtagctgggactacaggcgtgcgccaccagttctggctaatttttgtatttttagtagagatagggttttgccatgttgcccaggctgatctcaaactcctgacctcaaatgatccgcctgcctcggccccccaaagtgctgggattacaggcatgagccactgcatgcggctgtgaacatcttgatatgttcaaggtaaaacactttatttaaaatatcctaaaatttagattggtaaagaacgtaggtcatatttttttgaaatcaatcttatagcaccaactttgaacctatatcagtgttttcagttaattgagtaatttatgcacttacttgatcactcattaaaatctttattggtactaagttatgcacccaggcactccagtatatgtttgagagaaaaaggatgaatacaataaaatccttgtcttccaagatgctcaacagtccactaagggagaccaaatttgatgtcaaacagaaaagcattataacaggaaataggagaaagcactgcaatggaggagatacacaggaggaaggaagcacacctcactgtctgcaaaggtcactaaacacatctgggtaaaaggtgtgctgtgaaaggaatgaccattaaccagaagacatagaatttaggcttggcttttttatataactacaagcaagttacttaacctctgtaaggctcaatttcttcatctgtaagttgggaagagcagtaattgttctaatcacctgtgttctgggctgcaaaaaaccacagcctactcaagttaaatgtgatagggatgtgctatataaatatataagatggctagttgagagataattgcccgacgcccgtagtcccatctattctggagtctgaggcaggagaatggcgtgaacctgggaggcggaagttgcagtgagctgagatcgcgccactgcactccagcctgggcaacagagcaagactccatctcaaaaaaataaataaataaaataaaaaataaaaaataaaaaacattgcccaagactgggtaatttagaaaggaaagaggtttaattgactcacattttcacaaggctgtggaggcctcaggaaacttacaatcatggcaaaaggggaagcaagccccttcttcacaaggcagcaggagggagaatgaacacaggaggaactaccaaatacttataaaactatcagatcttgtgagaactcaccactatcaccagaacaggatgggggaaactgcccccatgattcaattaccaccacctggtctctcccttgacatgtggggattatggggattacaattcaagatgagatttttggtggggacacagccaagccatatcaaggggaaaggccgaaaaaccatgagaaaaaatggcagaaacaaaggagcccactccagacacttatgttgcctttgatagccctgaaatctccagatggttctactaacaaagggacaacccacagtgcaaactgcctccatgagaatgggctccaaactgtcctcagctgctctgattcactcatttctagggaaaaaaaaaaatcccaggcaggatcatctcattggctgagcctccatcacgtgagagcacctgggctgccaaggaagcagaagagatgtgcactctcctttgatttcagtagagggagagggagggggagccctaccgtccactgattttatctcaggggcctccccgggtagaaagagcctctccctgcccctgctaccccgccccggcagaaagggccttggaatgctggcaggtagaaatgacaaatctccactccatttgccttctcactgggttgttgtgaagacgaagtaagaatgtatgagaaagagctttattaaaaaaaactgtaaaaattgcagtggttttaacggcagtgtaaacttcatgctggcataaagtgagcaaatattctgaaggctagctgtgccaataatgccattgctcatcactatagatattcacagtaagagagtaatgcaagaaaaaaaattaagttgtaaagtggttcttatccacatactgtaagtatataacttttttcttttacagtcggcaaagtggataatatatacacgttgctaaatgttactatgtaatttgatttagagcatttaaaataaatcagacctctatatgtaccagacaaattctgagcaaacaaaaatgaacagttgctccctggtatcaatgaacttttatatttcagcattcctaaagggtagcacagctttcagtaagtatgttgctatgctttctatggaatctcaacacatacttcttatctaataagcataatgtaaaactaaataatctatgcatatctcaataaatgatacatgattttaaggtagtattctaatatctttaatacctttaatacatagtactaagcaaaatggatcacacttcagtgttttttttccctatttgtcttgtcaatttaaaatttccctgaagtaaaaaaaccttttactaattagacataaatgcatagcacaggctaaaaataaatactaaataacagatcctgctaaatttatattactaattatacctattggtatatgatatgactataaattatacaacaatattctatttctataagtgtatgaaatacatcagattaaattttatatgtaaaaatatgaatcattagttaagacattaagattatctttattggcaataatagcaatataaaggaagcacataaataatccatactcttactacacttgacaaatgtaattcatagagaataaggtaccctaagccaacgtttttatctcattgcataagaaccaggaaaccagaaatacctagaccaatggttgaagaattagccaagcagtcaggcagctaactcattgaactgactccctgaatataagtgtatacaaataaatgtatcaaggataaaatgtgccttttaggtaacgtaccagtatgttttcagaaaaaaataaatatcaaaactgttttaaaatacaatttggaaaaattgttccctaaggatgaagtgcctatatgcatagtgcctggatatagaaaatctaaaattaaaacagacgaaaaaacaaaacctccacaaacccacaacaatatggtgtaatgcttaacagcataaatgctagtgagataaacctgactttgaatcctgtgtcccctaatctcaatacctctttatatccttaaatcaattcagttaaagtgggaaagtggggatgtaagatgaccacagtcacaaaagcaactataactattactactgttattaccactatgactgctacaacgtgctaacctgcacaccgtcatgggcattttacataagtattcttgtatcaaatggggagtagagtaactctttccccacagtgctgttatatagattaatgatactaaaaggatatatgacgtgactagatcagagtagatgctcaaaatagggtgctacttttggtatttattcatcacaatatagcatgaagtcattctgcctatgcagttaagaaaatagagactaagacgttaaactatttcctaatattatatataaagcgagtggaaaacttatatctctttgacttaagaacctcatctcttttgaaaatacgctgttgccttttaagagaaaaaaatgtgtgatgcaatcgcaacctgcccagaactcatagaggagaacttcattcaaagccacagtcaatgaacacaaatgcatcagtttcaaaagggaaaggcaaaattgctaccaaagcatacagcaaggacattttaggaatttttttccatccagtcctttaaaaataagtgtgtgtgtgtttgtattttaaggagagtacaggcttttctagagcacttttcacggaatatgtttgtacttgtgaagaatcatctatacattagcagtttcttgtaagtttaatatcaaattccactaacttattgagtacaacaaaatgatacataaaattgtccccttaattctgtgatatttggaaaatctataaatttacatagtcttctttgtaatcaatgcctgcaaaataagagagaaagtcatttcaggaccctgacttattcttcagttttttaactacctatgaacagattctttttttcataaaggtggggctatgaaaatgtggaacaggatgaatgtactctgttatacaaatagaaaagttggccgggtgccgtggctcacgcctgtaatcccaggactttgggaggctgaggcgggcagatcatgaggtcaagagatagagaccatcctggccaacatggtgaaactccatctctactaaaaatacaaaaattaggtgggcatggtggcatgtgcctgtagtcccagctactaaggaggctgagacaggagaatcgcttgaacctgggaggcagagggtgcggtcagccgagatcacgccactgcactccagcatggtgacagggcaagactccatctcaaaaaaaaaaaaaaaaaaaaaaaaaaaagaaaaagaaaaaaagaaagaaaacttttccaaaaatgtgaataaaaagaatagcccattgtcaataatttattttgtaataaaaacatttaataaatgcccatttacacaggacagtcacacaatttattgcaaagggagagagactaattatgagctaaacctgccaggcaaagtccttgcaaaacctaatcccttacccatttttaggcagacctgtccctaggtcatctgaaagcagtgagaatagctttctaaataacttttcatgtactgtacttgaaaccattgtggaattattcttctgctttctctgtagtcaattgacctttgcataaaagttgtattttaagtttctaaagtgatgattttacctttcttctgattcctctcagattttttcacattgatttagtggtgaggctaaggggaaaaacaggaatatgaaacgatttcaacgaatttaaactgtttccttttttgtacctccagtcttcattgaatgataatagatatcaaaatattattttctgagatgcaccatgttctttatgcttttaaattccagtattatgacaagaaataggaaagacactgaaaactaattttaggtatgaggaaatgtaaaaatgctagtagcagatactttgaaatactttcacttacttccaacaccttttttctttaaacaagatcagttttcatgatggaaacatataatttgttattactttagtttatttggctttttaagttgtagactcagatgcttactctgttgtttcaatccttttggtgtataataatatgtgtaggttttatatcaaataacgatagatccttccatatggctcccaagtggagatgggttttacaaaggtaataaatatacttgtcttcaagataccacacagattaaggtcatgacttctattcctccccaatattctcagtccttttttccccgttttggtaaatggaaagaatgaattttggatagtggttcagcagaagagagatgattgcctgcaggacccacggggcatgcaaacagcgcagctcatcaatggtattcccagagagcttgaggatatgtcttcgtgttggaaacaatatgtggcaaactttaaatggttgagaatcatatttgtttttatagttttataaatgaagcaaatagtttgatgcttggcctctttaatagcacctgcaaaaattgactctgacgttaaacagagaaaagatttagggttccagctgatcataattatgttagaaaacttgccagattgtaagtaaacaatcattttatacacatcagagatttagatgtatattaatagaaatggataaatcatcaaaggaccccaaattcaaactttaagacatgtttaacatattaaacaagggatagtaatgagttaaaactagtaccaaaaaccattctaactcatgtcacccatggcaaaagaatcatagtcatatagctatagttagtaaattagaaattttgtaaatataaaatgacgtgagtaaatataacccagaaaatattctacttttctaaaactggattttctaccagaaaataagacagaaattcttactgcagaattcttttgtcaaccaatttttgaaattatttttgtaagcagctctgatgcttacatttggtcctgaaaaaaacaaaaatatatcatttcctcatcatgtcatatgtagttagcagcttgaaaccaagatgcagaaactccctgacctcgaaagataatgtctttttctcttgtggtgaaaaagcattaatcttacatgtgtcagaaataagaaaaatataccaaatagcattttgtcatcaatacttatactgaacagtaaatttctgaatttttagaaattcagtgtttaagtgactttcaggaagtccacaactgtacaaaaagtgggaatgtttgttttttttttcatacatggaattgaattattcttaacaaaccccacctaagaatttcaaatttgttgtaaattaaattaacgctggtttcacaatatgatctccaatgacatacattctgaatttactgtctttattattcaccagtgctctccggaaagtcatgcagatagttaaatttgactaacatttcctgaaacttgtttgcaagtcctcagaggtcactctgactgaatattcatttattcacgtcagctaatgtagacaggcacaggataaatctttgctaaatgtaattgtccacagactggctagggaaggtggtttgttcatgtaaaggaaattggacactctttccttcagtggctcttcccttcaggtgttatcagagtagctcagaacatttcccacctgcgccagatagcagacggaaagaaattataaagaagtcacacatgatttgttgatgtcaaatatacatctgcttccaaaagaaggcatttgaacatttgtaactataacataaactttaaattcatgagtatatcccatttaaagaatgtattaaatcccttagaatagcactatctagtaaaaatggaatgcaagccacagatatgagccacatatatggaatttaaatttttttgtttttgcttttcttttccttgctaaaggagatggttttttttttttttttttttttttttttttttgggacatggtctcactgtgttggccaggctggtctcgaactcctagcctcaagccttcctcctaccttggtctcccaaagcactgagattacaggcatgaaccaccacacctggccaatcatcttaaaattttctagttagccatattaaaagagaaaaaatgtgaaagtaattttaatatttttctttaccaatatatccaaaatattttaataattaataaaaaagttactgtaatattttattattttaatactaagtcttcaaaatccagtgtatagtttacatttacagcacaccttaattgggacaagccccatttcatatatttaatggccatatgttactagcagctgctatactggacagcacagcctcagataatccctttcatcaaatatcattttaaattactatattatcacctgaataactcatttttctcacaaacaataaaccgaacatctctgtcgtaaataactgagaaaactgagtaaacaccaaaacacaataacaactgtaggtgacaatgtgtcaatgatatttctcttgtttgattgctttggtccattgagcacctgtaaaatgttattaagcatctagcagatgtacatgtcttagcaacactctctcattctgcttcctactcatccatttttatcactttatcttgtcttaacttgaaatattcatttttaactttattattaagatataggatagaaggtaaacaaaaaaagaatgaatgttttaggcaaataagcatggacttgtgtgaagacactgttcttgtgttcacgggtaggactgaagcgccctctttataattagtcatagctcacagacagagggattgttgactcatggcagcagtgtggaaacagacaatactcatagttatccttttctctcttgcatttcctctataactccctctcactttgatcccccatcgtgttcagtacccagtgcctcatgcttctcttttcattaggctcctactttcgcacctcatgctcataacaattccaattttcttttttttttggacatatgatatgtgtcccatttccaatttcctttcagtcttgccaagtgactgggttactactctgagaaactaaactaagatgtcaaggattaaaataggcttcataggctccatatgatgcttgcattttaattagagttaaaactctaatccaaaaggttaatcttaaaatttgggaaataactagtcaaccactggaagaacttatttttcagaagagcctttggtgctcctcaaatcacagtggaggtgttatcctgagtagtaagggctcctgggagggtagatatgatgaccctgctccctcagggaactcaagcaaaatgcagatgcaaagatatttggaaaacggtactgaataaaaaataactttagtataattccagttagtaacaaacttataagtctatctttttgaatggaaaccttttgcaattgtgttattaatgtaattattaattaagtttttttttttttttttgagacagagtctcactctgtcaccaggctggagtgcaatggcatgatcttggctcactgcaatctctgcctcctgggttcaagcgattctcctgcctcagtctcccaagtagctggggctacaggcatgcacctccacgtcgaattaatttttgtatatttagtagagacggggtttcaccatgttggccaggatggtctcgatctcttgacctcgtgatctgcctgctttggactcccaaagtactgggattacaggcatgcgccaccacacctggccttatttaagatttttaagtgtctagtgagctcaatgcttaagagacaatcccgtcatggctcagtacgtaagaaaaggaaagtgaaattttgacaaatttataaatgggcatttgtacaaagctcagcagattcttgtgatagtcatcttaattaaatttacttcttcaaaaattgataaagaaaactgagcctttcaaggacattactttctcacacaacatttatagcttgtcatataacttccttctcccaatggtgctttcaattgtgatattataaaattgcgaagaaattaggagacctctacgactatttttagtccctgtcttgtaaatacaatacccagggaaatttctgattaattttaatttgattgttggttaatgattaaaggaatttgccaaatatcaaatctctaaccctcagttgctaataaaagtcagaaaaacaataaaaaagaaatttcatttctccttgaagaatatgactgctagattttcccaagcttgacatggtaagagctctgacacagagtcagaggatctaggttctaaacagggttctaccactaatctccttaaatgactgtgaaccgggcagcaacctcccctgaacctcagattcctcactgtgaaaatacagaattaggacatacctctaaaatgctcctcacctccaaaattctgtaatgaaaaattttaaaggatgcaaggacaacaggttttctttttcatcatattagaaagccctgaattgacaatgaatagagaataacaataaactaaagtcaacaatttcacttacttgagaacctggatgcatttgctttcctgacataatgtggaaaactgtcatttgactgtatctttatatgtctttgcacagtcccttctgggaaagtgattgtggttgcagagtgtttctatttttattccaagcctttcatttgcatccatccctgttggtgaattagagagtccctaagtatatctcccataggatgtagactatgattactttgtggaaggtcatatataaagcacttcgactttatattttagtctatgtgatactttaaaatttactgacttttttggagttgacatttttattgtaatcaccttgtgatctgtgtgacacaaacataaagcctacgtgttagagtatggttaacattagcagcaatttagatgtaagtagtactaacgcataagtcagaaaaacaacaaacaaaccaaaaagctaaataaaattttctttagccttttggcatataaccctaggctttgactgcatgatgctagcatgtcttacttaacctggattttcttttgcctctgaatcaatatactgactacctatgaaaaccaatctaatgacaaagaaaactctgaactcattttatatttaaaactctggaaatcaactaattctttttttttttttgagatggagtcttgctctgttgcccaggctggagtgcagtggcacaatctcggctcactgcaagctctgcctcccgggttcatgccattctcctgcctcagcctcccaagtagctgggactacaggtgcccaccaccacacccggctaattttttgtatttttagtagagaggaaatcaactaattctttaaaggtgtaaaggtgtatattttactgaggtatacctcttctactcatcacatttttatgtaacttggcctttcataccatccttcaaattatatagcaaattatgaagtgtcacaaataagagtttacttagaaaacctgttgaattactgagaaacgagcacagtagggaaagaaatgtgtgggtcaaaaagaccagaaaatacataggaataagaaaagtaaggacaaggaggcactggaaaaagatgaggaaaagagaagatgaagaggagaacacaaaagaagaggaagtgtcatgtgtaatttcatgaagttgtaaggttccagtgtaatctctgaggagacattttggcccaaagccacacacacataaggtcatctgtgatgacccagtatctgagaaggtactagagcggcactatccaatatggcagccacttgttacatctggctgttgaggacttgaaatgtggctagttcgagttgagatgtgctgtaaatataaattgcacactagttcttagtaccacaaaagaaataaaatatcttagtaatcatttttacattgattatatgtcaaaatggtaatatcttccatctcaattcctgggctagttcttctgaaaaaaagtaagactcaataagtagtcaactactagtaagtaatgatatccataactaataagagtgagtgaaggtgagaaggagtcaacccaaggatccaggacaatagacatttgataggcaagaaactcaatcagaaagagtatcaagaaccacgattggggttgagctgcttattgcctgaccaagccaatgacagctgagtgatgggcagaggggaaggttatcatacatctaatcatcttgtcattcatgcagcaaacatttactgatagcctattatttgccaggcacaggttaactcaaggaacaatggtgaatgacataagcacagtcctctttgaaacttaccttctcctgagggagataaatattaatcaaaaaatcacacaaatacaaaattataaattctgacaagagctaaaaaggtcaagtggtggtgtttggagaactccaagaagagttcaagttaggctttttaagaaaaaaaattggaattatgattgaatacccagcctttctccctcaatctgggccaaaatatttatggataaatacagatctttaggaaatgcatgtggtttaaccacaagaaataaaattgctccaatgttcttaaacttgtcctaagtaattttctaaaagccaaatggctaaactatatggaaatgtatatatgtgtgtgtttgtatatatatgtgtgtgtgcgtgtgctcccaaataaatcaagttgcttgccaaatctaaaattagcaacatttctgctgattagccagataagctcttcttttctcagtttaacccaagacatagtctctactgaaaagacctctaacattcacaaatccaagagctatgcagtttgaaatgaagttttgttttttactacataaacctaattgaaggtagaactgatagcaggtttaacttgatattgacctttgtttctagactgatgaccaatgtagtctggtcatttcctgcttctgatagtgggggagcaagtagagtcagtgaaggaaaggctcctccatagcactgatgtctaaagtgaaattagaaaaaaaaatgagtaaggccaggtgcagtggctcacgcctataatcccagcactttgggaggctgaggcaggtggatcatgaggtcaggagttcaagaccagcctggccaagatggtgaaaccccgtctctactaaaaatacaaaaattagctgggtgtggtggtgggcacttgtaatcccagctacttgggaggctgaggcagagaaatgcttgaacccaggaggcggaggttgcagtgagccgagatcgcaccactgcactccagcctgggtgacagagcgagactccatctcaaaaaagaaaagaaaataaaaaaatgagtaaaatgaagtaaaggctcaagaggtacagagaggaaaaagcattccaggcagaggaaacaaatttacaaaagccttgaatctggagaaataatagtaacttggaagaactaataggaaaacactcaggctagagataatatggaacctaatagggtttgttaaagatttgggtcaatttccaagaaataaaaggaagcccttaggggttttaaaaggcattcagatttgtttttaaaacagatgtcaggctgcagggtgtaagatggattggaggcagcaagagtgaaaagtcttgaggtcaatgagggatatttacaaaggtaaagatgttatctttgaaactgcctttgtaaaaattataactgaggaaatcatgacaatgaaagagctctgtcctgactccatcttgcctttaacatccaaactgtttttttttttcatacctgggtgcaggctgaactaactttgggaggaacttacagtttaacaaagatgaaaacagccctttcccaaaacaaacccccttcttgcctggggagtagactgtctttgcaggactaacaaattagccacaaaattaacaattatggttaaagagtcaccgttttaaaacctgagatcagtgcttgagatattttgcagaccctgcatttcaaggcatcagctgacaccacctagatcgagaacctggctcatctagtcttgtgtacaccccccccgcccaccgcctccccccaacactcaggaactgactcagcacaagaggacagcttcaactccctgtgatttatcttccgccggaccaatcagcactccctactttctgaccctcttctcaccaaattattcttaaaaaccccgatccccagattttcagggagactgatttgggtaataataaaactctggcctcccatacagctggctctgtatgaattaaactttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaattaaactctttatggtgattcccctgtcttgataagttggccttgtctgagccccgggcaaggagaacctgttgggtagttacagcttgggctagtggaaggtgatggaatggagacaacgatggtaccaattaggttccaaaggagaaaaacagaaaacagagtaatggttaggaaggaactaatatgagcagcttgtgcttgaagaactggaagactttttcttgatgacctccccttatctcatttggaaataagcaatcttggacatatctaaatttgctcctaatactcaggatttctttttaaaaaatttcaatagttttttttttgtttttgttgttgttttttttttttttttctggagacagagtcttgctctgtcgcccaggctggagtgcggtggcgcgatcttggcttgctgggaataggtagtgtttggttacgtggataagatctttagtggtaatttctgagattttggtgcactcagcacctatgcagtgtactctgtacccaatgtgtagtcttttatcccttgctcctcttccatgcttccccctgagtcctcagtccgttgtatcattcttatgcctttgtgtcctcatagcttagctcccactcataagtgagaacatacaatgtttagttttccattcctgagttacttcatttaaaataatggtctccaactccatccaggttgctgggaatgccattatttcattcctttttatggctgaatagtattccactacacacacacacacacacacacacacacacacacacagacacattttctttatccactcatcaattgatgaacttttgagctggtttcatatttttgtaatatttttgtaattgcaaattgtgctgctataaacgtgggtgtgcaagtgtctttttcatataatgacttattttccactgggtaggtactgagtagtgggattgctggatagaatggtagatctacttttagttctttaagaaatctccatactgttttccatagaggttttactagtttacattcccaccagcagtgtaaaagcattccattttcaccacatccatgccaacatctattagttttcaattttttaaattatggcccttcttgcaggaataagatggtatcacattggggatctgatttgcattttctgataattagtgatgttgaggattttttcatgtttcttggccatttgtatatctttttgtgagaactgtccatattcttagcccattttttgatgggattatttgtttttttcttgctgattttttccttgtagttccttgtagattctaagtattagttctttgtcagatgtatagtttgcaaggattttctcccattctatgaattgtctgtctactctgctgatttttattttgctgtgtagaagctttttagtttaattaagtgccatctatttatctttttgttgtatttgcttttgagttcttggtcatgaagtctttgcctgagtcaatgtctagaagggtttttccaatgttatcttctagaatttttatggtttgaggttttagatttaagtgtttcttctatcttgagttgatttttgtataaggagagagatgaggatcctgcacgtatcttgccaattatctcaccaccatttgttgaataggatgccctttccccctgtatgttttcatttgctttgttgaaggtcagtagcccataagtacatggctttgtttctggattctctatgctgttccattggtccctgtggctatttttatgccagcaccatgctgttttggtgactatagccttgtagtatagtttgaggttgggtaatgtgatgcctccaaatttgttctttttgcttagtctcactttggctacatgggctctcttttagttccatatgaattttaggttgtcttttctagttctgtgaagaatggtggtggtattttgatgggaattgcattgaatgtatagattgcttttggcagtgttgtcattttcacaatactgattctacccatcaatgagcatgagatgtgtctccattcatttgtgttgtccatgagttatttcagcagtgttttgtagttttccttgtagagatcttttacctccttggttagagatattcctaagttgctattattatttttatgttggtggttgttgtagctattgtaaaaggggttgagttcttgatttgtttctcaccttggttgctgttggtgtatagcaatgctacagatttgtgtatagtgattttatatctgaaacttcactgaattcatttatcagatctaggagctttttggatgagtctttagggttttctaggtattcaatcatatcattggcaaacagcaacagtttgacttgctctttgctgatttggatgtcctttatttctttctcttgttgaatcaaaaacaaaaaacaagaaacaaaaaaaccaagatattcaggcaacaactagcacaatgaatagaatactacctcacatctcaatactaacattgaatataagtggcctaaatgcactacttaaaagatacagtggaacatgacaagaatgccgtggctaagacttccagtactatgttgaataatggctagccagtactatgttgaaagaagtggagaaagtggacatccttgtcatgttccagttctcagggggaatgctttcaactttctccattcagaataacattggctgtggatttatcataggtggcttttattacaaggtatgtcccttctatgtcaattttgctgaatgttttaatcataaagggacgctgaattttgtcaaatgacttttgtgcatctattgagatgatttttgtcatttttgtttttaattctgtttatgtggtgtatcaaatttattgatttgtgtatgttaaaacatcctttcatccctgggatgaaactcacttgatcttggtggattaccttttggatatgctgttggattcagttcactagcattgtgttgagaatttttgtatctatgttcatcagggatattggtctgtagtttttttgtttttttgtttttttgtgccctttcaagacattttgatgtaggcatttaatgctatgaactttcctctaagcactacttttgctgtattccagagctattcacaggttgtgtcattattatcattcagttcaaagaatttttaaatttccatcttgaatcaatgttgaccaggctgcagtgattgttattgctcttctgggtctagccacccagtggtactgggttggtactggggaatgtctgcaaagagtcctgtgatgtgatctgtcttcaggtctctcggccatggataccaacacctgctctggcagaggtagcaagggagtgaagaggactgtgagggtccttagttgttttatttactgtgctggttttcttgaatgctgattgtgctgacagtgaaggtttcacgtggacagactcagggcctcgggttcgccaggatgttactggtggtggaattagctgctgttttctcctttcttggagcagggttattcttttatgagttgctgtaatggcttgagttggttggcctccagccaggaggtggcgctttcaagagcgcatcagctgtgatcatatagggggatataagcttgcccttaggttgcctggataagtattcaggtttctcaggcaatgggcagggccatacagcacccaaaagtttatgtctttcgtctttggctactagggtgggtagagaaagaccatcaggtaggggcagggttaggcctgtctgagctcagcctgtccttgagcggggcttgctgtagccactgttggggatggggtgtggttctcaggccaatggagttttcctcccaggcggattatggctgcctctgttgtataacacaggtagccaggaaagtgggagaaagctggcattgacaggccttcacccagccccacgtagccaggcaggccagtctcactcccactgtgccccaccaacagcaccaagtttatatccagtcagccggtgagcagggctgacatcttgccccaggcgacaagcctctggactgagagagaaagcaggggtttcaggctctgcccctccccacctgccatgacttatgtgctcatatttccacttgtttgccacccccaccagattctgcccaggaaaatttgtgcttgatcaaaatgactacaaagttcagctgaaagtttccttctctctgtggtccttcgccaattctactggcagccctccctaaggaaccctgagagataaagtcagaagtggcttccctgggcttctttaggggccgggagtgcctacaggactctccccgctgcttcttctacttttatatttggctttctaaattcatttcaactctaagtaaggttacacccttctcctgtgatctggattttcgggttccccagcgagatgtgtgtttggaggcagacttttcccctctcacactttgggcactcacagtttttcagccatctcagagtttgccgtggcaagccacttctttcaaagggtctgtgaattctttcagttttcctagtatgttcctgcagtagttcttggagcagaagttcatgatgtgagtctccacatgctgttctatctgtccaaggggctgcaagtcagtcctgactcctatccaccatttattttccttccctgatactcaggatttctttatgagatgctgtgggctggcaacaccaggctgcaataaggattttttttttaaacattacagcatcctataagtcttaattttttgaaagaattacccttttaaaaagtcttaatagatatcagacactgattggtagcccaacagcagtttaaatctcttgtcatagcccttctattttcctgtaattatttatttgatgtctgcaaagccctaaattttggctcctcaaaaggagccatttatcattaagctttgttttcccagcctctagaacaacactggcatatggtcaatactgagtaaacgattagtaaatgaattcttacacagaagagacactcacatcctgtaaagaaagatgcagtcctggtggtatttcttgactttcatgatgacaaggagatttgggaaaaaccacacattagagcttaagctttcaaagtgtaggccccagagcaacagcagcagtgtcacctgggagcctatgagaaatgcacattctcaggccccactctgcacttattaatcaggagctctgggcatgggtcactctaggtcattagaatgcacgttactatctaagaaccactgtctttgaagattcccttaatgagagaccaattaaatgaggtttattttaaaaggccggtaaaagaaggattcaagtattttatgatcttctatcattccttccttcaaataatctttatgaaaagactgaggacaatgtagttgtttttaggtattacatttctgatatgctaacttgtctatgttaggaattgacaaatattttctgtgaagggccagagagtaaatattttaggcatttcaggccatacagtctgggtcattgctactcaattctgctgttgtcgcatgcaggtagctacaaacagtccataaacaaataagtgtgggtgtacaccaataaaacattatttatgatactaatatttgaatttcatgtgatttctatgtgatatcattattctttttcatttaaaaaatactctttaaaaatgtaaaagccattcttaccttgttggcgacacaaaaatagaaagtagactggacttagtccacaggttatagttttccaacccccagtctatgtaataatcaattacattgaggttgatttttaaatttttcattagaaattacacaagaatttccaggtataggtatcattcattaactgaatacttcatatgtacctagcaaataagcaatatagacaaagcttttgtcttcagggagcttaagagcccagaaaagacatcaaaattaatcaaataaataagtgagaaagagaacataatcagaataccgtaagagagggtaacagagagaactcccttagacagattgggtaagaatggcccatctgaagcgatgctatttatactaagatgaaaaagctaatgaaaatttgcccactatatgaaaagccagaagagactttataggccaaagcacagcaagcatgaagtccctgggaaagaaggagcatgtaggcaccgatgaaacctaacgtgactgaagcataacatgtaaggggaggaggggcagcatttgagcctgagaagatgacaggaagcagatcatacagggccttgtcagtgaagtcaaggattttggcaaaggttttatgcaaggggctaactggattttatttaaggctttaaaaatgacttccttcttgttacgctgtggaaaacagatttggaggggaccaagagaacaggaagacggtttgaagactagattagaagtgtgcatgtgtgtatgtgagagattcacaagcatgcattagatatcattaaaactgaaaggcttacagtagaaattcagtaaaacaaaatgatttcctaagcccaaactgatgatctcatgattgcagattaaaaccaattcaactagagactctaagaagtcttttggaggttgatgtaatgggatttgatctagatacagaataaaatcttcaaggaaaaggacaaaagcttcattcaacattatccagcagctaaagaatgatattctttatgtgaatgtagagagaaaaaggaactttgaataggtaggtggacgtcaagaatgaataagctttgatagtttacttcatcacaatgaacagctattcagttcagctccgtaatgacattactagagacatctatctaataacacaaccctattagcagatctgtctaaattgatattgaaaggacaattaaaattggcactcaggctacaaccaatgttgtaagttggaatgtatcaaacatcatttttaaaaaaggtatattgttaacattgggacataaatgcaaattagagtaatgacttcattcagcaatttcctttatatgaggccattcgaatcagactctctccatagaaaagggcaaatccttagtaatttagatgattacctcataggagtgaatagtaagtgaaatcaataccataaggtctggcctgccatttccttcccgttacttcatgtcactatgacaatgatgagaacttttaaaagttttcttgcatgctggttcataagcattcactaatctcctccaacaatcttcttgtgctcggaaaagaaatccaatgtcatatttggaagttttattttaaaaaggtgagtgctgatacagaatattaatatgaactttttagtcatatctttatgtagaacactgggaatccattgccactaaggtagataattattcatttaagttttatgctaatcattctaattattgcttagaaaaataaaagtgccatatagcaaatccttataccattctcttacattcatgccataaacaaccaataacccaagtgtgactatgagtttcaggaaacaatctctatgctttgggctggaggtagtgtgctgaaattcatgaattacagctcttccgacaagagcccttagtggctccagggactggaaatggaatatgaaacttctgacccaaaggtcattggctccaatttggcttaaactggtagtgactacaagttattatcaacagacagctgttcagcaactgctacaaaatgaattggtgatttcagtgtaattcctaaaagacaggtatctgtgtcaggaacacatgaatccttcatgccctaaggtggatagttctagacaggagtcaagacattgactaaaaggagttatcctagcactttccagcctttataaaatgggtctttttagatgggagcagccaaaagttttttggcaactggcaagagtgtttgttacttaatagtttgtcatttgtaaggtggggatacaattatatctgactataatctctctgtatatctatgtttatgtttaaataaaatataacagatcttagtgggaaatgcttagagaagatgttaataaaataagactcttgctactcaaagtgtgatctgcagtccagtagcatcagcctcacctcgaaacatgttggaattgcaaactctgaagtatatgccagacattgaatcagaatcttcattttaacaagaccctcaggtgactcagtcactcaataaagtttgaggagtataatctgtcttgaacccgggaggtggaggttgcggtgagctgagatcacgccattgcactccagcctgggcaataagagtgaaactccatctcaaaaaaaataaaaataaaaataaaaacaaaaaacaacagcaacaaaaaacctgacttcaggtgatttgcctgctttggcctcccgaagggctgggattacaggcgtgagccaccgcacctggcctgtatcttaatttcgtaatctagtatccctggctgtttacattacttatgttgccacttataaaactgcctgcctattcattgtctcggcatccctattagactttaagctcctagagggcaggtatccaagctggcattccttttgagtccaatgtaggttttatcaatagaacaaaggaacttgaaattataagtcttcagcaccttatactaaattgagtcatgccaaataatctgataataacctgattcttttttttttttttttttttttgagacagtcttgctgtcatccaggctggagagcagtggctcgatctctgctcactgcaaactccacttctcaggttcaagcaattctcctgtctcagccttctgagtagctgcaattacaggcacgcaccaccatgcccggctaatttttgtatttttagcagagaaggggattcgccatgttggtcaggctggtctcaaactcctgacctcagtgatccactcacctcagcctcccaaagtgctgggattacaggtgtgagccaccgtgctcagccccaaataaactgatgcttatgcaacattaatttaaacagattgtgtttacctgagagacctgaagggctatcatgatgccctggatcattagccagcagtaaattgctaaccgctatttaatgacattgttggtagaatacatggtaagagtattttgtccactctgctaaacttgtaaccacaacataatgaaatactccggctaattttcaaaatgagtttgtgtagaacatattgatatttcatacattacattaaatttagtcaacatgagactgattaactggaatttatttaaaatttggattatgattttgtttgtatggtgtttataatccctacctttcaaaggaaaaaataaaatgcattaactttatggtactaacaaatcaatttgcctgaagttcagctgttcctagatcagaggcttccattctaaaactaagccaaaaacgttaaataatatattgaatattttccccaacacatattttatcaccctattcaaattatctaaaataaagatgttcatgtatttgggtacccaaggttttcataagaggctctctcaagtcagctatatgtgtcagtttgggcaagtttcctaagttctttgagtccatattttaataatttttggctttttaggagaaaatattaagaccaaatttataatgctatcttgaacatttaatgagataagcttgaacaagatttttggcagataggtactccctagttatttgtactgctactacttctagtacctctgctaccaccaccactatcattattgctaactggcattcctacttgcagcacaatatttgctataagatcgttaggtagcataccagatttaaacataattgaacatgtaagatccactcttacatggttcaccaggtaacatcaaaacataatactctaaattaaagaaaagcataagaaagatagacaagcctgcaggtctaattatcttttctattaattctaaaaattctaaattatagcttaatctaatcgtggcctttctttaagccttggaaaattaaacaattgactgtgttgattagtatattgccaacagctgtgtccccctgtgtcctctcccttagtagaaagaaatggtccttttatcacacccgttgtcaaagatcctcatctctctctctctctctctctctctacctagaagcagtataatttaggattaggagtataacctatggactcaaatagaggcttaaagctgttttgtgccacatagtagctatgtaagttgaagcatgttataacgtctataaaacagggataataacagtgcctaccacacagagttgttctgaagctgttaaatgggatgttgcttacttttgcatagcactcaactttgtgcattggacatggttaagcaactagtaaatactattattgccaagacttgaagtattaacaaagggcatagtctctgcccagggaccatgctcacttaattgtacagtaagttctcacttaatgttgtttatggcttcctagaaactgcaactttaagcaaaatgacatttaatgaaaccaattttactacaggctaatggatataaagaagagattaactcccatgacctatttctggtcataaaaacaacaccaaacttccagataaagaccccaaacacttctaatactaaatattgaaataaatgtgaactatacatacatttaggaaatattaattaaaataagtaagattatttacccaatttctggtgattcagtgagagacagcattcatagtggtggtggattaaggaaaaagtgtttacaagcaacaactgtaaaaaggacctcctatcaccatgcagttcataaacaataagaaatatggcaggttcgctgagtgctttcgcacctcatagtttattgcggtgtattggtatgattgttctagactttataaatggttatttgacaacaatttgtattcattcattcattcttcattcattcattcgttcattcaattttccaatctgtatattctatttcagggctgaggatggctggagcctatcccacaagctcagggtgtaaaggaggaaccaccttggacaggatgccattctatcacaaggcacgcgcgcacacacacactcactcagattacgacaatttaaacatgccaactcacataatgtgcacatctttgcaatgtgggaggaaactggagtatccagagaaaacccacacagacaaagggaaaatgtgcaaacctcacatggacagtggcttcagcctggaatacattttttctgacatcgatgttataataaaacaatattgagtgaactgatgttatccaatgacctgctatattcccaatagagggcacatttcaatggactgaccttaggaactggtgagtacagtttgccttaaccttttaagcttcttttcttctcacctctagaattggattctctcagaatgctgattaatacaatatctttaaattgccctagctcatggtaacctatcaacttcctaacccctttctcaagctcatcgattttgccttcagagttagaaagagccttgaccaactatctagtcaaaactcccatttgaggcattacagttatgcctgcattcccagtgttcactcagcatcagttttcaacatttctaacgttggaaagttcacaacataattaaacaacctattccatttctggatagctcttcattatgagaaacttattctttctttggagcagaaatcattgttctttgttacatgaagctaatgatactggtttgagcttttggaacagaataggataagtctaaaggctactccacaggacagacctccatgtattttaagattgctttcatgtcggccaggcacagtggctcatgcctgtaatcccagcactttggaggccaaggcaggaggatcacttgaggtcaggaattccacatcagcctggccaacatggtgaaaccccgtctctattaaaaatacaaaaattggccgggcgtggtggtgcatgcctgtaatcccagctacttgggaggctgaggcaggagaatcccttgaacctgggaggtggaggttgtagtgagctgagattgtatcactgaactccagcctgggtgacaagagtgaaactccgtctcaaaacaaaacaaaacaaaaacaaacaaaagattgctttcatgtcttaatgcttaaaatgtaatgttgaacacaactgaatacagttttagagaccttattttaccagaatagaaaacagtgggacaattattttttctttgatttagatgttaactattaataatccaaagtctatattgagttaggtaaaaagaattcacttatggttgaatttgcaagatgagattgctttaaaaagcatactgcctttcaaaatgtatgtgccctttttactattcatccatgggtttgttaaacctcaattcattcaaggaaaaagtttctcttcttattttctataaatagattgctaataagtttaaactacttttattagcagcatcatgtcttacaaaagtaggtttcctgtttgagaggctcagtttgacaagcactcttggtaaacaaaaaattgtggactttgagaataagaaaagttgatagatataagtgggcctggaactattagctaggtattatggataggagctggcctgctattcccagctaggctatggtgttctcctgtggaacatcaatagtttcacagaacgccaacttcagacaaggccattgtgtgaccatagtggatcaagacaaaagtaagactgccttcttttgcatatttcccaactactgcattcacctttgttcattcatctgcattctagataagaattataaaaacccaatcataaaatcacccgattcctcacagcatccatccaatctggagaagagtcctactgccttgagctctcttcaggatcacctactataaagccaaatcctaaatcttcctactgagatggctcatagtgctccatggagtgctctcttcctcatttctcaataacgagttaataaaatccatctttctttgactataggtgtgttcctggtgaccttggctgaagggcattgccatcttgttactgatgtgacacataaaaaagactacctggatttttatcaaatgcaaaacctactatatatttcctatgacctataaaacacaagtataatatgtcaatgtattaataggatgatgcaaatttggacattaaatcctttaataagggcctatttgtgtgtttgttaccatgaactgaaaatcattttctgatggaaatcttgcttttggcttacctagagtttcacccttaacttctactatgatctgagtatttgtccctcctatccttgatagtgttaggaggtgaggcctttgggaaatgattgggttttcagggtgaagcccacgtaagtaagattagtgcctttacaaaagaggcccaagtcagctcctttgtctcttccatcatgtgtggacacatagaaagcaccgtctacaaaccaaaaagcagacccttagcagataccctatctgcctcgatcttggactttccagcctccagaactttcagaagcaaatttctgttgtttataggccactcagtttacagtattttgttatagcagcctgaatggactaaggtaatatcctttagaacagaagttagatgatcttttgttcaggcacccattctttgggcacctcagtttttataagagaatcaatcctatctgccactcagctgataaaatatttaatgctccacttgactggcaaaagggcgccagtacatcaggtttgtgccagaaaggataagcttggacttaggatggctcaatacacttcagaagctcagccaagaaaaacaatatttgtaaaaattaggggaaagagacaatccatatattcctctagatactctaaaatctactcctggaataagccagacagatagaagactgttaatacctggaccttggaatactgacactccagataagagcttttacccaatggcacttctgcataactccactggacaaggttgaggacattttaaaataaaagttttgtgatccttgatactgttttttacattaatgtcatatcccctccatgcaaactcatgagagaatactgttagtgttgagcatcctctgaacagtttttttttttttaactcatgaacattgtgactcttatagctaatcatcctttcttaatgaccaatttccatagagacaagttaatggtttagttttaggaatatgtacactgcacattggaattatacagaacttcttctaagcatgcatttagtgtgtctctttgtatcttcttttaaaattgatttttttattatatggatccttgtaagccatcttaagtcatttcagactgaaataggggaataaattaataaataataattactgagaatagatttagtgagttgtagaagttcagataccagtcaaaatatgggatgctcacctatcttaactttataaatgaagttcatttgattccagattcactttctcactgtatcttaacaatgcttccttgtatagtacaatttttatcattgacttagccaaatcagtatatattaaatccaccttgcagtgttcattagcaagttgcattgttaattactttagtgggttgtttaaatggctgtggttaattgggaacactctcaaattttttctgggctaatgcatagcaagtttacactgtttttttgttttgctttgttttgatttttgcactcacattatagaaacttacaggccttgaacacttctgagtctcttccacaagatttattgtcaagccagatgtcttgcttttgcactatttcaagagatcttattgcttgcttacttaaaatgttcctctttacacttactttgcatctgaattatattcccagcatcagtaatttgaaagccacatacatgaataatatacccactgcatgtcaaccctgagagaagacagttctgaggagactgtcctaagggggaaacttctaggcaggccctaagagggtaacttctcatccagctgttgtgcttgaattatacgaaagtttaaaataaattccaacacgaagtataagtggcttttaccagtttgcattgttttgtttgtttgtttgttttcagagggtgtcttgctttgttacccaggctggagggcagcggtgcgaacctggctcactgcagccttgaattgctgggctcaagtgatcctcccatctcagcctcctgagtagttggaactacaggaatgcgccaccacgcccagctaatttttgtattttttgtaaagacaaagttttgccatgttgcccagatgggtctcaaactcttgagctcaagcaacttgcctgctttggccttccaaagtgctgggattataggcataagccactgcatccagctccagtttgcattgttaatgaaataaaaggtcaatatactttcagcaatcttattgggcaattcgacttgaagaaaaacaaacataaggtatttttaaataaccatagacttttaggtagacatttgttttccttttttttttttttttttttttttgagacagagtttaactcttcttgcccaggctggagtacaatggcgcgatctcagctcaccgcaacctccacctcctgggttcaagcagttctcctgactcagccttccaagtagctgggattacaggcatgcatcaccacgcctacctaattttgtatttttggtagagatggggtttcaccatgttggtcaggctggtcttgaactcctgacctcaggtgatctgcccgcctcggcctcccaaagtgctgggattacaggcgtaagccactgcgcccgactattttccttttaactcagaaatacattacatgaaaacgtgtagccggcatgatagtaaaaacagccttattaaacatttgtaaaggtaaaaatgagaaactatacaaagaactgtatagtggtgtggtggacaaaaatggtgtctgtagatgccgtactgtaaattgcttattttaaaaactgcaggcctgtgattcgtcccagctacaatggacggacatagattacttgtgttgtagcactacagaaggtcagggttgatccagctagggtgccctgagccaaagagaaacatgaagccagtttctaaggggtgaagcaaggttcaaattctgggcattgcaaatacaaacaacaaatccaaagggctagaaacaagttcgaaggcagagtacggggccaaaggtctaaaactgagtaaggtggtagaacgagaacaaattgcccccccaaggtcagtgagctccaggcaattgctatggatatgaatgagagtttgtggcttttaagagttgtggctagcatggagtggaggaagatgagatcgtcttaaaaactgtaagaggcagagaaggaaaattcagaagttgcctgtaaaatcaactttaaattaaaaaaaaaaaaaacaaacaccaaagtgtattccagagcccagatttgtcctttcataaaagggtaacggcctaggttttacaaggtagcaaaatgctgtacattcccatctgttcgcagtcttacaattgtaatatactttgactacataagcattttcgtagctttattttaatgatcacaacccagttaatcatttaaaagttttccgtattactctccacgctgcccaaatttttctcatcaatgaaataaatatgtttatggcaaactgtaaaatgttgcaggtcaccttggaaatgcaactgagttctaacaagaaaatagtaaggtaaatgtaactgtccttcagataaatacgtgatttgaaaacctctgtcattaaagtgttactggtgaaggaagacttgcacttatacaaacaaaataaaacctgctttcttcaaacttcatccccaagcctgacaactcagactaaatgatcccaagttagttagatgattatctcattagagctactgagtatgaagccccaacaatgttctagacactgtcctgggtgctagatacatccattaatatgctcaacagttctgtgacacaagcgtttgtgcagacaagtaaaccagagctcagagaaatcatattgccccaaatcacacagttaccaagtggcagggataggatttggattttggaataaatctggagttttaattgtgtctgctatgacacattgcttcctatgatatgtatttgtcctactccaggaaaatggaagggagtagggcccggggtagtggaggggagtcccaaaagaaggagagatgtggggtgaaggcccaacctgagtctgacctgaagtgggatttgtattaggttatgtctgctccataaaatctgttggttatatgtattttcccccatttctagttctaaaaatgtgttcccctttattaaaaaacaatgatgaaacaataacatatccttggaggaaaatgcattctgagatgctctccaggaagtgaaggtagattggtattgattcactgacccaaagttggtctcataggtgcttccatttttgttaaaatagggaaaaattggagaaaccacactgtcatgattacacacagcaaagctgtctgtgaagtgagggttaacagtcaccaaggcttgtgtaagcgcttgtgaaagtgctccatggggctgcaagcaccatcatgatcttggtcacacttctgagctaatcaagtttgagtctcatatttgtgaaccttacataaatctgaaagtccatgtggatctcctcattctgtcagtcacacctcagaagataattttctttatatgcagaattttaaaagaacacaaagctctatgcaatagtgctgatgggattcaggacacattaccccaaaatatagcaccgtggcatttgacaacagcagagacaggaaggtcactcttaccttcttctcgcccatctccccggaaggcggccataaatcccaggaagaattttctaaccttcccctgaagcaggtcataggaccctcattcaagaggtaccctccctacatccagaggaaaagaacatccttatctctgaagacacagggtcacagagaggaacttgaacagacaggctttgctaagttctgccaagttattatcattaaatcataccccctttgtccaattacatttttccacgactctcccatttccatcaaacttagcataaaaatacatagtttggccgggcatggtggctcatgtgggtaatcccagcactttgggaagctgcggtgtgaggggtgtgagaatggcttgagcccaggagttagagaccagcctgggcaagatggtgaaacctcatgtctacaaattaaaacaaaaaaattaaaatcagccaggtaaggcagcgcagcctcagaaggctgaggtgagagggttacttgagtccaggaggttgaggctgcagtgaactatgatcactgcactccagtctaggtgacagagtgaggcactgtcagaaataaataaataaataaataaataaataaataaataaatgaatgatagaggacggttggatggatggatagatagatagatagatagacagatagatagatagatagatagataggtttaactacttcttgggactttgtttccttatgaaggcttccatgtcacataaaactcaaccagggaccctaagagggtggaggaatatctttcattccttttagtacaaacaggcccaagtacatatcaaatttagtttcatatgtagatgataaaatatcagaaatttcatatgagatatatggacacatataaaaaaactattctggctgcaaaagtttgtgggcataaagctgcaataagaaaagtgataatataatgaattattatgaaataaagatattacaaaattaaactagccccaattaagcacaactatggcaatgataatgaagttatttctgaaggcttattgtctgcacttgggaactgagtttatattacctatttatgttgctacctgctgataaaaccacaacacatcattatttatagggtgctaaaggaaaaaagcttaccattaccacatttgagaaagtcaataaacatttttcatggatggattttagtcaatgactacacttagattgagcattttaaagtactcagcccaaagatgtgtttatctaaacactcatttctaactgcatgtttctattgcatttatatattttacaacctccactcttaccactaaccactactgggtggactgaagtctcaaatactaaaagcacataataatgcaaaatgttttgagaagagtattgcaataaaaatcagtaaagctattaccatgtttaaaaaagaaaatctagtaactattaaaggccttaaattcaatatatgttagcatatctggaaagctcttcaatcataatgccctatatttgcttaccagtttatatttttccaaaaagtatatatatatatgatagcttatattatgcctcacaggaagccagagtaagaggcacagaagataataatcttgtcacatgaaacatggataaatcgaatctcagtgagattgaatgacttacaggggtcaacttatggttaggggcaaaacagggtgggacataaatgtcactcttctgatacctttgcccagggccatgtgcactttgctgacaaacttgtcccaatagtcaccaaacatactggtttgggaagtgtgtgaagtctcctgttggcaccaacatgggctgatttcacaggcttcaggactggattcatccgtttacttatgggaactgcatatcttcatatcctgaagttgtgatgacaactctaaaatgtttgcaatggaagcttaaaagaaccttgtaggaagatgcagactaaaatgggagcacttgagggaatgaggagagtatgtgaagcaataccctctctatctataggtgagaagagccctggggatgaagttgtctagaaccaatgctaagaacaagcaaccgttttgctcactattgtctaagtatcttcacatattcccatttccatgcccttctcaagctttccccttacagaaacacactcccttctctttcctgtgtgaaagccacacttcctcttttggaatcctccacttaaagaattgtgggtttgccgccgggcatggtggctcacgcctgtaatcccagcactttgggaggctgaggcgggcagatcatgaggtcaggagatcaagaccatcctggctaacatggtgaaaccccgtctctactaaaaataaaaaaaaaaattagctgggcatggtggcaggtgcctgtagtcccagctactcaggaggctgaggcagaagaatggtgttaatcgggcagatggagcttgcagtgagctgagatagtgccactatactccagcctgggtggcagagtctcaaaaaaaaaaaaaaaaaaaagaaaaagaaaaaaaaagaatttcacaggtgaggaaactgaggctagaagattttaatttgcccaagtacacacaaaataagattttggtttcctaactcagtgatgtgagttttaccctctgtactgaattgccaatttctgcattcatctttccttttacaattagttatatttccatatgtactgtatatatcttgccagaacaacaaaattggaagccccccaaaggagccagttagcattgttgtattctccttccaagacctggtaccatttcctgctcatgacctggtgagctgaaatgctaacaaaaggctgcctttcttccagagcaattttagagagaaggaattttttggctattcccttccccatcttacttagaagtattccctagtctttgggtatctggccctctagccaagtgatggtactatgaaacacatatggaggctcccagggcttctccactcttctagcaagctcctgacccactactatgaaacaggatgctgacttacaaaaactagagcgaaaactagaggaatgtcactacccagaaatactttctagaaggtcagtgacaaccccatagatatggaacaaaagttttcttgttacagccctccaaggaacaagcagtaataaaggtttttctttttctcctcttaaaaattaataatccatttcagagcggatttcagtgtaatcagaggtacagtttttgcttattgattatttaaaatacaattgaacatgtacatgtaagaaaaggatttcaaacttagagcacaaatgtcatctctataaagtcatcctggctactctaggtggcctctctctactgatcctctttagtactttattggaactcttttttttttttaaaaaatagttgattgtgtatgtgactaaattctcctacttaaatataaatattttgagtgttctattctcatttgattttctcctctaagatcatggtgtgtgataaatccttaatatatatcaattgaatacaaataaaataatcagagttggcaattatctgatgttatgaagttgctatgaaataaacaaagtttctcacttttaatatatttatgtattcccatttaaggtgaaacagagaacaaagaaagagacaaacgttaatttaaaaagaaacgtgggtcttctgctagcaaagtgtgctaaatcagtgtgtgagatctcagctgattcactgtggttcaaattcacagtagcaagaaaggaaagtaagagtttttattttgatcttaagtattcctttagtattattcatgatgacaatctctttcctaaaaaagtaataatttctaaatttccaaaaaagaagaatgaaacttaagattcacttttgaagctatttctaaaataaggtgcttttagaaacatgaggcagtgaaaatggttacttttgactctgcaaggtgttagtaacattgaaactaacctaaagccctagcccaggaggccaaaatgtaggttctgtgataatttacaaccctccatccttcagtttcttcactgcctttttgggtccttataatcacctaagaggtcatatgataaaatgacattctcacaagtgtgacagtaattgtaatagtcccagctgtgacttggtctcaataactattcagttggcccacgtgagggtgatcatacagtgcttttgcagctattctaacaatggatcctttgagacaccgtttttttttttttttttttcttgcaaagccttgtagtcaacacaccaggatgactttaaagtgccatttatttaataatcgaggtcatgtgcagggtgctattttacagtcacttaaatatacatgagactaattttaaatttcaggaacccaatttcatttttgcatcttaacaaaatgtacagtgttctctggtaatagaggaaaggcttctatgtgtccctaagttattacccagaatatatgcatgattacaatcattacgactctacttttaggagcttgcaatctgaatttccaaaaaaaaaaaaaaaaaaaaaaaaaaaaaaagccaaaaagaaaagaaaagaaaagaaaagaaaaacaatagtggggctcaagagaaagaaattcctttcaggtttttttttttttttccagttgtaaagatttataggtgtattttggactttcttctcactaccccttggttgacttgtgtattaaagagtttgctatctattttgaaactactgtattaacaaattcctcacactttgggaagaaataagaaaaatgaaaagggtcaataataggtacataactcagaaaagattagtttgttataagcaatggtattttctgtggagctcatttaaagcagttagtgattttgtaaatttgatattaatgagtataaagaattatcaaagggcatgtactatttggtcttatattaaatatttcccatgccgatgctcgtgagtattaagcttaaaattgtcctgctgaaagggaacccacagagtagaaaaaatacccgagaatcagagtgctggcttaaagtcctatattctcctctacactgagcttttgttgtgattcattttttctgtgcctccatttcttcatctacaaaatatatgtgactttatactcatagtcacatccctgccttgagaagtgtttaatttttgataaaactgatatggataattcattcaagttttatatacatacaaacatgtatgtgtgtgtgtacacatatatttgccacccactgtcacacctgggcaacttcaatattggaaaacagtcctacaaggaagaaaatgagaaaagaataagaaaaaatagggactaaagtagagaaagaataaataaaggtatctacatggggacttacagacaaaaggaaatattcaccaaaggcatgcagcttgaaggatgacaaaagaaaaaaatattacatgttccatgcccacacaaagcagggacaaacaagggaattatgagtgtgagaaggttgaagttgagaaaaaatttactgagaggaagaaaggaaaatgaagatccacattaataattgaacttgagacagagatattaaaatcagcaaacagatttagatggggttaggactatacattcattttcaacatggtgagtttgaagtgacagcagaatattcatgcacagatgtccaactgacatttggacagttgggactgaagttcaaaagagaggtgagagttacagattggttttgaggagtattctggaggtgataattgaagccatgaaagtggatagagtttccaagggagaatgaataaaatagcatggaaaaatgtcagatctgatgtggcaaaacgtaatcattggaacacttaaattatcatcttctaagataatttatgatgtaaacgttaatctaaatactttaaaatttttttaaaattatgtttaaaaacatgcaaaaaattattttgtagtttcaaaagacaggtgttacagaaattgaacctttatttttatgagagcatcaacaataatatacaactagaaattatttgtgggcttcagcggtaggcagagctgggtttgaatttctgttcttccctttgatagccttttgtctgctttctgatagcatgctcttaaccattacacaatcatcctgctcttataaagctggattatctgctgagagcatcaggaattgacatctaggataatgagagaaggctgatcatggacaacatatagcctttctagtagatgcagctgaggcatagctcaggatttataaagattttaggttgcatcaacctggaactttctcaggcattatacactcaggtgtcctagagaaaggtagaggtggtaatttgtagttggtgatcttgggtaggtgttgcagaaaaatagaggagcaatgttggaacagggattcacagaggtgtagcaaaaacttagaaagcagtgatacgcataaaatctttggagtaaatgaacacacacgtgtcaggattaatagaaggaaaagagacaagaagcagacaaactaggaagatactgagatcaagagctggaggtctctgtgaaatgggaaagaagggatggtaggtaggtgtgggctcacgagacagatgaattagtgtttgttctagcaagtacaagattctgggcaggtgagtaggtagttgaaatagaatggccaatggagttaaatagcttagtaactgtgagactagattatttgtcaggtcacttatatgcatgttgaaatataggttagcatgaaagaagactacaatttagcctccaaagttttcagtcacaaagagagtgatcagaaggcaggtgacagcgagagatagatgacagtgaaaacaagtatcatattaagttggtgcaaaagtaattgtggtttttgcaattaaaagtaatggcaaaaatagaattaggaaagaagactttagaccaaggtggaagactaatgcctagaagaagtggggaggtctcctgatctgacatcagggttgtggggtttgagagaacgagctgcctctttttggaatgaatgaatgaagcagcagcaccctcaggggttgggcagatttcaaccaacgcaggaagcaaagaggtcattgtctgaattattaactaagaaacatgtatctgggggatggcaggaaaggttgcaggggataggctaaagtaagaatgaagtagccttagaaaagtaagggcacgaaggtataagtgagttaggagggagaaagctatggatggtgtaggatttggggcagctgatagaaaaccacaaggaggagaggcctgctgtctcaaataccatagcatgctcacatgcttcaggacacacctgctcccctctctgggaagtagtaatgaccatgatgaagtttgtgaaagattcacaaacgctctattagggtacatgcttccatggagttcacagaagggaaggaagagacccagttgggatgtggcagtgatgtacataaagatgttccatgttactgagaattacatgtacacattctacatttttcctacttaaaaaaatcatcactatgagagcattaaaaggagtgtttaaagtgagtgttatttgtattaacttttcttgttttattaatttgtgttccttcttcattcactccctattcctgatgttatgtgtctttctgtagcagactcaatgtggcacagatgtcctatacactgtagtagaaaggaaatggtttccttagcaacaataaccacacaaaagccagcagaattttctttgctgctcatgtgccattttcacagtttaaagaatccaaacagtaggaaagaataataaacatctgattggaacatattgcaatggagacatatagaatgaatgcaaaaaggcatctgctatttataaacagttgatggtgattttaagtgacccaaacttaatcatcatgattcattctttttctcagtgaaacaggtaaaaaatcatactatatctagttgagtggagtgaaatatactccttcaagatactttcactgtcactgaaatctgataattgtaaatacgtttttgagccactacaagataatgtcctgggcaataattggatgtgtgctaggcagagaaagatttgttttgttgttcaaagagagcctccatgaatttactgttcctaactgcatctccctagaagggattcttgggatttatgtctcttctagtcttctgctactgaatttttgctttgcaccttcccattttagcagttctaaagtgaagcttgaaggccccataattatgtatgaaaatacattcactttcccctccatctctttgtctctttgtgagtttcttttttgttgttttttttttttaatgagtggtcatttgattgtaatttcttgccagaaagttcgcctgctgacaacatggtagtaatggtaataagagcctggtaaagaaaaacagaatttgcaaatatgtgcaattattataaattggtaggaatgtttttaaagtctctattaaagtcctaatgtcctgctgagccatccttgcaagatgacagggcacaactgaaaaggttttataatttgaaagaggaaaaattcaaagatgattgctaaaaatgcaagacaattactagcttggggaaattttatttgggctactgaaaggactgcttcgcagagaccatgggggctgcattcaatgctcaaaggtcacctggggcagcatgcaccttcccgtgcctggctacagtgatgattagtggtctcctcaagcacttggccattagctttatgatgcaaagccacattgattctaggattacgagtttttggaaaccaggagtgtgaaaaacgacagacgagagccactcaagagattcaggaaatgagccagagctgaggtcctaaacagaaattaactcagtgccatatgaccccagtcatccacagccatgttttaaatcccctggcagatgacttttctaagaggcaatcctaagagctatgataaattctgttggtagaagtagttggtgctgcttcaaagacaaaatgcccatgtgcttttccatatcacaccttacaaataaaaatacccaatgcctatgtcaagtccaatctccacaggttcagagttactggaaagagagtatccaatgaacaagattatagtcaaaatattacgcactaacgttatcaaaatcaatccatagtatcttatcacaaatatagtgtttgagactgcaaacaagtctaggaagtctgtaagactcttaaattctatttaatttgaggcctaaattaaattggattagatcaaagtcatatttgaataggtattttttttaagttgctaacacatattacacagaacatgattaatttctatgataaaagggaaactgtaaattttcaaattttgtaggtatgggagacacatcaactctaaaagatcacaaccaaatatgctgtaccacgccaaggttaattgagcaggtaaggataactgtggaagaatcccgcacaactgcctcataatctgactgggtgctcttctggggagtgaggctaggctcatggataccagctttaatgttattctgctcagcgttttagtattataggcattaatctgatttaatctgtcaccttggatcaaccctgagcgtcaacacttcacaattaatatattaaaatataagaaaaacattctgctttagattaatttcataaccactaaatacttgtacatttttgtggtgatgccaggaatctgaagtctgctcaatgatccacttatttatcaacttcaatgctgacaaagtttcaggttagcaaagaaagttagataatttttgaagttatttgcaagtaaatttattactttttgattataataaggtttttaacgtaaggagttaggagccatagtctttattgtcaccaaaagccttaactgtcgtctcttatataactgtgattagaaaatgacctcaaaatatgttaccctctgtctatacaaccttaaatattcagttaaagcatatgggtttggcgatcatttagctctgaattccaagtataacattaatgttcagtccagggcaagttacttcatctcatctctttgacattcttttttttttttttttttttttttttttgagacggagtcttgctctgtggcccaggctggagtgcagtggcaggatctctgctcactgcaagctccgcctcccgggttcaggccattctcctgcctgagcctcccgagctgctgggactacaggcacccgccaccacgcccagctaattttttgtgtttttagtagagacggggtttcatcgtgttagccaggatggtcttgatctcctgaccttgtgatccgtctgcctcagccttccaaagtgctgggattacaggtgtgagcaccgcgcccggcctccttgaccttcttttcttcaacaataaaatggttatggtaatacttaacttgtagaattgatataatggttaaattttaaaaattagcaccaggcacggtggcttgcacctgtaatcccagctactcaggaagctgaggcaggaggatcacttgaggccaggagtccaagaccagcctgggcaaaatagcgagaccctgtgtcaaaaaaaatttttttaaaaattagtggggcatggtggcatgctcctgtagtcctagctacttgggaggctgaagtaggaggatcgtttgagcccaagatttcgatgttacagtgagccatgattacactattgcactcatggtctcagtgacagagtgagaccccatctctaaaacgctaaaaaaaaaaaaaagataagaattaatatatgtaagatgttcaaaaatgtctggcctatactgagcacttaataactgttcatctaggttattttcaaatacttttaaaaaaatcacaccattaaaacacgtaagattaaataaaacatttgcttttcgttttcttgtcatagacaacacagccttactattggccttacttcagaaatttcccaaattttctccatttttcagctcatggcacgactaatatactttattctagtcctgcaagactcttactgacaaagaagcatcatttagtactttccaattttgaattaagaaaaatggaaaatgacacatttatttcttcatgcagtcaaatagcatttaggaagcagctgagtacctgaaaatggcaataattttggcatcccgggctgccacacattagttctggggtgcgggtagatcattaaacctccctgcctcggtttagtcatctgtaaaatgaggataatgcttgggctgggtgctgcagagaacagtgtgtaaagataactattccaggaagcaatcatcaggctgaaaatgagctgacatttgggttggtgctttcaaggagcaggggaattgagaaagtcagaggtgtgagatggccccgttgatgacatctcttggaagtcgttcctttatcttatgcctcacagaaccatgtgagcaaaggcatggagttgggaaagctgagagcgtgctcaggaaatgggaagagggaaagaccaattttcctgaacattcaatgtgaaatagagagtggagtaagagaaggctggaacagatcctgaacggtggaaggatgctgagggccttgaaaatctgagaattctattttttaaagtgtgagaaaggcatggaggtgagaatggcggttggaacaggaagaagaaaaatgcttgaaaaatatgccaacaagattgatctgaccctaataaaggactgaatttcactggtgagagagtgctaacaaagcaatctatccaggatgatgaaagacagggctatcaacagacacagtttaaaaaaaaaaaaaaaaacagaggaaaaccaaggttcaaatggatttgtcctccaggtacatactcagaggtcaggagaaaggagatgcttacattagcaagctatgtgtagtaaaatctatcaatatataataccatgaatactttcattgtcctaacactttattgagaggttccatcagataacttactcttttcaatccttatcttttcttctataatttcagtaccatagctgattttaaaatagtagctttcctcattgataataatatataaaactattatttatagcatcaaggcctaaaaaaattcatgtaatcagcctgagaattgaaaaactatagcctaatgcctaaatcacaggctgagattttattctgcttctgtcatagatttcctattttagatatggaaagtaatcaactctgagctcatgtctcctttttacaatatgaggttttaaagtttgacttactagcaaacatgcagtttacaatattaaaatgaaactgatataaaatttgagaaaacacatagtttacaaaaacaaagaaactttgtccccgttattgtccccattattctaatatactaaataattaactcttttgaaaaagtaaattcatagttgataggaaaccttgacattcaagtttttaattgctgtacttttcttctatttctcctcttatttaccatttcagaagagaggaactacaaaccaggctcttgaaaaatcagaattcaaatggaattgctctattccaagtaataactgaatctgacacacaaaaaaagatgcagccataccttccaaataccttgaaatcctcaataacaaaagagagcctacacactacacacacacacacacacacacacacaaccgcaatgcatgacaaatgagtgactttttttctctcacacagacagaaatatttctggcttaattggtagcttttgtatcaactacccagtaggatacatagatgtagaggaaaagaaatcagagaaaaccaatcctttaattagcttgcacctatatgtacaagaataaacattttgtagatgttcctgacctccagcttccttctctctctcccctactcaataacatcactcctgcagtggctgctctttcccctgcatcgccagttttcctctctttactggatcatttcaatcacatatacatacgctagaatatctccaatcattaaaacaaaacacaacaaaaacctattttcaccccccatctcccaacaaatacccaattctctgcttcctctatggtaaaactccctatgggaagtccacactcagctttctctaattcttttctttagatcattttcaaaactcactccaatcaggcatttgtccacaccattacatttctcttgtcctatttaccaagacatccacattgcaaatccaggggtcctttctcagtcttcgtcttagctgagctgtgaacagcatttgaaacagctggtaagtttcttaaaacactttcttcagttaatttctacaaacgcacacactccttgtcttcttacttcacttgttaatcctttttggtttctttttctggcttcttctcttctctccaaactctaaatgtttaagttctaaatgtttaaatctgaggattggtctttagactacttcacttctctatctatactcatttcctatatgaagtcattcagtcttatggatttaaataccatctagaatctaacagctttcaaatttatgtccctagctccaagctctgcactggactccagattcatgtatccagctgcagatccacacctgaatgtggacgtctcacagtcatctcaagctttgcatgctccacccagaacatttgattttgcatttcgcctcctaacctgcccatcctacagtgttctcctccctaaatagtaactttattccatgagttgatcaagccccaaatcttggagtcatctttcatgtattttcttttgcttacacctcttatccggttttattagtaattctgtcattgtatttttaaaacataacctatgaccacttctcagtggttccacaaccagcttctgaacaagttaccacacgactgcttcctcgccagtctctctgcttccactatcgtccccactccctagtccagtctccacacagaagcaagagtgaggctttaaaatgttgtacatataaatgcatacaatctgtgtttgtaaattatgccttaataaagctgaaaaaaaaacatgtaagtcagatcagttacgtgcatgctcaaaactctccaaagtgttccagagcccaagtccttgctgggttctgagtctctcttttatttcctgctccaggcagcctgacttccttgctattccttgaccgttctgcacatgctcttccctcaggccctttcacttgctgtttgccctaaattcattttgcccccgacacctgcttggtcactccttcactttcttcaggattctgctcagatatcttgttatcagagaggtcttccctgaccatgcaccgtgaccacagtaggtgacccctgccacatatgtgcatgccaacacacacacacacacacacacgtcactattcctttgctttattttcttaagagcccttatcgccacctgacatttgttttttgttcatttattcatttatttatatagtgtttcatttcttacatccataaaatacaagctttatgagatcaataactttttctgttctgttaaaacatattctgagggcatagtacatggttaaggaataaatgaatgaataatacttgaatggatcacatgttcccatatttcacttgaatttgctacatgcatgtgcaaggacacacagacacgctaaacaccccacactaatggcaagccatctctagcttcaaaatgcacgttatatatctaggcatatggaaactcagactttcttttggtagatttgttttaatttaagtcctgcccaatatcacttgcgtttaagaaaacaattttctggcaaaaaggaaagaaaaaaaagtaaaacattaaatcattccaacagtaatatttaaaaaaaataaaatttaaaactttttacttattcaaacgattatttttgtgcatgcaaaaaattacacaattattaagcatacaatttgacacattttcacaaaggaaacacccacatgaaaacatagaattttattaaaatctcagaagtctcctcctgatctagtcattatggcctacccaaggtaaccactatgttgattcctgccaccactgatcactttcatcatttaaaatcttaaactttaataaacggtattatccagtacgtaatctttttgcctgaatgtttttgctcagcaatttgtttttgatatgattctttgtttttgtggatagtaatgttttcattgttctcattgctacagagtattctattgcttagatatttcactgtttttaattcttttgtcaatggatatttggcttattttcacttcataactattaagacagagttgctatacccactcttgtacacgtcctttggtgaacagatatgtacatattccaacagggtagagtggaatagccagctcacagggtagacatatgttcagctttaggagatattgccaaacaagtcttcaacgtgtttctacagtttatcttttggtaattaattcttgtccaatttgctaaaatctggactctgctacctctaagtagatcttgtaaatatgattgaaacattaaaaactgcttattgattttatatttaaaatcatctagacagaccagggttcctaaagtagcgtggggaacattaattcttaagataataaatggaatgaaggaagtggggaagagaagagagaaagtaagtttcatggccaaataaaatggggaagcaggacgaatcaagtaaaagaacagcctttaatgcaagttctcagatctgctaatatctgctgtgcattgacagtgacagggggtgggactacagcatgcagttctgtgataggaacatgataaaaaccttttttttcctcacagagtatcttgtagggctatggttccacaaaatttactttgagaaatgctgggcaagaaaatttgctcagtgattaccaggaatatccgtaatccttaaaaattgctccaactgaagcattagcagcatgtaaaatgcaataaagtgctttgttccagattatatatttctgtgcttctttgttttgatttcatccacctttgagttcatttttccattgttctgtgccctaaatacattaacaaattcaatgtctgtgatggttcttagttcttgacattgcaagtctagctgtaacaattcaatattgatctcttctttttaagtgagtattctgaggctggagcaaaattaggttacttaagattgcacatattttagcttgagtaaataaaattgctcaagtttttatcatatattcatctataggctggctttacaatcagtgttatctcctcgaagtgaaatgctctctgtcatgttgatttagtttaaataaacttgtttccctggtgtgtattggaattatcatcaccttcattctccaacatgcaaattataaagaagcctcttaagtttcctgtagaatagcattacatttgagaaagagagaataatctaatcaaatgtgaactcctggatctcattcttatcattaagaaaagaatgactagggaatggggcctctttggctcctgttctcagttaacttgaattcaatgtaataccctttggaatgaatattggatttcaataaagaacatttggggaatatgaaactcagaaagcaatgacagcatccaaatttatgacggctcaaagatgcttgaaatagcaatttatgccagatcaaataccatttcaatgggttgtaggctactggggaaaagtgtttatagaacatcttatatctgcaaagtactttcagtcatttttaatagtcatgttggatggatggttataatttcaggtgacaaggacaactcagtgagacaactgacattcaacagattttatggaaaattaaattatcttgaaatgttaggtttgatcatggaaataacagcaataataaagagaaagaaaaataggaggaagaaaaagaaaaagtggaagaaaaatgagtatgagaaagcaatgataattgttgatattaaaattacaatttgtgctttgtctaatgagttagtttctagcctcaaacatctggtatcaaaagcaagacctggaaatttttctaagaatagaatatttttcatagtaacttaaaattttcattttgtagacatgggctctttccagatatttctaacattcaatttctgatatggcaaagtcctggcacgcaggacttaccactatttgtctacttgttttcaaaacatttggaagtgtatatagattgcaaatttaaaagatgaaagcattataacaaatggtttctaatacaacaaattaaaaaaagaattctaaaactaaataagaggcaatagcaaatcatcgatggggaaaataaatgtctttattttgctgcttgtggtcatttcgtggttcagcaaagactttcagtggcgttcatgtttcttttactaagctcctcagagattatgactgttttaatgctatttaattgattatcgaggaaatcagggtttgtgatatcctttaagtcatgccaatcccaaagaatattcaaataaatattgaaatgcaaatttaacactctcatcaagtaagtctaactttcatccttggtcaagtaggtaaggcatatcagacagaggcaaaagttcatagatgtggggctatgctgttaaattggcggccctcagggaaccatgcctcccagtattcatataattgttcagaactttccctccctgactctgttgaaagtagtatattcacatattttagacaaattgtcctacaaggtataaaaaggtaacagaattcccttacctaccccccagattcctatccctggatgcaatcattatctactctgattttttgttttggctatttacttttatatttatttatttatttatttttgagacagagtttcgctcttgttgcccaggctggagtgccatggtgcgatcttggctcaccgcaacctccgcctcccaggttcaagcaattctcctgccttagccacccaagtagctgggattacaggcatgtgccaccatgcccagctaattttgtatttttaatagatacaaggtttccccatgttggtcaggctggtctcaaactctcgacctcaggtgatccgcctcactcggcctcacgattacaggcatgagccaccatgcctggccaattcttgtgattttaaagtttctgtattagtcattgttcactagaggaacagaactaataggatatatatatgcatatgtatgtatatatatatatatatatatatatatatatatatatatatacacacacacacacacacggagagatatacatatggagagagatatatatatacacacatacacatatatatataggctatatatatacacacacacgtaccctggaacttttatatatatatatataaatatatatataaatatatataaatataaatatatatatataaatatatataaatataaatatatataaatatatatatttatataaatatatatatttatatatataaatatataaatatatatataaatatatatatatagagagagagaatcctggaaatatatatatatatatatatatatatatatatatatataggctgccactgacacctcaagcaccatttgatctgctgggtcatatggcccaagtggcagagcagcagcctggacctgttgcagagccttctcctcctctgggccccattcaaaaatagcagcctttcgggtcgcttgataaatgggccggagtaacacaatttctttgaagcccttcatttattcccaattatttgtttcctttggatttaccttttaggttttgtctttcgggtttgagacttcatccagtatttggtaatccttattatgcttttacatttaaaattggattagaaaaaaaaaatttgattgtatgatctgtgcgagtgggtggggctcatccactgatgggtttcactgcacattgaatggtgagttgggtttttattggagggttcccattgccaagtacccggagctatttgccttctccatagaagaatcctccagtttctttcatgaagggtttcagtctggctagaggcatcctgagatctgagctgagtacagacttttccttaattctcctattttcagcctgacatcaagccctgcccctgggtatgcccatggctatgtatacaggtggccttagtttctccattgatatttctccaatttctccaaagaataatcatctaacatttggctagattgagtaagaaaaagggtagttggttggatatatatggtggacatggagagctggtgccaactgatctatcaaccatgttccctttttgagctccaggttttaccccaccttcagcaagccccagtgcctccagtttccgtgactttccaagatcctgtgaaaaggtgacagggtggagggcggtgacattgctaactggcatttcttaccacaggctttcacatttcattacaatttctgttgctcccatcagtcagatgtattcctccatcccctttcctgattctgaaaatgtgttggcctctccagtcttctgattccttgcccatttctttttctgcatggatttatatattttaccatgtatactgtcattttagtgatgtttcaggaataagcagaaattaaacacatgtgttcactatgtcaaattaactccaagacttctataattttagatacaattgccactgataaggatggcattgtaactcattaagaacgacttaatgtaatgcttgacttgtttaacatatagttagatcttgatgctggataagtattagagtacataatcaagcaattggcaaccactatagttttctaaagtagaaagcgttctagtccaatttgaattcttctaaaatagaattatagtcctcaccacaagtggaaagtgataaatgtcatttacaatgtactgttatgagacacgttgattacaggaaggtttgaaattcaatttcaaatgttaggcattggcaaggtgatgacggtgaataactgttttgtatgcagtgaatagttatcatccaaaaaatcagcttttgtaaatgtattaagtgttatctttagaaaatattcaagaccatgcttaaattccactttctctaccatgtcatctccctaacttcttagccagaaaccatctcatcctcatcctgtaaacatttgctgtctacacccgcagtttctaatgtttttaatttcactgagtgagaactgattgcccactgggtccctctcttccaactgaagtaacaacacagggttgccacatttcttggccctctaaggatattaaacaaacaaacactttaaaaaaaaatctcacaaaataattattaactatcactatcattccatttaaaaggagctactagctacagaactagcaaccaaaaaataataaagtattggattatagccaaagtataaaatattaggtttgaaagtaacggcaaaaactatgattactttttgcaccaacctaatgattgattgaatgaataaatgaggtagaatagaaaaatctcccgtatagaagaattctatttaatgtatatagatgctgttatataatgtatatagatatcaaggaggagaagcataaatccccactacttaagtgtgggctgcacatagtgacttttttccaaggactacataaatgaaagggggtagagtgtgggggaaatcaccttacagtaaagaaaccccacaagcatcactcagttacatgatgaagcttaatatcgatagtgataagtcacattgatcacacatccctttaataaaatgatgagaatggcactttatctctatgatctttttctcccaaacccataacccagactaaccatgagaaaaacatcagacaaactcaaactgatagtcattctacaaaatacttgacaaatactcctcaaaattgtgagtcaccaaaaataaggaaaatctgagaaattgtcacaatctaagggacataataattatatgtaatgtggtatcctgggtgaaattctgcaacagaaaaagaatattaggtaaaaacaaaagaaatgtatggacttcagttaataataatatatcaacataggtttattagttacgacaaacataccacactaatgcaagataacagagaaaattggatgaaagttaaacataaactctctgtactatttttgtacataaatataatctattctaaataaaatataaatctattctaaaataaaaagttttcatgaaaactaccacaacagtagaatgaaaacacttctgtaaattcagggctttatttctgaaaaacaacaaaaacaacaacaacaaacctctctataatgctttttttttttcttgttttgtcacagtttagaactttttcaagaatccagactactcaactggcttttgggacacattggtctctagcattctgggttactcatttgtggtattattgtgacatgcacaatctaccacttcctttgaggagattttaaaagagattttatgtttgaatctattggagactgggagggcctcagaagcaaggtctctctgattgcctctggccctcctgtctgtcattcccctttctcccacaaggcatgtcatagaaaccagaattcctctcttccaaggcaggtcatataaaccagaactcccctctcccagagcaagccataaaacttagaaaggtcacattctgacctacttttcctgaaagtccatcagaagaccacagaggaaggaatgttacacatagacaccaaggaaaatctgaacagacaggccttgctgggtttccttcaatttattatcattaaatcatccccttttgtccagtcacatttccccacaactattcacttctttcatcaaacttagcataaaagtacagtttttcctgggtctttgggtctccatttctgaagtcttccatgtcatgtaaaacttttttaaataggctgggtgcagtggctcatgcctgtaatcctagcactttgggagtctgaggcaggcgtattacttgaagacaggagttcaagaccagtctggccaatatagttaagccctgtctctactaaaacaaacaagcaagcaaacaaaacaaaaaacccacacaactttgttaaaacaaagttgttatgcttttctcttgtcaatctgcttttttgttataggggtgtcagccatgcacaggatattgctttcctcttctatacttaacaccgtgctttctacataatagattctaaagaaaaaggatattttttgtgtaatttatttgcattattttatttcactaatttggaaataataaatatacaggcaaaacttaaataggtgctactaattttatggaaaataactaaaattctaaaataaaatgaggtgataaaagtaattctaaagcatgggaaagccataaatatgaaaattcatatctctgttcaaaaatgaaaacaacaacatataaggtatggggtcctaattgaattaaaagattaatatgagtcagcaatatgttattgttatatatttgaaataagcaatatcataaaggttgaattgttttatgagcattttgactgttttcattacattttagaaattatgctgattttcatgcacgtccgtgtgaagagaccaccaaacaggctttgtgtgagcaataaagctgtttatttcacctgggtgcaggtgggctgagtccgaaaagagagtcagtgaagggagataggggtggggctgttttataggatttgggtaggtaaaggaaaaaggggggttgttctctggcgggcaggagtcggggggtcacaaggtactcagtgggggagcttttgagccaggatgagccaggagaaggaatttcacaagacaatgtcatcagttaaggcaggaacaggccattctcacttcttttgtggtggaatgtcatcagttaaggcagaaactggcgatctggatgtgtacgtgcaggtcacaggggatatgatggcttagcttgggctcagaggcctgactctgatcatgtaatatttccttaattagaagaatttaattaaaaattagatttcatgacaaaaaatttaaactgaagttattcagaggagatatttttatccttgttttggggttcattaatatgaaaaccagttatcactgtgaaaaagaccaaaaaaaaaaaaaagagaccttcaattgtattctctatatttgtatattttattggttttcactttaagtagggaaaatttggcaggatataattatatttttggatgatcataaaacatgtttatataggttactaatcttttattctggttgtatttaagaataaaaaacctcaaaatccataaataccaagaaagaggagcctgagaatgtaagaaccctatggaagaaaagctttatattttttatttttttgagagagagctatgaagatgaaaatattacatataataaaggacaatgtacatagtacatgtatattacatagagcaaatggaaaccaatgtaaacccatcagtatgttaaacatagttgtgtggacagggaaaatgggtgcataaagagataaaacatagaaaagagaataaatggaaaaaacatagaagtaaaaataagaaagggtaaatgaaaaaggcaaaagaggaagaactgaggagtgagaataaaaaatggaggattattttttatttttatccttctctaaagctaactagaattatggaggatatatacagagagaaatagaagatacaaaaaggaagggaaagagaaaggaagaaggaggactgctttgaagattctaaattgaatgcactgtcacactgtaagcttctagagctgtggatgtgagtgtgttaacaccttgtattcctctatttgaattgctaatgagctcattaaccactgttcatgactctcagtggaggccagggcattatccctcggggttgacctgatgcctgaacaaagcaaaatactcccaggccttcaaagaaacttctcctttccccacaataccctcaacccctttgttggatatttaaatatttggttttctggaagcttttcccaatcactttttgtctccattgtgagtcccaatgcctggaaaaccctcaccgggggttctacagtcagccttctattcccatgtctcatctgtgtggctcactcctttgtgaagctttcctcaggtacagccacaatcacatcccatcttcctgctagactataagctccatgctacttaaaggaaaaataaaaagcaacaacaaaaaacaaaactgaggcaaaattaaaacaagtagagactttatttggaccaagtttgaggagtgcaagctgggagcactaatcttaatcacagctatattccagtaactaacagtgactgacctagagaaggtgctaaatacatatcagatgggtgaatgaatacaatgaatggatggatgagtagtgtgggagaccaggatatacctccccaaaatatgaaggagggttgagctgaagacaaacaagaagcagcagaggcaggaaagctctttgccttccatttacctaaaagcaggatatagatttacaaaaacaaaaggtatcccacctccccttctaccagggagaacaaagattaaccactgaagacaattttagacccttattgacctggagatggtaccagaggaatctgcgttaacaagcttcactaactagcctttttatgccattattgccttttcacaagttgcttcccctagagactcagagtcttttcctttgtcttgccatttctttaaaaatttactattctattcttagttgaagatgctatataagccacttctaggagaactactttatttcctgtctcccatgtatatataaaatattcatgttaataaacttctgcttttctcttgttaatctatttttttcttacagggatccattctaactaagaaccgatgggggttactcttccctacactagtctaaactacccacttgtctgtttccaacttgattatgatatttgactgcagcgaccaactgctcgtctattgatctctaatatccagtattgtacacctggcatatacttagacttgcaactgaatgaatgaactgatggaactgccagagatattctcaaccaaacaatttataaaatgtaacttagaatgaagctttttgaagtaactttttttataatatggtgaatgtaatgtgtttatgtatatgtgaatatgtatgtgtgaattttatgatgagatgctcctcaaaaataagggaaattatttttccctttgaaatttaaaaattaataagatagatcaaaaacacacatgctaacttaaaaagaatctgacagtacagagcaatattatcatgtacccatttaagagaggaatatcaatggattaaaagaaaatcaaggggaaaatgatgactggccctctgtgctacagttcttgaaaaggacaataggttcttctaaacaaggtaatgatgtacgtgttcagtcacatgtacaatccatgtagaacaactcacaaatgttatctgatgagtatttcctgttgatgtgtattgtacaatgcaatctacacagactggtgaggcagaagaagaatcatgatacctcatcccaattggggcacaggcaggtttcagaacattaaattttaacataatccatagatacaaaattgaaagtgatttaacttcctcatgatcattcatagccagccaaacctagttagaaaaaacttgagctagttcagcaaatgactctcaaagtactctgtaggaatcttaagtgaattctgatgcctacgtatagcccattcagatcagaaagactaaagagaatgagttttatctatttctatccaacatttgatgaggacaaattttagtcatattattcattcttgatttgaaattatttttaaacaaaaacataaagttctgtctgtcctgtctgggtctactgagtagacaaacaaacatcccacacccttccccatcccaatcaagataatgacatcacaaatgcagatgacgacagatctaatttcaatagaattttgaatttaatgccatataaataatttagttctcatttatagtctttttgaattatgatggtgagtgactagggatgcataatttcagcttctacttttcaataaaattctcaaggaaacacagagagatgtaattataccatttgaaaaaactcagtattagcttacaacacttggtgagtgccagcagaaatatctgctcagagactctgaggaagagctgcaggcccaggcttgggggagggaggatatgtataagcaccttgactacaactgctcccctcaagggtgtctggccttcttcaaccaaaggaagcaaagacctacctcttgcttctctccaagggagttgcttcttgatgctatcagggccattttatacatatacatatgccatcactgccattagtattcatttttatccattcaaggtccgtgctttccagtagtttaataccaccagggtgggtacagatatgcatagcagtatatggttagaactttgactgtaaatcagcagtagggagggtagagacaagagcaattctttaagagcagtaacttcacacattttattttctagagaaaaatcacacactacttgaaataacacaaaaatgaacttccttcccatatttacatgattaggtaagtagggggaaagaaatatctttctctctcattgctaggattatcattgaagcccctgtaataaaagacagattaagagagaaagcatacaaatttggttaagttttggatgacacagaagcttacataaggaaatgaagacccaaagaacaaggaaaacctgtgcatttttttttctgttaaatgaagaagaggactgttgtggagaggtgtgattgggcaaagggagtatgaactaatagcaataaactaggaggaacttagtaaggcctgtttgttaagattctcctctgtgttcttgtgccttcagaagtaaggacattcctttcctccgggtatatggagagcacctcttacatgagaatcttaggacctgctttaggggaaggtcaggaactccttcctaggttttataacttgctttagcagaaaaggggtaaggggatgatgagagtgactttcctgcttctgttgttttctcagatgcaaaggtaccatgtttttgagtagtgtgtcctgaaccccatcaggtagcaaaagcagttttctgcttagttcagcagagtaaactgatttttgaaaatggcttggttttaaaaatgtgacatgtaaccatgcccctcaaccagtcttcaggtataaggcaggaaaggagtctaagagcaaccacgtgggaagtgaaggagaatgggaaacatctgtggttgaaaaacattagatctggatattcctgtcctcactgaacagaaagtcaccaactgagatctgtaaaattgttatgcaatataaaagaagggaacaattgcacctggaattgcaccaaagcatactttggaaatgaaatgtttatggaagtgatatatgtgatttccaggcctaagtcatagcaatttgctagaccatcctttacccttttccctgacagccaaagggagacaattccagttaggagccatgtgccaagaggcaatatgaaggaatctgatgcctgaatgaacacttgaaagacagctacctaccagaagcacctgcatttgactgttgcttgagcaataaatacatttttattgggttaaaacattttcttaacactatgatttcaggacacatttgttacggcagctagcattaagttaattataacatagactcctctagaaaaatgggaccagttacattgtttggttttggaaggggaatagaaaatacacccaccttacctgatttaatactttagaaagacctatgtttccaaatatagccctgccattaactcattgagctttgggaagccacttaaaatataggagcctcagtttccttattcgtcaaagtattttcaacagctacccctaaattagttgctgcttaccttttcccagatttaaaattctgtgattcttttattataagtgaaaattctaagttaatgtcagataccactcaagtcaacacggaggaagtgtgagtatagaaaaagactagggattatttattaataatccaccttgagatgacttgctaacacactttataacaaaacacatataaaaaagaactgagccttgacagagtaaacataagcctctctcaccccttaaaaattatgaaaataggctgggcctgtaatcccagcactttgggaggccgaggcgggcggatcacgaggtcaggagatcaagaccatcctggctaacatggtgaaacaccgtctctactaaaaataaaaaaaattagctgggcgtggtggcgggcgcctgtggtcccagctacttgagaggctgaggaaggtgaatcgcgtgaacctgggaggcagaggttgcggtgagccgagatcatgccactgcactccagcctgggcgacagagcgagactccgtctaaaaataaaaaaataaaaataaataaaaattaaaaaattatgaaaatatatgttttagaagtgaataaaaacaaaaatttcccccaaaatatatcaagaaactgtaaacacatctctgtagaaacgtcagtaagagaacaaagtgaaggacaagattagatccaagctgaatacttcaagcagtagccaaaatgggtgacagtaatgatattatccttttggggaatactgtaaatgaagacctgttgcttgattgatttataattagaatcagcaatattctagacagtactgaagagaacaatcatgtattggcaggggagaatgagatgataacctaaaagtcagtttcatttctcttgtctatggtaattgagtccttataatggagaattcaggggaagccaaatggagacaatttcaccttcttcattgtcaccctctgcattgagctcaaatacccttctagaataaattacacaagtgcttctaaatagcagaggtcagtcactaagcagttttataagaagcttatgtaacccatgtgtgatgggaaaaaaccaaaccaaatcaaacaacaataaacatttaaacttcagagtactagctcagagcgggagtcaaccttaagaaaggacactggggccgggcacggtggctcacgcctgtaatcccaggactttgggaggcagaggcaggcagatcacaaggtcaagagttcgagaccagcctggtcaatacggtgaaaccctgtctctactaaaaatacaaaaagtagtcgggcatggtggcagtcgcctgtaatcccagctactcaggaagctgaggcagaagaatcacttgaactcgagaggcagaggttgcagtgagccaagatcgtaccactgcattccagcctgggtgacagagtgagactccgtctcagaaaaaaaaaaaaaaaaaaaaaaaaaaaaagaaacaaagacgttagactaatggagttttctaatcagcactcagaaaggaaaatactactttcctacatgaaatgatgaaggtgttaaaagctttctgcatggcatcagcacagtgcagagcacacgaaacatatgtgtgatgaagaccaagtgcaacctagacctaatgcagttgtaattcaggggcagtagcaggcttgagaaatactgctgctgagctgtgtgattgaagaaggtggctggcaccttataagccctgcactgagcttgggaggtatggcaggaggtggtgataaagtgcctgggcttcggatatcagccaaaccttggctcaaatcctgattctaccactaactagctgttttattgtttaatgttaatggcttagctgtttaatggcaagttacttagccactcaatttccttatctataaaatgaagataataatatgtacctcacaggggttttgtaggatttaaatgagactgaaattttgtagtaggatatccaggtgaggcctaatctgtgcctgctactaggatttaaagatgtttgaaaaagtctgatgaaatggtgaagtaggctactcaggatactattttcacataggataaaaggggttccagaaaacaaacttcggaaggaagaattactttgagttggtaatagtctcaaagtcagtagggaggaatgatttttgtatatagtttggcctgccattcaaatctattgtgtgtcagctccctaaattcatttctgcaatttagggagacagagcactgtgaatacatcctgaaaaggtgctctcactaaaattgtgttagacttcgagacaccggtaacttcactttggtactcatcttacaagggttatcagaatagaagaaaaatttttctcttccaaataggcactgaccatcatactcaggtatctgaaggttccagtgcaatagtgactgtacccaggaagaactgcagtctctacctgagactgagatgagataaggtgtctctgcctgatacgtagttgaaagtggaaatggcagcagcataggaaccggggggactgtggcacctagtgaaagaagaaggggtatttaaaaccagtggcaatgtgcagctgagagagcagcacctgtgaagggtggctggtggctggtagtgccatggcagctggaagacaaacagcaaaggcaatggcagtgataacaagaggtgcccaggggaagcaatggcagcattatgtctagcaggcaccctatagctgacttcactggttggagagcatagatgtgacaccacatatcagaaatactttgggaagggaatgggaatacatgaaagggaactgagagggtggggttactttacagtcttgcatgatcagatgtaagcaactgctaacttcatgaagatgatcacctttatggagatcacgtagatgaaccccagagaatggcaagtctgggaaatctgaaccagtaatcaatacaccacaggagctcaattcgtgataacattctgtctcctttaccctctcctttctattttaggtagacaaagtagactcatatactggctgtattacctgcattaaatgatgaccgagtgcaccaaattgtataatcatggttgtctttctcaacctgttacctgattagcaaaatgggaatagcgtagcgtgctctacagctgagagattgcgtaagtagatcattgttgcaacacttgcacatcttcagcattcagcaatgttagtttcctccctctctggataactgaagaactctatgcaattagtgtctcagaactgacaaggaaggaactttggctagcttagctgtgataactagaaaagtagaaaagactgtggacttagagcaggagttccagctaagagtcccccccaaacacccccacccataacatctaagaatttatttgatcctttcaaataactgtgattctctccctatgattaacattttatataagaagaagaaaaggctcaaagttttaacatgggtaaattcaagtctgggcaataaggcagactgaactaacacaatctgttatgttcttctctcctgcccaacttccacctttttttcagatgataaaatatgcataacaaagaatttgccatattgtttttaagtatactattcagtgacattaagtacactcccattgttgtgcaaccatcaccaccacccatctccagaaccttcttcatcttcccagactcaaactatacgaatcaaaccagaactctccattcttctctccctgcagtcctcacaaccacccttctatattctgtctatgaatctgaccactctacgtagttgacataagtagaatcatacagtatttgtccttttgtgactcgcctttttcactaagtataatgtcttcaatgttcatccatgttgtagcatttttcagaatttccttacttttttaaggctgaacaatattccattgtatgtatataccacattttgtttatctgttcattcactgatgaacatttgggttgcttccaccttttggctattgtaaataatgctgctatgaacacgggggttttacaaatgtctcttcaaaatcctgctttcaatttttttgggtatatacccagaagtgaaattgctggattgtttgacagttctatttttgatattttgaggaaccactatactgttttccatagcagctgcaccattttatattctcaccagaaatgtacaagagttccaacttctccataccctcaccttattatttttcctttccttatcccccctttttttctcttttgataatagtcaccctaatgggtgttctggctaagaatttttaccagggctttcatcactgtctaatgaggagtgaggggaagctaccaaagaatcacagagcacttacagctatttgttgtttgcaaattgctagttatatttaagttaacttattcatctaaatgcagttcattaaaaaaaagtggttcattttgtcctatttgtctgtagatttccagttaatagtatctgtttcagttattgttttttaaaaaggtatctgaagtggatatatttttctggattgcatttgcaaacaaaatttaatcactttatacagtccaactgagtgtttctgaggtgggacaacccaaccagtagatgacgctcgtgccatttgattacattttactggctaatgtcatgtatcatcctccacattttgtctggatttcaactgtagagagcaaatactcggccgtagcacataaaacctttctccaaccttaaatcataagaatatggtaaattcaaggcaattttaccaacaaatatgacatctcttcttataaagattcagaatttataatcgtatgttcataaaggtataaataaaatgggtattcattacattggttacagatgaacaaaatggaatttaaaagaattacaagatggatgtcttgaagacctccagaaagcatagtgaagtgtcctctggtaatgtcacattccagaatgccagctgtttactggctgtgtgtgactctagacaaggaatctttgtgaaactttttgggaaaaaaagtaaagtagggaatacaatgcatatcctctaatgatgaaataaaacattgctgaacaacatcgagtgtcacaggcctcccagaataggtgcttgttcaacgttagccctcttttctctccacccgacactttatcatctttgttatgtgacaattaactggaggaagatttcatctcaattatcgtatttcttcccttttcattttctttggcacagaaaaatttaatgtttaccttcaaagcatgaattggtgtgtatgtgtatgggttctccccaggagacaatttaatataattaataacttcaaaatcatttgggtgatgtgaaatatgcatagttattacaagccagtgtgtggcagggggaggggtagatggctgttcagtaggaggcagaggcagataacatatgtgcaaatggaagttagaaaccaggcaaccttccgagagtgaaggctgccaagtcagtctcaaacaacttgcaccactcaggtgcattcatgcccaacccagagaggactgtgggcttggtgcagatgactggctgagctcctatcagagcctcttacttccagcttcaggcatttgtggaatagcaatgtaggtgtgctggctgtgaataaacttgggttttgagcagccacattaacaagctagaatcaacagggagaatttgccataataaagcactttcccagttgtcacattgtactttttaaagtggcaagtttttcccagtgtgctccaaatgtgatcagatttacaaacagctgattaaaaagataggattttagagctgaaaagcacctccgaattcatctaatacactatcttcattttacaaataaagaaatagaggttcaaggggagaaatgacttgcccactgtcaggaactgaacaagtaggaattcccaagcttcttaactatcaggaaagggctcagtccagaaggccacaccagtgatttcttaaaccaggattcctatgtggtttatctcaaaaagaattgctattgtattcccaaactcctagcctatcacagagctgtttcctgataattttacggtctggccataaatgttttgaagtagatactcaaaaattcaccaagcaaatctacgtttcatcatcatcatcatcaccatcaccaccatcatgtttcacacttacacggtgctgattatgtggcaggcactaactaatgtaagaattttacataaattaactcacaaaaccccagtgagggaggtaccattctcaatatcttgcagataaactgaacacagagaagctaaacagcttgtccagaatgtacatggttgataagtgatggatttgggatttggacccagccagcctggctctggagtctatgcacataactgctatgccatatttcctctcaaacaactgctatcctatattaccactccactctatgattaggatgaggagattttcctgatggtcatattaagataatttgttgaatctgctttccgaccctaattccgtgagtgagaggtgtggcagggaagaatagagccccaaagataccaggtgtgatctacacttgatcttagccaaaaggccgagaagcaataccaggtgtgatctaaattgcattgcaaatgctccatgcacgtagccatggtagaaagggtacatgtcaaatttgctggggttttattacacttcaagaaatatagcattctttgattactttaaatataggtcttcaatatggaaagagtaatgcagtctaagtaaaactgagcagttacttcaagtcaggtacaacaagcaggttattatttcaaaaatgacattttaattaccaccaggaggccattagaaatgcattctggcagtttgcttggttcctttggaaagataatattgacaaactgctatgaaactggagttcagaaaacagtgtaaattgagatcaggaataaaacaaacatttgcttgtgtaccctaaagcaatgatgaacaatttaaagagagaagacaaagttgaaattatatttttctttcttagggagaggcagaagagggagtagttttgcaggaagactgttgtgttcctaaatttattacctatgtgaattacttgatgtatttagcatagcaatttgaagcttcagccatccaagcacaagtcactgaggagctgagtgccctggaacgctaattctgccttcttctccatgctaggagattggcttcttgtgacctctggtgtggagggtttcaaaagaacagtttggtcctggagctgatctccagtctcatcaaggatgactggcataactccaggagcttgggtcatctttacaaattccacagctttgtcccttggtgatcccaggacattgggaaaatttttcacatttagcttcaggcatttgcggaatagcaatgtaggtgtgctggctgtgaataaactaaaatataaaaacctaaaacataaaagggaaagaccagataagtacacctaaaaatcaatgctcctattgcttatcatggttggttttccttataactaaaatcagtacaaatgctttttgctagtcacgtgggttgtcactgcagaagccacaggaaaaccattcaagccacttaccttttctctctttcctctaggaaataccttttgtattggtctgtgtggtacttaaaccaaaggggaaaaactgtggtgactgattctactacaggttaaccatataaaataaagaaaactcttgagatgccctattggagcaatgtaatttactttcctttccctaaagtagttccaaaggtggggatattgctaggatttggggtcacttttatttctgagaaaaaaggtaaagatgaatggtacttagattgcaatacactagccaaatagcagtctctgtcagagactcctccctctgactttcctctctatatttattaatttattcctttgacaaatattattaaagagagtactatacatgcctagatttatctaaactccaaagagattatggtctagagaggaaataaaatatgtatatgaataaatgaacacgaggaagaaagaaataaataccatgagagcagcacataggaaatgctttgggagattttacatgattatcaagagagatccagcaattctatttcaagaagtcatattgactatatctcttctccttcctgaaacagacctcattgagaaagccacaagggattataaaaggttttaacctacagcaataaacaagagcgggttagagatctcattaaaatactgcaggtgaaattgatgcagtggtatctaatgtagccacatctagctgtagacaagaatatattgagaaagggatgaatccaagctggaggtgcggggagtactctattccacagaactccagaggcttgggactcagagacactgtgtaaatgaggtcaggatgatatatgatgccaatggcggagccctaacatccacgtagcctctagctaaggaaacaagcaaataagcaggactccctgatcagaattaggaaggtagtctctgagttggaatatgggtaaacctgtcctaatggaagcatttgggacttgaaaaattgagtctggctcctcacccactctccctaaaatgaggccatcaatgtgtacacagagatcacagtcaatgtctctattgcttcattcccaaatgtaaataggctataaggaataaaccttcttttcacaaaaacctaaaacataaaagggaaagaccaagataagaacataagaatcagtcacaaaaatataagaagagcaagatgttacaaacaataaaagctgcagcataagagaagactcttgaaaacttttttaaaaaatctgatggaaaaaatgtaaagacattttattaaagagttgtgtgataagaacaaggaaattccttatattgaggagtgaagtgataaagagaaaagaaatatgagggaggacaggtgactcagaggattagtccagaaagatcacatctcactaataggggttccagacagaacagtgaacacaaggaaagaaagttgcaaagaaatcttttaaatatagcactttccggtgctaaaagcacatcttcaaatggagagatttcattgcatatctgaaacaaatatatttttaaaaagtattctctatataggtattgttgtgatatttcagagcgccaggaccaggagtcagcaaacatttttttctgtaaaggaccagagagtaaatagtagactatttttttttttttcctgtaaaggaccagagagcaaatagtgcaagctctgtaggccattcagtatctgtcccaactgctctgctctcctgggttagcacaaaagcagccatagatgtgattagagcaaggggatagaaggccctaaaagggcagtatttgaaaaaaataaggaattttattgaacatattatatgatggagcatttgaaagaaaacaataaagatacaacaaaggcaaagagtgacggtagaaaaaatcaattagaaagaagagaaaaacttaaaactcacacaggaaatataatgatattacagcactctattttgtctaagcaatgaacagatgcatatttgcatgaactgtcaggggagggaatgcgtgtccatgatttggagacctgggaaagcaggcacactggggaggatagagcacagactgtacacattgtaaaagcccttgcatgccctccgaaaaattactgattctcttttttttttttttttttttttttgagacagggtctcgctctgttgcccaggctggagggcagtggtgcaatctgagcttactgcaacctccacctcccgagctcaagcaattctgcagcctcagccttgcgagtagctggatcacaggtacttgccaccacaccaagcatttttgtattttttgtagagatggagtttcactacatcacccaagctggtctctaactcctgagctcaaagcctagcctcccaaattgctaggattacgggcgtgaaccaccgcacctggcccctgattttttttttctttcttttttttaaagcaattagatgagggcggatcacgaggtcaggagatcgagaccatcctggctaacacggtgaaaccctgtctctactaaaaatacaaaaaattagccaggcttggtggcgggcgcctgtagtcccagctactcgggaggctgaggcaggagaatggcgtgaacccgggaggcggagcttgcagtgagctgagatcgcactactgcactccagcctgggcgacagagcgagactccgtctcaaaaaaaagcaattagaaactactgacagtttgaaacgcagagtaacaagattggggtggcatttgtgacacatgggtctggtggcagtagtggaccagaggaagatgagacggaaggcagggagaacctacatgggaaactcgactgggcttcttgttttagaagtagaatattttgttaaccaagaaggaagcatccacactgtgcatcttatagctcttccatgaatttttgtctgaaaatgactaactcttatttgtcttccagatgggatgaagagtgcaaaaaatattatttggggcttggtgtctctgagtacaacatgaaagcaaaagatacttgcgttggagtaagcagagacatttttcatacattggcatttaaaaaaattcaagttcttatataatccccaaacttccatacttccatttgactaaaaattgtccaaggtacgggaacttttgttcttttttggtcaatatagctttagaatagatgtgttaaaaccgtggttctgaaatgttagcttagggaagctgctcttgttaaagatacatattctcaatttcaactcccaaacatatcacattcaagggtttacagtgagggggtattgagaaaatgcattttgaacatgctcacagatgtttggtagtgcctggcttaaatcatcctgtaggaatgtacctagtcaacaccatctccttcaaccaacctatatcccacttcacatttctgtcttgtcctctttgatactcctcagaatgttgaagctgctctcagtttgccggaactatatagctttggcagaagcttgtcatttgttaagataatgttgcccaattctacaatttaattcctattctctgctactgtggaaggccaggtctcactaacacaggcctctgtaacaactatttcagcactgactgagtgattaactattaaaagctgaaagagccagtgactttatacaaaggctggaatgtaacaaaagcccaccaagagttttgtccaggctttttccgggccttgaagcatgacaagataacaaaggaattctattttttttgttgttttttttgagacagagtcttgctctgttgccaggctggcatgcagtggtgtgatcttggctcactgcaaactctgcctcccgggttcaagtgattctcctgcctcagcctcctgagtagctgggattacaggcaagcaccaccatgcccagctaatttttgtatttttagtagagacggggtttcaccatgttggccaggatggtcttgatctcttgatctcgtgatctgcctgcctcggcctcccaaagtgttgggattacaggtgtgagccactacgtccggccagcaaaggaattcttaaaaggacctgtttaggatgaaacaagttttactgggggctaaaggagctccccaaacctccataatttagtaggaaacaagggtaatcaccccagtacttggtcccattaagtaaatttactaaggctacagagaaaggtcttcaggactcagatctcagttatagattaattatgtctttagatgaatgcccgcttacacacagacatatagcttagaaggtatataaggtctggaagactttgtaattttgagttggtctggcaatattttctgggccttttctctgtaaccggttacagaaataaaaactccctcctttccaagttcatctgcatctagttactgggccacaggaataagcagcccgaccctcagtttggtccagaacactatgttttgctatttcacttgctagagactttggacaagatgttccacaactttcctctcccaaattgttgccatgctgcttggagtcagagtaaaaacaaattatctgaatatgagacaatatataacctatggaaaggcaaatatttaattgtgcctgaatttaaagtggtatttgacttcagtataaaattaggttcaagaaattgtactgttttctgaaattatctttctttttaaactagctgcgatttctgcttacgctctcatctaacaagtttaattattacttttaaaaagcaaagcacttcacgttttgccctctgctacctaagctgctaaagaacaagtttcagagatattatgatcaaatgtgagtttgacctagaatataagaattcgtttaatttctatgctactttcctctgaagaaaactacgcactcagttcagaaatattttggcatgacaatcagcataatgagaattagttcatttttattcactgtatagaaccaaaattcaatggagaataagaaatgcaaatagaaggatgtatgatgaggtcctcagagcctggtgggttacggggagtagaatgctgggaagcacaggagaccttaagtattttgaatgtatcggtagactctcagaagcacacaggtgagagacactaagatattcttgagtagagggagaggtcagagaatttatttgttcctagagtttttccaatacaaaggaagtataacaccagaatgtctttgtaattcagctctcttttggtagattttgaatagagatcaaaagaaatatgcatgaattgggatcaaaattgagaattttccctatgataaaatatgcttcataagaacagaatctttgtcttgttcactgttgtatcctcagtttgtagatcagaaaaaatgctcaataaatgtccatattaggaaggaaggagggaaggaaggagggaaagaatgaaggaaggaagggagggagggaagaaatgaaggaagggagggagggagggagggaaggaatgaaggaagggagggagggagggaaggaagaaaggaaaggtgaaagggagggaagaactgggatgataccacactggagagttaagctgttagcaagaatggagccctgaagatgaagtgtagttcctttttatttaggtattgactgtcaacccagtggtagatgctggggcaacaagaggaccaccatcagtcctctggccccaagagcttctatcctgaaggaaaaaaacatgcaaaatataacgtggtgagtgctttcaaggatgtgggctatgatgggaacagagcaaaaggagctttcagttagtaatgagtaaaactaggattaagatccaagtcttcctactttaaatcctatactttttacgtgaaagctctgtattaattaggtccaccatggtaggaaggttcttggtggtgttagttttgattctcaactgctttaagttttaaatacaaactccaggtgatatctaaatgccttttgggaagttcttaggacagcctagtgagaaagaataaactagtatattttcttcttacttaccaattacttccagagtcctgattgtcatccaaatgtcatcaagacatcctcatcttgacccagtgtccaatagtgtaacagtactcagctgaggcatcacagcagatacatgaatgggtctatcacataaaataattagctggagtggagcataaattagccccagggagttgtacggagcctattttaatctatgtggcaggcagatctgagtgaatacaggtgtgttgcacatgtgcacatacctctcccacgtttggaagtggggaaaaaaagttggagagctgccacattagagaaatggctattaggatgcaataaaagttagagaaaaaattctttaagtaggaattgttcctaagttgttggtagaaaggaggctaaccagaaagacaagcttgaaaaacatgctggcagaagagaatatctgcctttaactagttatataagatccaataaatttatctatagcactgagttatttctgagcatattccaatttgagaaatgcctatttagctacttttatttaacattataacgtatacttctcagcatacttgatacataataatttttgtgaaaatacataaaaacagtaaaataaatgaattccttgggggggggggtcttataaataattttagatttggatcccaatgcccacttaatccagactaacttgaaatacggtcagaggcacaaagtggttaaccaattcaactccacatgcagaaagctaaaaattctagttttcataacccataagatttcaatgaaagagcccaggcaatgaaacaagaaatagagaaataaagggaaaggcagagatcatttatacatcactaaatggtttaaatatgggtagactctcgagatacataaactgcccttatccttcctgcttttacctaaccatgaatgcgactgaccctgggaaatggtctcttaatagttaaattgacaattattgcagtagggatttgggaactaggctattaaaatatcaggctattttggttttgcttaaatatatctttacaaggtttcttatagaatcttcaatccgatatttccagaatctttgttgcatctggcaaactgtttttttttttccccatagagtgatttacttggtaaaatttgcataagtctatttaataataaaagaaaaataggcatgtgacattcttcattttgtaatcactatagtaagtgacaccaatacaaggtaaaaacaatatattctaaaaactgcctctgaatattgaattattttggacttaactatcttcctgggatggtcctcaaagaagaatggttcaacattaaatagctaaatctgcttatgcattaatttaaaattaaaatatatttatggaatgctttttatgagtaaggtatcatgttaaactctagggatatcattgtaaacaaaataattatattctttcaaggattgtatagtctagtggccacggaaataaataaatgaaaacttgcaataaagtgtggtgaatataataagaggggattagcaaagggagctctggaaatatattagacggtgggagaaaggagttagtctggtacggggaggtgctgaggaggagattgtaagagaggagtccaggaagaaggaaaaccttgagttatgagagggcatggcctatttaggtaaagatggtagattaaaatccaggaattgaagggaaagaggtagagaaaaagaagtgacactacagagacagacagccaaggaaactcttaagaactttgaacttcattcttaaggctagaaggaaccccaaaggatttttaagcaaggaaataaaatgattggattagtactcagatcagttgggtgatagcatggagaatgaatcaaggaaacccgttgggaggggttgctttgatttggataaaaatgctaattgcctgtactaggtaagctactgggaggtgacactggaaaccgtagacaggtctaaggaataatttagtaagtacaaccaggatatagtgttaggttatttggagtaaataagtcaaagttagtaaacatgtttctggcttgagaaagtaggtaccgttcatggagacaggtaagtatcccttgagaggtttggaagaagatgaggaactagtttcaaacatactgagttgaatgcttatgggacatcaaacagacgtgtcaggaacgcattggattcacgggtttggagcttaggatatatctggggtcaaaagatagattgtgtataattgtgaatactgtaccactttatacgcaacaaatttaagggagataaagatgcagatttatcatttacatgcacttctagaatgtgaccttgtattttggcaccactaaaatctgttcaagtaaaaatcaatttttagaaattaacgaatcatatggcttccacatgaccattccatacacacacacaatcttatttcctaccttttcattacccagttccatttttgtatacttaaaaggcacattttcaccttcattaaaattatttctgtgcctcgtattaaaaattttaagaagatagatctcaagtgttcttactacaataacaattatttttaagagccattcataatttagcatgtgacataagccatgtttactttccagagcctccctaatgtgttggagtgattatctgttcttccttcagtctctgtgagaaatacccatacccagagtcctggagctaagaaaagccagaatgaataaaataggcaagttcggattaacagaaaattttttgaaagccagaaataccgatttcttaaaaaacttcattggtatcaaaacaatgtatctctttcactctactcttccactgaacaataacactgacctgtaaaatcagaggtagtcatttggaacctctggctttggaaagactattgcaatgtgccatgtctgacttcaattatttcctgcactaggtctcaggttctcccctaatttggtatcttgagtccttccccagcaaggtactagggacgtgcccagaatggtcaggttatctatgcctaccaggagaataagacctcactctgctgcttgtcactcctatctggggatgtcataggtcatcttctctctgaattctgcatttgccagagagaacctttcgtgtgaactttggaatggtgcctcttcctgtatccacaggacttgaggaatgaatcaaaccctttaagcagaatgcttatacacccaacattccatcctcactcttcaatgcctagttgaccttgtaaaatgtttgttcttggtctttttttcttaaaaaccaataaaattggatacctttttgtaaatatctccataagtttcaaaaatgtgattatcttaataatcttttaaatttacctaaatacataaagaattaaacacatttttatcccctctcctgtctccaaagccctactaaaatggtaatgaaggaatttttaaataatggaataaagaatcagaaagaaaataggagagaatagcaaatcaagaataacacaattttagaagaagacatatagatggagagttaactagacttaccaaaaataaaaagctgaaatctagagcctgcatacagttagcaaaaaaaggtttaaaatatagatattctatccatgaaataaaaatatgatgccatacaaaaaatgattaacagattgaagtaagaaggggaaaaataacttataaattatcctatgtgtttgtgtagaaaatagcattcactagcattttaaagattatcgatgcatttgggaaatgtggcaatacataattagaaaattaagcaaatagaaaaatgaggcaactattaattcacaggggaaaagggcatataaaacgatagtacactggagtgaataatatttacataattataattaaagcatcggtgaatttaataaaaactgtgattacacacgaggggaggtgtgtgtgtgtgtgggtgcatgtatggaaaggagagctaaatattcattagattaggaatcaggttagaaatcaaagtgaaatgtgtaaaattgataaatcaacaaatagtagtataaaattacttttaaaatgtgaactgtatttcagaataaattgctaaggaagttgaaaatgattgcctcaaaggagaatgtgggttggtgacaggtgtagtgggacactcttgttattaaatataagcctttttgtgctacttaacttttaaaaatatgttattttgtcaacataaaaataaagtaaaatacatttatctgacaatatacagaaagatgtgagcttaaccttggatctgattcacccctctcacattttagagtaaaacaaatgtgtattttcaatacaataaatattcctcttagtggttggtccctccatgcttattgggtaccttctatgtgccacacactattctagggactggagaaacagcagtgaacaaaatgaacataaatcccttaccaagtgtacatgtataatgaagaagttagagaataatgacataagaaagtagaacacaagttggttagatgttaagtgctaagaaaaaaaatgaggctggaaatgggtcccaaagatttgaaaatgtgacttatttggtaatcacttgtaatttttttcttcataagaatgttcttagcattctttctgaacttcgcattctgagaatcagtatgttgcatattttatataaaaagtcttaagtcttagaattcctgtctgccttacctcaggaaattttggttgttcgagatattgcaaaaatcctgtttcctttcagtatttacgggcatttttataaggtactcaaattttgtatttctactggaggatagaggaatttgtgagctttgtgggtaattcgatggctcaatgttttgggcaaggattaaaaaaattaccacattccacaacttttacaaatcaaagaagtccaaatctgtacactttgcaatgtaacttatgagacatagtaacagattttgaggtatttatattgcaaagaaacaaaaaataataattattcatagaaaatactaagtttggacggcttgtatatcatttggggtggtttccatcagcacacagtacagtggacacgtggtataaatctgcctttgtcttttgatgatgagtcaggcaagccagagtcctacttagctgagtctattaggtttgaacatgaggaatcatcagtagaatgagccccacatttcaaagctacatagacagttctactgcccaactgttttaagcatttcagaagtctactatttcagcttttctggcccaagctctggaacaatttctcttctttcactctctcttctccatacattataatttcaggagattaagtactttttttttgagacggagtttcattcttgttgcacaggcttgttgtttcactcttgttgcaatggcgctatctttgctgactgcagcagctgcctcccgggttcaagcgattctcctacctcagactcctgagtagctgggattacaggtgcccgccaccatgcccagataatttttgtatttttagtagaaacggggtttcaccacgttggccaagctggtctcaaacttctgacctcaggtgatccacccatcttggcctcccaaagtgctgggattacaggcatgagccaccatacccggccgattaaatattctttttcttctttcagaagatttcttgtcttggatgctttgaagccaattccttgagaatatttgaataagtcttcatatcaaaattgaggtagaaatgctatgttctttttatctaagagcattaaaaaaagctgaaaagcatttttaccagaataaaacaaatgaaaggaataggaaatgccagaaaagtaatgtatgtaagattggccacattcgcaaagagccatgtatgtgattatgtgaaatggggaaaaatatctccccatagaatgcttttaatgcttattatgatcatttaaatagaaaaaccttttccaccaaatatattattagaaaaaaataaatctacaaataggccagaaaccattttaaaaagaaaatcatcatattattgcatagactttgtttataagattttattcattctttgatttcagctttgggaaagatgctacagttaattgactaaataagaattacaataatggggaaagttaatggtgactttaagagaaatacgatcaaagctttagctccctgactttaaaaagcaagctccttacacaataaaaaagcaattctgggcactggttgctaggtgttgggactcattctttttgtcatcaaagacctcttgtatttttttcaattaaagtgacagaattactgagaagtgccaagaaaactgataatgtaaagtactaaaatctttcacaaaattttgagcttcataaggaataggatctggctcaaaggcaaaataaacattaattttcttgtacataattagcttacatgtttctcttaaaggaggaagtaatgagaggagatgtcctaatacaggttcctcttaagttaacatctctgttgctttctggctctgttagatgactatcctgaggaaacgttttctaggctggtagctctgatgtcatttaggatgagacaacaagacctgtatgaaggccacattgaaagaagagtgaccttgaaatggattaaaacattcaagatttgaagctttcttgatctaggcatattctggcagataatatttctattttcttttgagatggagtcttgccctgtcaccgaggctggagtgcacgacgcgatgtcagctcactgcaacctctgcctcccaggttcaagcaattctcctgcctcagtctcctgagtagctggattacaggtgcatgccaccacaccaggctaattttttgtatctttagtagagatggagtttcaccatgttggccaggctggtcttgaacttgtgacctcgtgatttatccgcctcagcctcccagagtgctgggattacaggtgtgagtcaccccgcccagccaatatttctattttcttataggctaccaagaaacctatacaatgagacctatttgttcaaatggctaacatttgttgaacacctactatatgacaggtactgtggtagggaccagaattagaataatggtcagaataagaaattgtccttcatattttagagctgataggctggtcggattggcactaatgaaacataaaatcaaacatacaatgacaaaattaagatatgtagatattctgatgaaacataattatgagattccctggcagcactgaagactaaaggagtcatgaccattttattgatgaaacagtcatggagctggtatcaaaacgatgagtaggatttaagtagggaaagaatattggggacagggaagtatgaacaggaaagttctttagacaaagagaacagtaggtaggatggccctgagatggaagaagcatggtgcatttgaagaactgggagcaggtggctgaagtatgttgatgggcaaggagggcatttgaagagatgatgctccagaaatagataaaactagaatagaactgggtggttttgaaactcatctgaagtggtttgcccgtcctttgttgatttgattactttactggccgccttttatccccatactgaatcccattatctcccgtcccagacaaatgttctaatgtaataaatgaaattcattcactaagcaaatattgagcatctcccatgtgccacacactactctaggaactggagaaatagcagtgaacaaaatagacataaatcccttatcaagcttacatttataatgaaattagagaatagtgacataagtaagtagaacataagttggttagatgttaagtgctaaggagaaaaatgaagcaggaaacaggcacccggaagtataagaaatgtatttctctgtttcaatatattgttgctaataccaattgttgttttacatgaaaacatttaaattcatataaatggcattgtgctatcaatcttgtttagtttttaattctttctacttagagctattttcttaatatctattcatgtaattatgagtgtggataatctgttgcttctgaatgttgtgtaatacccccatacatccccctcatattttatgtatccatacttccaataatggaaaacaagattacctccatttccttgctctcagagcaaagccaagccatggctccatggactttgtatgcatgtgagaggaggtggcagtggaagagaaataagactggcttcgtattttcaaaacatacctctagatgcaatgtgaaaactggagtggagggaatccagattctatttaggagagtgattgcagcagtctgacaagaaatgtgcattttagactaggttgatggcaatggtagaactaaggagaaatggaagaattcaaatgatactgaaaaagtaatgttgattggccttggtgataaaatggatatggagatgcaagagagggatgtgtcaagagtgactcagcattctaatttaggcaactgggtggagaagaatttttgcactaaggtggtgaacatcggaaaatgacctcttaaagagaaatattacatggctgtaacactgattaacatgtagaatttaatgaaatctgtaatataaccactttaatctaaccacaccatgaaggaaagattcactgagtacttattatatgctattaactatgccaggatttaaaagtccagtagagtgacaaaaaaactgccaaatcaaaatattataattctgtaattattatgatgaagcctatcggggacatagaacacagagcatgctgaagtctgtttggagatgaatggaatttcactaagaggaatctggaaggagggcagaaggaaatctaagcacaaagagatggaaatgtaaacaaatataatattttaggggaagttcaaggaatctgtttttgcaaggaaggagttagtggttttcagtggggcgtggggccatataattctctggcatacaaaggattttatggagactgtgacgggaggtactcgagcagaaaagtagtgattagattcggacactagagagattactccagcatcaagagagaaagacaggtaaggacactactcgttggcgacctctgaaatgacgactgtatgaactatggcagggacatagggattggataagaggggcacatgaaggaggtgttcagaaagtagacttgaaaggacctcatgattaattgaatgttctggggaatcaaggatgactcccaggttcctggcttgggcagttgtgtagatggctgtgatagttactgagcttgggtgtacaggagggacagaagttctgagaaggtcatgtgctcagttgaattttagtttgtttttttaaaaggtcaatccagatggaggatgtatatgggttcagacctaagaactaggtctgagttagggatgtagattttagactgggtcagttgactggtgtatgtggacactgggaaggaaaagaattaagaccctctttgcccagaggcctctttgcatatgatggcctacttttgacaaaaactcactttgtgaagccaagcagagccacaaatataagaaaaggtgaaagagactagtcaaagataatacaaggagaggagaaccaggaagaaagaagagagaaggtgaggaatataagtattccagtgtctgcactattttttcttacatgtttttccttgtgtgctagtttttggaatgttctgaaaatgctatttgtgtatatattctataaaatgtcatgatggtttacctctggtttctcttttacatatggcttcaatgtatctttgcatatgatggcctacttttgacaaagaatcaggtttatagtgtttgaattttatggcatcaataaagttttaaaatatatttaaagtgactgctgtataaaatttctccttgtcttgcagttaacatgcccttgtattctgtttaccatgccctcccacaattttctttatgttttctgctttctgtgtatctgtttttcatctacatgggctgtttcttccatcaaaaaaagacctcccaatttctaattttaaatgtatattcctttctccattctttatacatacttctaaatgtaactcaaattttccaaggcctggcaagcccctggatattaatggaattatattaacaatagcccaaactccattgctttttaaacgtaactgttacaaggacctttgttccttgttatgtatgtctgtttattatactagaggtgggcattgtttggccgccaaacatcttgaccttttccctatgtttgaggaatccaccattgtgtgactattgtgagagggggcatcttctgcagaggtgagagaaaacatcactctgatttctggctgctagggggcagtcatgtcacccaatcgcagataatcagataactcttgccagggaatttgaatctgggttgattgacctatagaagcagaaaagcctgggaatattatctagtattcagtggctatggtctagtggtagggtccagtttccgcggctggcaggcccagtagttgttagaagtcagagacgcttaacaaagttcccttgtatggaaacagaaccacatgttccatctcattagaaagaagtcaaacttaaaaaaaaaaaaaaaagagagtctctgtaaaatgtactgcattgtattgagaggaatttgtgttaaaaactaaataatgggaaaagatccaccctaccctatgacctttgtggtggtttagctgctcaaatttccttgattagtcttttcagaacctggttctagttttcctttgattgtgtgatgtacaaaatactggtccaataactttcttttttgctaaaataaccagactacagcaaaatgcctttgtgctctatgttacatcctcatggacaatttcagtttcagaggtggcacacagatccatgagagctctgaatccctttgtgctggtagcatcccgcctctggtactctccaagttggcccactcttctggctcagcttggctctcagcctcctatgacctggtcacttcaagcttttagacaggaacctctcaagaaacctctcaagaggacataaaacagttccatgttggcttctcttgaacatgttccaatatggatcatgaaacacacagcattgtgccagcaggctgagagagcaaattaatttcctgtttcagctatcataggccgctcaagcccaagcatggccttttgatttcttaggctcaatgtagattccagtctatcaggccacacactaaggtgacacatattaagtccctctcttgacttaatgtaaaggggtaattacctttcacatctttgctttggtgggggtggagtcatagcataacccttcaaatcaatcctcttcacaaaccctttctccccattcacactcttctacccttccatgccttcccctgtccccaactggctttgagatcatttgctgtacctttctgggtatcagtgtcctcatatgtataatagagataataatggtttctactttgcaaggtttttgtggcgactgaatgtgtgtgcatatatatatgtatatatatatgtgtgtgtatgtatatatatatatatacgtatatatagaagcatatataatgtgtgtctgtgcatgtagcttagaatagtccagctcatagtaaactctatctaaagttttcttattgctattatcattattattcatgctgttgtatcctagtaactgacttgagagttacaatttagtccctggtatgcctatgttgatttatgtaataaaatgccgttttgaaggggaggatttaagagatgttaggcactttaatttatgcaaagagaaatttcaggaaagttgttctagaatcacatagttacatggtactgaaattgagggcaaaaccacttttgtccttgttatcaccccttttctctgctagttagctgactggctgttttagtcagggttccctagaggggcagaactaatagaatgtctatatctatctacatatgggagtttattaagcattaacttacatgatcacaaggtcccacaatagactgcaagcttgaggatcaaggagagccaatctgagtgtcaaaactgaagaacttggagtccaatgtttgagggcaggaagcatctagcatgggggaaagatgtaggctggaaggctaggccagtcttacattttcacgtttttctgcctactttatattcactggtagctgattagattgtgcccaccagattaagggtgggtctgccttccccagcccactgactcaaatgttaatctcctttggcaacaccctcacagatacacccaggatcaatgctttgcatccttcagtgcaatcaagttaaccatcacaagtccactccttgtcaacttgaagccatatatatctcctgagatcataatcttcagtaaagacaataataaggtcataattatgcctaacatgactatgcttcatacaacaggaaacacaccaatccccaacccaaatactattacatacagttaacaaatactattacataaagttgataaaaagtcaataaatcttatgtcacgtgatgaaggaaaagaaaataaaatgaaggtattttcttagtatgagtgcctacatgcacaaacatgtttttaacaaaaggaggaggaaatactcatgacggttacagtccttggttctgcagctgcttacctggtcatagctgttattgatgactaccttcttctactacccacccaaaccttcattcctgaggggtatggaccatttgtagtcctgcctggattgggctgatgtagtttcccattgaccttaatcacagagcaaggtaatactaagagacaccctaatggatctcctgtattccatgcatactcttccttacctctgttatgtagtaggctgatttcaacttgataagtccaggccaatcaccccagccaacactgtaactcctctcttagcctcttgaattaggaggagcccaaagtttccaggtggccatcttaacttctagtttaatgtaactattgtatctcttggtggcagcattcctccctctggaactaagacctctaggtcagcagaatgtaatgtgggaactggaagcaaaattttgctagtggatcactaggggtgatggtgagtggtgccacttccactctaccccttgattcctggatctgtgaatcttggctatgggagaaatggtaccacatattggatactaattcagagcatacatggtcttctggagaactttgccccagctgtgcaaagtattgtcacctagttggattgtaattgtgacttcaaaaggccattctactgttctatcaatccaattgcttcagggtgatagggaacactggccttggaggaggacaggctgacttggtttctagaggctgagtcctagtgactgcttgtggcagagttggctgtgtggacagaaaaccatcactacatagtatagtgctggtagaactcttaaagggcatccagctcaaccacttggctttacagggaacacagtggagacctggagggttgaatgatattgttgctttccaacgtgtgctccagaacatgagtcctggggagatgttaatagagctccatgacaattggttccacggtctaagaagtttgaaaaatgctggaagcacagatttaaacaggcttctttattgcagaacttaaatttttaagattcaatccgtaatatgaattttccaaagagaatatggtaggcagtatattttccaaacttgtttgaccacaggtttcctccctctttgggggatagaatttcatatgacttatgttctgccaagcatactttaggaaacactggtttagaatgatggatatcatggttggaaggaaagtgaagtcaaggaggcacaaatagaagagcaaagcgagtcatcccgttttggaaagggaaatagggtaaatctagactttatttgactgaatacattcccaatgggaaacaggtcttccaagcacagactatgtgtcaaagaaggctggaagcaatttcaacttctcccctttctacttcagagacttccttcaagttactaaacatctttacgcttcaggtttctcctctgtaaaaatggttaacataatactttcattgaagaaacattgtaaaattggagattgtgtatgcaaagtatcaagtctggtgttgttttgggtgttttagttatcatcagtccaaatgtttagcaggtgtgtatcccctttagaacaactctgacaagagagttcttagtctgtgcttggcaactaatatcaatttattatttcattggccctggctatgataaagcatttctttataacaggccataatctatctttcttctttttccttgtttcactccttaagatcattcagaacaaatcacattcctatatcctgtgaaacttagtcatttaaagacagggtacatagagccctcttagtaaatgtccagcactaagttcatggcaaatccaagactggcatttgaacttatgatttctaggcctctattacatactcaaataattctgacattccctaccaaagccttggttaactggagcactgagactttttactatcttctgcattttaatacagctgtagaaattgttgtttttgctgaaaatgaggacagattctgttccagtgctgtttgttggaaaatgtgatgtacacagtggtatggcttagttgacatcaaagagataaaacttcctacaacacacacgtacagcctgggatgcaaacaattccattagacaatcactcacctctgaacagtgcagtagtatgattgtatttagtttcttcaagtgtactgccaacaattcttatgcttgaaagtagacatccagcacaaaaaggttgtaaatgattgtcctacaactgacctgaatccactctgtcctagcaaggctggtcaaggttgactcttcctctagtaactggaccactccaactacccccagaagcttctgtctataatccaaactccagcttctcatccttctgtcttgatatatttaagtccaaatttgataccactgttattttgttattttgaggcaaacatgatctaccttcatttattattagatatacatctctactctcttatacaatttctacctctactattgtttgtaaaaatcgtatgctattaggacacaatttttttttcagtaatagaagagttataaacatttacatgaaacatgaaaagcaaaaaaatgttttgagtaactggaaacctgtattggagaaacataagcaattctgtgaaataactattatttcttttgtctaattctatagtaaggaattacaggagtttaccaaaaagcaagtgtggtctcaaattttatgtaatagaattaaataaataataattataaaggcacccaagaaatacaacataagaaaaaccacgaataaagggaatgtaaccagctaacatgagaatgagtattaacgggatgctttataaataaagtaaaattttaaattaaaaaataacattagaaaacaagaataaatgaaaacaaataaaccacattgtttttcctctgttaaggcaatacccttatatacttagagacaaacatttgttttcccctaccagcctcctaatgacaagggaggcctggtctcattaacggaataaggatctgaagattaaagaagcataaaagaggaaaatcacattttattttttttaattttttttttgaggcggggtctcgctctgtcgcccaggccggagtgcagtggagggatctctgctcagtgcaacctccgcctcccaggttcatgccattctcctgcctcagcctcccgagaagctgggactacaggcgcccgccaccacgcccggctaatttttttgtatttttagtagagacggggtttcactgtgttagccaggatggtctcgatctcctgacctcgtgatccgcccgcctcggcctcccaaagtgctgggatcacaggcgtgagccaccgcgccaggccgaaaatgacgttttctaaactacaagggacataatttattaaatgatgaagagaaatgaaataaaatgtcatttaaatgattagttttattcacacaaacttcaggcaaatataagtacatagtaagacccatttactaagagaagacgccagtataccactagatttactgaaaaacatgtaaagtgtgaagaatcagggtacattatatcagtttctgaacatataacatgccaaactacacaatcttcatttgaacaaaatgcccatgagcatgcccctttctaagacagtgtagcttctcttacaggacagataaatcattttagttaaatttcctctgtagttgacaatgagccattgccttgtgggtacattagtaaatgtcatttccattattctcactgtttttccccatagctctacaggaagaaaaaacatattaatttgtaagagccagaaccaagaaacaagatcaagtgaagtaaaaaatgaagcatttcccagtagaggaagctttctaggatataaagttgaactatagtagagaattcacaaaggactcttgattctcagaagaaagcaaagcataaagtaaaagtacagaaagcaaataatgtcaatgagcttttggtagaaacaaaacacgtgaaagcctagtaaaaagaaaatcttttaaattgtgagagaatggcaacaggagctaaatattaaaagaaagaaaaataaggagtgtactaaaatgaaggttatggcaaagacaggactatgaacatgagttaaaaatgtgacaatataataggccaaatgtcttttacttttgattttgttttgcctctaagacgaatatatacagaggcctggtgcagtggctcatgcctgtaatcccggcactttgggaggctgaggtgggtggattacttgaggtcaggagtttgagaccatcctggccaacagggtgaaacctcatctctactaaaaatacaaaaaattagttgggtgtggtggtgcatgcctgtaatcccggctacatgggagcctgaggtaggagaatcaattgaacctgggaggcggaggttgcagtgagctgagatcatgccactggactccagcctgggtgacagagtgagacttcatctaaaaaaaaaaaaaaattagtatatactgcaaactgtgaatgtgggctttcagggaaatcaaccaagatagcgatgtattatttcctctccaactaaaaacataggctttgaagcaagtgtactgcagcttttactccttagaactctgggggacaggtgagtgtcccaaaagtgaaagaaaaaaaaaaaaaaaaagaagcagagaaaacatttccacatactatcatgctgaggtttctaaaaaaaatggataaacttgtaaattcacattttattaatacatcaattttaacaatttggtaatgcaccaatagttttacacatctattttaaatccagcacattcattagttgctttacaaatatgccacatacaagatttctgacttcataaaaaacattattggggcaaaagaatatgcagtttttaactttattataattgtaaaatatctaatcactttttaaatgtatatttatatatacttagaatgttttaggcatgtaagaacattgtcaggtttgtttgcatttatagaatgcatttctgatataattgttgagacaatttagtcaaatcttaatttgagtataaatttgaatatatataataaattgtttccaaatagaaggtagttaaaatattttataccaagagttgcattacatttgtctggcattttcaaggaatgtagtattctaattaggtgaatattctagcctttccctttcagaagtccaaacttttgaattttaattatctttaaaagaaatctttcttaaatattacctttctgcacataacgttttctggatagctcagggtcattattaggagaatcaatagctatgcggggttgcaatattttgattacctctgccagactgataagcacttccactgtaagaatgaccatggatgactcaattttcgcattcctctgtcaactttctgtactttctctctgtcctccttcactgtcaggctgtcaatgtgcctgtctccaggagtctccatccccacatctccctaacctgcatacaccattatacacattttcttttaatggtttgctgctacactttaccataaatgagacccctattaaattgaaggggaataggggagaagggagaagttaaaattatctaacctgtatacactctttgaaaattagtattcctagatatccttgaagttagaaatgctaccaactgcccttgttgcaatgtgttacatttcatcccaggtataataaaacttgtttcatctccagggaaaccagatggctgcatcaaaaaggtgttctctggaagtttcatggagaccatttactctcatccttagagagcaggggcagaaatagcaagtatttaatctgtctagaattgatcctgggggacctggcatggagaaatctttctgttcctatggaccagccaaaagggaacagatccctttgggaaatggcatcctccaatgccagatcccagtgccaaagggcaggtttctctcgccaaatacatgccccttgtttacatatggcatggaggtaaaagagaagaaaactcattggaaaattttaactcaaatatgttccttttatctacccatcattgtcaggattacgtcattttgggcctattgtatatcgtttaaaactttttgtttattgacaccacacattgtgttaatttgggttactattagtattcatacttaaaatacacattttcaggtttataattttacccattaatcagtgaaaggaatcaaactttcacatattataaaataatttaaagtcactctaacataaaaggaaaaaagagaagggtaaggtgaggtggaaatcttagcacggaacaattactaattgataaaaatatattttcagtttttccattaattatccttagaataaaggaataataaacaaacctatccttccttatagtttatcaaaaagcagccagaaaatgttagtgaattagctaataaatcccaagtcccacatgtccacatatttacaaagcctttacatttctttaatgagaaaacacacattctagttcctttgttttaaaataagttttggaatttgtatattttgcaatatattgcaggacctttctacctctttcatacgtttaacctcattactttttttctctaactctccactgactttctgtattgaaagcagagaaatcaaggaagccttcataatatttgggagaaaaagagaacatgaaaaaagacagaaattttagggaagggtaattatcattaattcataggtagtaaaatacatagaactttggggtgtgtgtgtgtgtggaaggagtgattgaaggtatagttttgttgaccaaatgtactgttttgagttttagcgatttgatatactatgaattagtgtagggaaaaccacactatgggaatggccatagcaagataagaactacatcccagataaagtgagagggaaacatgtgagagaaagagactcacaatgttaatgatgagaattaagataaagacaaaattatcacacttaggacatgtggttaacttaggactagattctaaggccaaatggatgctgcagcttcaaagtattggcctagagccaagaaagtggatatgccccagagtcttgggtcaggctaaatctctaagtaggggtagaagggttctcattgttgggttagaagaagaaacttaggtattcatccattcattcaacccacctttattgagcactgcttaggtgccagtgattattctaagtttgaaaatgaactgtgattcaaacaaattttctgactctctgagtttactttctagtgaggtacactgacaataaacaaataaatggatacagaataaatggtcaattataagtgcaataaaaaataaataattggaacagaatagaaaatgagggcaagtccaattttggataaggtagtcaggtaggagctccctgaagacctgatttttggatgaatatcataaagtgacaaaaaggaacagatggatattaggaagaaaagtagtccaggaaaatgacaaattcaagatcctgtgtgggtaggaatgtgctggttatttgagaaacagaaagcaggccagtatagctaaaataaataggttgaagacagtgtaagtcaaactttccattttgttgtaacttataatttaaatttgtgctttctgctggtcccgaaaaattcatatttgtagagtgtttcagaatttcctttcatggaatcagttctctgcagccatcttatgtggacaattgatcctgattttgtctggttgctacatatagatacaacctataacggatctaagagaactattagtcaaggaagtactgatactaaattttagtctagtgttatgaatgatttgccataatcatgagggtttccaagccttcaataaggagaagctttcatacagtgtgaatattctataacatgattgcttttaaacataagcagcggagtattttgacaaatattactttataaattttaatcaagctgctcagtatttctgtttacagcatggtcaatagaggcctcaaagtttcagatattgtttttgtgcagtctgaataaaagttgcagtttataaaataattcataaaaccatctacatctgtcgtaacttggttggatatcaatgatttaaataaagtagctacttagcaataaaaatgagggcattggtttttccagtattgatggtttctatttcccctgagagaaataacagacctgaggtcaactagattttactctcctttgtcccccagattaggaatatagaagatataaggaaagaatgtctgcggttttctttttcagattttaaattcaaatacaaaaatgacttttatataataggacatcaggttatagctttcaaatcattaatgcatagaacaaatctctgaaaaacctctgtcatcacattagggcaccattgagaaagactagggtaaataaaacatttgctttattaaggtctatgtgttaaatccaagacttaacatgcaagagccactgcttatatctatggggatatttcagagaaacatggactcttaagttaaaaacggttggaatcaatttcatcaagattctcttgtgtgcctcttatagaatgaggaaatttactgtatttgaaagtcatggagttgtcagatccagtgaatatattacaatatatattcatagctgcagcaatacactcattaaattatgatatattatcagttttgttatccaatttttttccactcagaaaaacaacacagagggtttgaaaatatgcacctaattattcaaggtaaataggttctgtttgttaaagcagtagggagaaatataagtaaaatttttgaagtcatgatttttcttcttcccactcaaaggacatgatttttttctgggtgaatttttgacgtgtttcagattaaaatggagacaactgaagtgtcaatcattagataatggatttttatattgtggtatatacaatagaatactattcagcctttaaaaagcagaaaattctgtcatttgcaacaacatggatggacctagaggacattatattgagtgatttaagccaggcacagagagacaaatacgacatgatttcacttacatctggaatcaaaaaaagtcaaattcatagaaggagagagtagagtggtggttaccagaagctgtaaaggacggagggtagacacatcaaggggaaatgttggtcaaagggtacaaagtttcagttagaaggaggaatcggttctggtgatctattactcagcatggtgactatagtcatcatggattgcatactccaaaatcgctaaaaaaaaaaaaaaaaaaaaaaaaaagaatttcaaatgttctcatcatgaagaaacaacaaatattgaagtgctagagatgttaattagtttgactaggtcattccatagtgccatgttttgaaacatcacattatatcccataaatatacgcaattattatgggtccattaaaaataaagcaacataaaaaagaaaaaagtcactaggagatgtgtacaagagttagtaaatcattgtaattaaagacatgagtgtaagaaaaatgaattaaactgtgaacatcacagtttcagaaccctaggttttacctaataatattatggattgtgagagagtcaaagaagtgaatcctatgcccatgcatactgaccttaattatatttccttcagctacaatggaacaaaaaacttacagaacaaacagtaaacaggttaatattgtagttaaggtgtcagagcaagtcacttcattttctgtgatattagtctttaagttaataattttatatgatttatatgataatattaaaatcattagttgcttatgtcagtccttctagtctctttggggagaaaaaagtgcttagaaataggcatttacattgcatatttcaaaaaagctgggctcaaaaaattcctaaactgaaagcgaattgtacttcattatagaagacaatgacacttccattcttagtgccttacattggaccaacatagcatgcaaaaaccgtacactatctgttgataactctgaacacaaattgaatcactcaccaaaaaattctggcattataaaaccttaaaggggtataaaacttcactatgttttcttctactggtcaaataaacatttagtgagatcagtaaacggtcagtgttcctaaaaagtacacccaaatgcatggcctagaatcttccacaatagaaatattaccagaaacaggaatcaaaagacaaaaatgctataacctggatatgtaaaaaacagctggacccttttaactttaagtgccaagaatctactgctgttatgaaggttattacttacacagtaaaaatttcctcttgtaatagtgtgcaaaggggaaaaaatgaaatcattttggtcttctaaaatgacaaaaatcttagcatcaatctaagcattgacatgcctttcaagaaatattatttatatttcagtggatagaaatttgaactgatagaagaatggttttgctcaagatgatctgtggtgccaataatgattttttatgagtatctctttatcacccaatgctatcttgattgcagattcaaaatctgagattaaaaatttcatcaatacatcaaactatgctaaaataaaagctgattttagctagtaaaatgaaatagatttgtgtagaatttgttatacatcttctgtcatcatagcagtgtttagcttaattgcctagaaaattatttgtatttaatacttaaatttctataggattttatgtgctacatcatgaagtacagcactccttcatgtagttatgagaaaacttgaatttcacagtcctcttaataaaattgctcaagaaacctggtgtgctgtttgcagtaggctcaagtctatgtgtatactagggtccacgattataagaaatcacatcattaggaggagggaaatgtcgtatttgtactatgttgtgtcagatgcctaaataacttgctggtcttgattcgatcctcttaaaaattgggacaatattacaattgggcttatgtccacttaaagaaaacatttaactctaggatcaatgaccttttcaatagatagaaaaatagctttattttaaaaacaaaacagcctaatatggtagcagatgttacaacagaagtggtgttctggaacttagttgtggattatctcagtaggtgaattaaatgaaatcaatccaagcacagatcaggggaggtaggtttagttaatgatgacattcagaacacaggctgaggaagacaactgctgtaagtggtgagtgaaatcacgaatgtaaaatcacagacacctggaagaagtaggtcaggcaggattcgctgacttagaggcctggttaattcagcactttggacagttcccaaagacctgtcttccttgcaggtacttggagtacctaacttttagagtgccatacttactaatttcattccacctcttggcatctcacctttacctgcaggtgaccttaaatccaagggaattatctgcattcatccaaagagctctgtggtctgtgttcacaggaagtcaacaccttcagtcctaacatgaaggttcatagtttctatgttacttgagagtttgtcagactcatcagtagtgcttattaatcaataatggattattaataatcaatttattaacaataaaattcgtcaactaaattttaaacctgattcaatatgaaaaggtgaggatgaaatcatccgagtcatggaaaagagtccctttaccaacacctgatggttactatcatggccaagtcccccaggcaattcacatgcaaggctattcagcagatgttctatatcaaattcaaatgagccattcagaattggggggtggaagcagaagaaaggctttaagaatcaactaaaaccctacctacagccatgtggcatagctatagatggtaactaaagcacattaagcccttccttgcaggctccaggaagtaacagaattgctcttttggaacaaggactttaagttaatttcttaaaaggcttaagaggcaggactacaaatcaggacaatctatctgatttctaaccaaaggacaaattatgctttagccacatctatccacaaagtttaaaatgagaattagcaataataaaaaggcacacatataaaaataaaagtagactttcctcatgactatttttcggatgagtgtttcctgttctaaaacccaatggtgaggctgaagcatagaaacaccataaaattggctttctctatgatgagcagcttaaactagacattttataaaggactctcttgatctttgtgaatagaaaacacaaattaagtagtttctaatatccctgacaataaatgcaccaattttggaagcatttcagatgagcaagaagaaacagggtttatggctctacctccagttacattagcagtcttgctgctctggtttgtgggttagattctgggaccccctttcagtcttatggatcccacatagttaacagaaggtctgtaatcttaaggctgagagtaactcaattccttcttattttctttggtgtattcacagaatatcatagatgaattttctggtctgacctagaactctaaacaatactgcgaaggcatgagactgcagtaggcgaggaggaggaaagggaacaatgacctaaacactgcagaagggagaatgtgtaatttaaataaatgagactttttattaaaggaaccattaattgctaggtttttcaacataaaagttctcaggtctttgtctagttgagtagcacagaattctgtatatcctgaaagtaccaacagtgcaaaaagacattccttagttttccctgacaaaatgaaaacaaaaaacaaaactcccaaaaaacacattaagtggtagccctaggtctagagcttatgacaagtagtgaagaaatgcagcaatttttattgggtgaattttgctagttcctcagctgtagttacaggaaaatctgaagatcctgaggtttgagaacattccctaagtgtttacccaggtcattatgtgacttgagaaaagagattcttattaatccatgtatacaatgtgtatttgtaagcaatggtattgatacaattgtcaaagtcttatatggaagtcagcctcactctccaataatcagctctatgcacactaggccaattaagatggcaccaaacccagcaaactaaagtgccagtactgaaaaggtgtctgaagaagattcagagtaacccattctggctcacaaaacttggttatgttcatacagtttcaggatattactttcaaaagtgaattggaacctaaagtttaagctgtattttaaaatactgatattaaatgtcatgacatctagtgtatcatgagaacaatggaaatttaccattaacatttgacataatttttcagcttatataaaatcagtttagagagtctttatttttacaaacaaaaagtcatattgttaatcatgttactcttttaatgatctgatatgttaagccattggttcattcttacataagtgatatttaaataaggttgtaaagcataatacattatattaaaatgtgtgcaaactaatgaatgttactaaataaagtcacaaagcccatgggaaattattctgtaaaatgtattatttaacatctttgataaagttattttctatgatttacagtttttttcatatatagtttaaggcagctttatattatgaacacaacttctttatttaaaatgttttcaataaatctctactatcttttatttttgacaatatgaagaaggtacagcactaatgcataaaactgtttccttttcctgggtatttttgcctatttcctgtaaatgtggcaagaagcaattaaacatctcagccgcaatttaggcaaatgtctccacctagattgccttataaatgctaatggaagagattttaatacttttaacaacttcaaaatattgagttcttgaataactacagttcactaaactaagaacagtcatgcattgtgtaacgacattttggtcactgacagaccacatatatcatggtggtcccataaagttgtaacggagctgaaaaattcttattgcccattgacactgcagcccttgtaatatcatagtgcaatgcatcactcatttgtgtttgtggatgttagtataacaaaacctaccgttctatcaattgtataaaagtacagcaacctcactagcatctgttgttttttgacattccaataatagccattctgacatgtgagatggtatctcattgtggttttgatttgtgtttctttaatgatcagtgatgttgagtttttttcatgtttgttggccacttgtatgtcttttgaagtgtctgttcatgtcatttgcccactttttaatgcagttatttttttcttgtaaaaattttttaagttccttgtagactcaatattagatctttgtctgacagattgagacattttctcccattctgtaggttgtctgttcactctgatgatagcttctttggctgtgcagaagctatttagtttaattagatcccatttgtcaattcgcttttgttgcaattgcttttggtgttttcatcacgaaacatttacccatgcctatatcctgaatggttaatgaaagactggataaagaaaatgtggtacatatataccatggaatactatgcagccataaagagaaatgagatcatgtcctttgcagggacatggatggagtcggaagccattgtcctcagaaaactaatgcaggaacagaaaacccaacactgcatgttctcacttagaagtgggagttggttgatgagaacacatggacataggggagaaaaacccacactgggggccttttgggcgggtgctgagaagagggagagcatcagaaagaacagctaatggatgctaggcttaatatgtaggtgatggggatgatctgtgcagcaaaccactatggcacgtatttacctacgtaacttaaaagtcgaagaagaaaaaaaagtatagcacatacggttatgtatagcgtgtaatacttgatattgataataaatgactatattactggcttagataattactgtattttactttttattgttattttaggagtgtattccttctacttattaaaaaacgttaactgttaaacagcctcgggcaggtccttaggaggtattccagaagaaggctttgttatcataggagatgacagttccatgcctattattgcccctgaagaccttccagtgggacaagatgtgaaggtggaagacagtgatactgatgatcctgaccctgtgtaggcctaggctaatgtgtgtggttgtgtcttagtttttaacaaaaaagtttaaaaagttaaaacaattttgtttgaacattttaattaaatggattcatttaaaaatactataaaatttgacatcgagagataaaaaaagaaccataagatttaaactgacaaatataaaaatgattggctacaatgtaaaaatacatttcccagcccccagagaaaacataatttaagtatagtaattataaaattaaaacaattttaaatagaaaaaagcttatagaataaggatacaaagaaagaaaaaatctttttgtacagctgtacaatgtgtttgtgttttaaacccagtgtgattacaaaagagtcaaaaagttaaaaaaaaatggaaaagtttataaagtaaaaagttacattaagctaaggttaatttattattgaagaaaaaatagttttaagtacatttaatatagcctaagtgtacaatgcttataaagtctacagtagtatatagtaatttcctaggccttcacattcactcatcactcagtcactctgggctcacccgctaatggactcacccagagcaacttacagtcctgcaagctccattcatggtaagcaccttatatagctatactgttttaatcttttataccatatttttaacttaaccttttctatgattaggtgtgtttagataaacaaatccttaccactgggttacaattacctacgtattcagtatggtaacatgccatacaggtttgtagcctggaaataacagattacagtacatagcctagaatgtgtcaggctgtagcatctaggtttgtgtaggtacattctatgatattcactcaatgatgaaatagcctaaccatgtgtttctcagaagtatccctttcattaagagacacatgactataaatcaaggagaaagtagagggcccaactgttaacgtggcaaacccagcttatttgatgatgtttggtgaactttgcatgtatgataggctaagcagcaaagtatatatcatgaattttgtttttaatatcactattagttgcaggttaataaaactaatctttcaacttaataatagcatctgtacatatactttgtaactgtgaagtaggaatgaaaaattattttctacttttttagttataatttcattatatatatacacagatacatattttcattagatataaactagatgcatataaatgttacccaaattgataaatgcaatcatatcaacatactgttacttatttgtatttttaatgccatcattccacttttacagatgagacaactaaggtttagtgacataaactgttacttaatttttatagcagataaataatgaagcctagtttgaaacagagattttggcttatgtttcagtgcttcttccactgaggcatatttcctgcattcaaggttttggtttcatttgctgttcacatttgatttgggtacacaaggagatttctattgtggtagagctttggagttcattcacagatcatatttttttctaccccataatttcgtgtaggaggaaactgaaggccagtgaggtagagtaatttgagaaagccacacagggataatgacaggactagaattctagcccttccttcttttagatgacatcttgagataaagacgttttatctgagagatcacagcttaacctcaggagacaagcacaagaatacttcaatgtgtgtgtgtgtgtgtgtgtgtgtgtgtgtgtgtataaaataggtatatatataataggtgtatatatataaaatataaaatatttaaaaatatatatttttctccaggcatattaaaagtacacttaattgagatgtattttaacttttttaggatacatttctaaactcatcttattaaagctctcaaacccaaaacagcccattagtaacctggtgtccccgtgcatttccatcgaatgagaaaaatgtgatgccaacaagaaagatttctcaggaacgttgtgcttaccttcataagtcccactttctaggagagcaccacttttctccaattccataaaatcttcaacagtgatgaaaatataatccactccagggacctcaccctccttatgtggccttgtggtgcctgaataaagaaaagtaaaaacaaaagaaagacgctaagtgatttgttgttgaactttagaaataccaccatacttctgaatattcagtgccacttgtttgtacatcctgcaagttggcagtttgcatttgtccttctgtttgtttggcaacagaaaacagcagggggtaaagattaaagtaaatgtacaaagcacttttcttcatcaagcttataaagagttcattgccatgggatatggctgcgtatatttttcagtgaaaaattcagaacattgtgccctttttgaagaggtggtttggatattgagccagcagtctgctagttcaggaatttatatatttcactccatgaatgaacctctattgtcctgcagactgctgtgctatgacataaaacacaatggaaagtagcgatcttaggaaaatgtcaatttatctttttaatttcataatctgctttcttttgggaggactgtttgttggttttcatttgttaaatttgcacccagagccatttttatttgatttaaaggatcgcaaaacctttactattacttaaaattaaataattagaattgtgtaataattaaattgcagtagtgtgaggctgggaatatagtatctaatctgacaggagaaaactttctctgactccatcacacaggctctcccttatgcggccttccttctttcattactgcctctaattctgactgaagtgactcccaaccaagggttactgcatgggaccactgttcctgactcctccatcacccacagagggaatggagctatgacggccaaggtggcaggagtatcagctactcagactgtagctcagtccagctctcctgaagaacacagcctcccaggcatgctgtccagtttgtgaggcaagagcagaaacagagacatcttcaaggctgcaggtttgtttccaggtaatacttcctcccttgaatatgccctaagcttcttcctttttctatgccacctacataggcattttgcatggtcagattggaatttacataatgcatacatgcaaagaaatatatagaagccagatatataaggtagtacattggcaggcttcatatatatagactcccccatattgtctatatgctaaaaaagtattttaaatccttaaattttatttttgttctctgcatttgaaatctttatcaactaggtcatgaaaatagccagtcggttctccttttggtctattagaataaaatctggactgcaactgagaagcagaaggtaatgtcagaatgtataatatgccagggaaatttgattttggataaaaatgaataattcctattgaaaacattttttaagatttgaagttattattttctaaaatcaagttttataactcatctttgggggctgcaaaaacaatttttttccataatcatgtttaatggctttccctgaattggttattttgtttagctgagtcacattttgcaatatttcctgctgcttttatgctataaaatataaaccacctacatctagtatgcataatattgtcaagttaatgtttctatgagaaccttaactttcaatattctgacttttatgtgcttaacccttgtgaattaaaagtgcattaacatggtttttggcaatcaatttgtttttctgtttatttagaacacactccaatcattaagaaaaaaatcacataacaaagactcaattttccttactaatttatctgcatatttcagaagctgcacactttaactgcttgcagtatggcaatgcattcctagcaccacgtgagcaccaggatcacaagattgagggcaatttccagggctgctgacttgtttggagtaacatggctgtaccaaattttagtgaacatttgtagttgtgctcttcttgggaggcccatcagtactttcggttcactaagtggctttccatctccatcttgcacttcagacctctgtgattgagttcttccttctgtgacaggcaacatcagtgagtatcacctattgctattgacccaactgatgctggctgcctacttggactggcagttcacctacctcattgtggcttgaagttctgctctacaatctcaaatgctgcaacctccatctttgacatcagtttctgatccttttttcctattctgttcttctttctaattatgatctctagtccctgatctcttgtaatttccctgatgttccccaaatctggctttatttgcctccctaactactaaaggactatgaaaaaaccagaatctcttccttcctttagttcaccttcatgattaccccactcataattaacccccatgttcactgttggttatttcattactgacagcagttgctataaaaaaacaaaaactttctctgacaaagtactccacaaattcagattacttaatgtcagtttgatcctcctgatgcttggtaattcttttatgtgtgtcttcttgtctctctctcttatattcccaacattttctatattcaactgctttgacgttttgcagaagacatgagctcattctttcttggtaaagagacaatctgaaaccaaatttcctaaagtttcctaatttttcttatctgcattactctcgtatttttccttcaaaattaagcctttattggaattatcatccatcttgctaagacaaatttcttttcctttgcttttagaattttatattttaaatcaaataatttaaattaaataaatattttatttgtcaaagttgcatatacagatattttaagtcttcaagcaattctataagacttctgatttttaaaaagcagaccctcatcaccacccagcccctggaagccctttctttttatccagagaaaaatacactgattttagctgattactttgtttaacccccaaatctctaaatactttaagatgcctcttgattctttactttagtaattttttcttgattttttttaaaaaatgagagtttaactcttttttttgtctataattctaaccctactgcacataccacttcctgcttttcttccattcttctaacggaacaatcttgtgtttagattagtgtgaagtgtttacattattaattctatgtaaatctattcccagctgaaatgtggtgtactgactttttgtgtttaacttttttttttttttttttttgagacagagtcttgctctgttgcccaggctgagaatgcagtggtgtgatcacggctcactgcaacttctgcctccagggttcaagtgattctcctgcctcagccccttgagtagctgtgactataggtgtgcgccaccacacctggctaatttttgtagttttagtagagactgggtttcactgtgttggccaggctggtctcaatctcctgaccttgtgattcccccacctcggcctcccaaagtgctgtgattacaggcatgagccactgcgcccggctgtgtgtaactttttgattactctatatgtaatatgttttcatttccattttccattcattaatcattaaataaactctctccttgagagataaatctcctctcaaaattcacaaatacattttatattttatcaagtttatcctattgaagaaatctttcctggaggcttctgacatgctccagtctggactctcagctgccatccagggatcatcctttgccatcatcctggggagtcactttgcctctgtcttgtgcagtttctcctcttccctagaccccatgtctatttttgtggtctccatcctcatggtggctgagcacatctgttggaagcttcctgtcgaaggttgcatggaagccacattgtttgagattttccaagcctgaaaatgtctttattacaccctcactagtggcaaatctgacagcatttcaggaaaatgtaatcatgaaaatgtatttcttcatcttgctcccctgttcatgccaccaccattcttctagttgtgctggtttgaaactttcacctcagagtcacctacctttgagtcctccctcactcctttatcccatctccaaatatttggcaagttctatgtcccatatctccacaacatcatccttccgatctgtactgtctctgatcccagcacctccctcctggaccaggcggtggctctgtcactggtgtgcctgcctccttctttcagttcatcgctgctcttcctgatgagccctggtgaagcaccaggctgatcacatttcctctctaaaggcttacctacccaatctatggtcaagagagtgggttgaaaaagggagggagagaaaaatactgagagtcaagaagaaacagagaacgccatggttctattatttacaataaagcacaactctcatggtatgccagcttgtgcagtttctttacatgggcttgccttgatggaaaatgtgagaagacataatgtaagaattttctgtttctgtactaccctcctttctggctcgtcatgtgtcattctactttctctttaacctaaaatttccaccattagaattactctttggttcagatgaaggagaaactacctttaaaatgtatgatattttgaaagtaagctgcttgtgctgtttgggactcagccacttgttatcagtattacctcgagcaaggttctccacctctgtaaactctagttttcttatctgtaaaatgggaacaatagtagtagcatcttcatagggctaatgtgaggaacaaatgggataattcatataacatacttaagacaatgtctggcacattttaaatactcaacaaggattattgtatgttaagtactattgcctcgaagagcagaaatgatttttttaatgaagtcttgccataaatattaactgagcacttactatgtgccaaacactattctagatgcttgagctatatctctgaataacacagactaagattcctgccttcatggaactaatattttaatagggagaggcagataataaataaaaaataaaaagttatatagtatgctataaagggttaaatcttattaattgaccataaatcagactgttagaacctatgcacaagttagtgggtcaaatactgagatttctgttagcttagacagtatggagaaaagggtggaggagaagagactgtgagaaaaagacctgaaggggagcagagacccacaatacttgtaggctgtacactacccaggtgagtgttagctaagtgggagactgctggaagtcaacaggggatccagaaagagcctggttatattttagaaagaatcactacatccttaaagagaaattccacttatttcacatattgcttggattagcttaggtcatttggcttaacatcttggcgcctcatacaggtatttctgaactatcaaaatcattttcaaaggataaacatggcagtgcatggtgtgttccaatgactggtgtatgtgcatatacacagacacttacatgtcaaccctcatttttaaaagaagaaaatgacgaggttgtgggaaaagggaacacttacacactgttattagagtgtaaattagttcagccattgtggaaagcagtatggcaattcctcaaagagctaaaaacagaactaccattcaacccagcaatcccattactgggtatataaccagagtaatataaatcattctactgtaaagacacgtgcacacgaatgttcactgcagcagtattcacaataacaaagacatggaatcaacctatatgttcttcagtgacagactggataaagaaacatggtagatatacaccatggaatacgatgcaatcgtaaaatgaacgacagcatgtattctatgggaacatggatggagctggaggctattatccttagcaaactaatggacgaacagaaaaccagatactgcgtgttctcacttataagtgggagctaaatggtgagaacttaggaacacaaagtaggcaacaacagatactggggtctacttgagggcggaaggcgggaggagggacgagggacaggagcaaaaagataactattgggtactgggcttagtacctgggtgaggaaataatttgcacagcaaaccctcatgacatgagtttacctatgtcacaaatcttcacatgtatccccagaacctaaaagtttttttttaaagtgagagaatggctgggggcggtggttcatgcctgtaatcccagcactttgggaggccgaggcgggtggatcacgaggtcaggagatcaagactatcctggctaacacggtgaaaccccgtctctactaaaaatacaaaaaaattagccgggcgtggtggcgggcgcctgtagtcccagctactccggaggctgaggcaggagaatggcgtgaacccggaaggcggagcttgcagtgagcagagatcgcgccactgcactccagcctgggcgtcagagcgagactccgtctcaaaaaaaaaaaaaaaaaaaaagtgagagaatgctgtggtgtgataaaatggtgcgataaaaaggttcttagattaaaaattgaggacatctacattccatttttgttttaatgttttacatatatgattctagataaaaacagttcatcatcgattttcttatgcactgaggtaaataatagacataaaagggcattataaaaagtaaaagcataaacaccatgccaacaatatctgcattacttttaagtaatattaatagtgctactaagaaaactacaatttcacaaatatcattggtggtatcttacttttggagtgtattataatcaaagctttaaatcacttaacttcactcaggctaacacttataataaagaaaaaaaatttatgcttgaagaaacaaattgtcttttttactgtttgagtatgaaaaaaacatgagtcaagatataaatccattttgtctgattacacagtaagatgtagtacacagtggcttggtcactagttacaaggatccttttgtcttttgtagacagtcatgtaaaacagctaatgcctatggcctaggctgctagaaggtttttgccatttgctgagtcatttgaaaagtgtgaaagtgctcacaaaacctgattagtaagtaggtcatttaattttacctgcaggcatagcacctacaagagtcagaaagcattttagatctatgtgtctgggaagaaaggatattagttgatgttacgtcaatgggcaaggcagtggctgaagaaggagaaagcaattggaaatctgtgaacacctctttggaaagtagtatgattctaaaaataaggaaaatatatgtgatatgaaatgaagtgttgtacaatggtaatttgcagctaaaggtaattaatatctagactggggaaacaagttaaatttcttgaagtggttacttacttttatgctgaaataattacagttgcttttgcaactcaaaagatgatgaatagttgacagcaaagcaagactcaacagtaataacaagtaattatctagcactagaaatagggtggaagatgtggagaataaaagagggaatatagatgattcatcatatagctgaagctcaccttcttttattgctcttctgttttggttgggactttcctaagtggtgtataggaaagtccaaaataagttttattatccaaattataatttatatattttattcttattatttattccagaccactcctccaaaggaaaaataaatagaactgaaagagcaaaaatgctaagttgaggctttgtttcatcttttagtaattaatttcttaaacaacagcttatttattaattgctaaattaagtactgtatgaacaacacctccttcatgagttaatgaaagcatacagcgtttctgctcaaaagacatgtctaaacaaaatgcattatctcccaaatggttagcttattgatacacagtgaagtcacatggaagcgacttgtcattttgctaccatggcaactgggagtgccaatggaatttttttattaacctactgtttaaatgaaggaacattgctcttttttgtcttaggaagaaaagggcatttgtggtaaatataattctaaagcgtatttcccctcagctttctgctatttcctagtttgagtaaaatacttttcttcaaaagagtcaccagcttgacagtattattacttagatgatggctcagtgcagtcatctattgtgatctattctgatatattaaaaattccatagtgcttgccgcatggcaggtacccaatacatatttgctaaagaaacagacttggaattaatcattaagtcaatgtattctaagcagatgggtcattgtgtgagaatgtgagaaaatgaattctgttcttattcatatattccccctttcttcttcctggtgtttctcaactgcaagctggaaaaaatagatcttgacagctagggtgacttcctctgtatttgacctttgattaactatctcttagattcttgaagacacttaagttggtcacagttactcatcagcaagtaagaacacaatcatcagatttgtgtatgctgccaataaaaacatacatccgatagattcctttggccaatgcctgtaatcaatttttacacaaccagcctaggccttgggttttattatactcattttcaatcacataaaatcccaaagtatggttttatacaaacatagagctaaagtaagcaaagcaaataatatcgtttgggtcactgaattgtatgtgattgacagattataaagtaatgtaggccttatagatttcctgttaactgatggggtggattggtttgaggtaaaaaaattaaaacctacaattcaatgaaataaatcacttattaagtataaaaattattaatagcctcaataaaacactatgcacattttataaaatattgaagatttgacaaatccatttgtaaaatattggtagttaatttgacttattttcttaacagtgtgttgctttaaacctcagtaattatttcaaaactctcttcccctaagataacatgttgtcaatttttgtttaaagcagcactggcatatactaacaatgttaggtatcttccaaaaacaggcttttttttttttttttttgaagaagaaacctcactgaatatcttggatataaaggttcaaaatagtgccccatatggcatcaattactgttttaaattttaacagtttggattgaggaagcatcggacccaaacttggtgtttcttaaaacataggctgcatcaaggccgggcgctgtggctcacgcctgtaatcccagcactttgggaggccgaggtgggcggatcgagaggtcaggagatagagaccatcctggctaacacggtgaaaccccgtctccactaaaaatacaaaaaattagctgggcgtggtggcgggcgcctgtagtcccagctactcgggacgctgaggcaggagaatggcgtgaacccgggaggcggggtttacagtgagtcgagatcgtgccactgcattccaacctgggtgacagagcaagactccatctcaaaaaacaaaaaaaccaaaaccaaacaaacaaaaacaacacacaaaaaacataggctgcatcagaaccatgtggaggacttgttaaagcacagatagctggttctcactccccagagtctctgagtcaccctgctgcggtggggcctgattatttgcatttctaacaagttttcaggcgatgcctctgacactgcgggtccagaaaccataattggagaaccactgctccaatttcactcatagctcagggaacccaaaataaaaacagtgttaaatttcctcatcaaatataactacaacaatccataaagcatgcaggtcatgactttggcattggccctggagtactctatagccatgtaccggattcacagaaaataagccatccttcattttctggtgcatagatgaacagagtcatgaggagtatttttcatagtgaagtgttctttagaagttaaatgaatttgggaaataatgcacctatctttatttatgtgtccttataaatatctttattatttgaagtaatataaattattttggctctatctatgcaacagtatggctgatattgggaaagacttaggagcttgactatagctcaccagcagtgatacatgataatatgttaaaaaaaaaaataagcatctaatgcagaagatctctcatgaagaaaaactatggtggatgtcaaaaaatagatgacaaatgaaaaatctgtagatctccaaaaagtaagaaataatagcattgcattattttcatataccaagctatctgatttgctaaatgttaaaattacagcttgtttacaactatacttatcaaatgaaatcaggtgataggtaacatacactttggaattagtactcataaagctctctgttataacaaattatttaggccaccatattgttttattaattccatagttttatttgcacaattaagtccctggtgtaaacactagagtaaatgaggggtagatgtgagaaatatcatttaaaacttgaactcagccaggtgtggtgcctcacatctgtaaccccagcactttggaaggctaaggagtttgagagcagcctgggctacatacagagatctcatttctacaaaaaatttaaaaattagcttggtatagtggcacacatctttagtcccaagtggaggattgattacttgagcccaagaggtcaaggctgcagtgactcaagatcatgccactgcactcagcctgggagacagaacaagaccctgtttcaagaaaaaaataaaaagaaaagaaaagaaaaaaaaaagaaagctgaactcatcacctgaactaaaaaacctgtcatactgagcaagaaagaaagacaatgtctggggtgatcacttttgaagttgatgtatatgcaatatattttcaattttaaggcttctacagtaaatgaccagatttaattaccaacagtaccaagattccttgaccactgatatacaagcactctacactgaagacaaactagggcaaagtgaatgatttcatttattcatacatttgaatcatcactacattggaaacaaaagatttgtaccctaaatcttatccattccttcacaccaaagtccatctcctctacccagcagatttccaaagaaactttggttgcataaattactttcttcatgatatttccatctttacctcacttgcattcacagtacagaattattcactacttggatgcagagacataaataaaatgactcaccccaataaaatcagattccttggtagctatagtcttggcttttgatccattcttacaatatacaggtataacatacctaactaactccaggacagatcaacactgcattctcaccaataaagtagggcaaccaaccataattccaagattcttgacttgactattaatttcctgaattttttaagagactggaagaagacaaatgacccttttgttaccaattaatttatttttgaacttctgattttaattcaatatttaatttagatatgttctatatttggcattctatagaattaataaaaggaggcttttgattccctaatttattatttagcagataatgtttcaagattacatattgagcttaaggaaaagaaagatcagtgactttctatagaaacaatatatatttagtttgaagcttttatagtctcctcatgtaaaattaatctgggccagaactagactgtgtggataccaccagtcctctaagcaatgcagacacactactcagtgaccttcatcgcatggaaggtttagtggatcataactttatcattttatcactgttagaatcttgcaatgacattaacttttagtatcaccattatgtccctatggcatctatattctgaaatgcccaaggtagatagtagaatacagagtctacagagtatcagaaaatccagatgaaagaaagagggcagttaactatccagggatttcaattatattgaaaatgcttttcagattatatggcataaatcacatgtctgagtgatcaactattttttttattgaggctctcaagtacacacataccaaattatcatggagggaagaaacaaagaagagagggaggagtgaaatattaatgagtacccactaggagctttggatgaggtgcttttattcttgctttaaatcttgagttgaagaataccctgtgcatctgatttatcttatgttcacgatactagctattatattagttgatattttatcacactaaatcttattataaagttgatgaaaagcagaacaaaaattcacaactcagcttccttactttaaaaaaattacagaattggggatattataacagaaatatactcggctatagctgacagccccttaattccaaaacccacgtctgtgagcattcatatgtagaaaacatctgtacatattacagggaacaggaaattctccccattcaggccagtgtgactgtgggccagacactaaatgttgagtggcatggcctggctccccctcaagaaacttaggaaaaaagagaaaagtgacttgttcaaatcaaataatcagcattctgataaaaaagaaaacataagtatccagattttcagcctgtagataactgcatgcctctgaagggataaaaaagcgggggtgcaggaggcagacagaatatgatttctgccttttttgagattttagtattcgacacacaaccagcagccccatggcctagatccatatggtcttttaggcatgaagggcagcaggactcagtttctattcaattgtcataatccccagaacactgtggttttaatctcagactactgtatttccttcctgattggagagcaaattaaaagtgatacaatataaaggaatgtgtattgtgaactgtcaaataatcatttgagactcctgctggaaatttttccataaaactatcagaataaaactatcctgtaataaaaaaacaaaaaacaaaaaacaaaaaacaaaaagcacttggctctacagactctcaaatcactgttgctgagaaatgcaattatcatcagagagtaagggaagttttaggaattaaaaatataaaagaaaattttaaggaaattttaaaagagagctaattaaggcacttctggcataagagatattgagttaatagtgagttatcaaaataaatactggattcttcagagaaaatgtttataattttagataaatctttacctcctttagagagatcaagacaacacacttatttgccaggactaatagagacataatacaaaacagaggggtgaataccaaccagtagcatcagcccagcagctgactcagcatcctacccctcacggggagcaactggctggagagttcatacctggtagggtgatggtgctctgactttcagacccaaagtattaagtatcactgcctaaaagaaggggcagagcatcctgtatttgaaaaaactagaaaggctgaggctggccaaactaggctatggggcattagtgaatccatgttagaataaaaaatgtgcatgatatagtttggctgtgtccccacccaaatctcatcttgaattgtcattcccataatccctgcatgtcatgggagggaacaggtggagataattcaatcacaagggcagtttcccccatcctgttattgtgatgatgagttctcatgagatctgatggttttataagatgcttccctgtttgctggtcactcattattctccttgctgccaccatgtgaagaaggacatgtttgcttccccttccgacatgattgtaagtttcctgaggcctccctagccctgcagaactgtgagtcaattaaacctcttttctttataaattatacagtcttgggtatgttctcatagcagtgtaagaatggactaatatagtacatatgtttaacctcctggaaaaaggctgaatagctatttatctccccatttagatccaaactattcctttggattagagttcagcaaatttctaaaagaactagatagtaaatattctaggctttgctggccatactgtctctgtaataactactgttattagagataaaactggacacataatacataaacaaatgagcacagctgtgttctaacgaagctatatttacaaggtggtggacagatttaacccgtaagaagtcgtttgcccacccctacattaggttttcgatgctttgtgtcttcatgatcttgtctcctagatttgtacttgtaaatcaacaagatgcaacttcagtgccagcatttgagtgcactacctcaagagagaaaaatatgaccatttctgttggtgtggccagcattaagtgtaacatttcatgtgtcaatttttttttaaacttcttcaaaacaaccaaccaggtagctttctaatacacagaaaaaaaatgggggaaaatatctgtagaaggatcatagatatttggtctctcaagaagcaagagaggattgttcttatgcaatctttgaaataatatgaacaagaaattgccaggggaaatacgtgttttgtgaggctgatcaagagtggaaacacatctgttcctataagtgaaggagcttctccttcagtattgactgagggcattgcatcttttagtggtaaataacagtatcttgttgaccttgcttccattttagggtataattatataagcaaatcttctgtgtgctaaggaatttaccagacatttcatacagggaagaaacatggagtctgtaagtgctcctgaatattacatataaattttacgctgttgtatctgtaatatcccatgtgtatgttacatggtcaccatagaaatcaagttacttatcatttattggataaagcagtattcacagtaatattttatgtttgatagaaaatttgtcattacctgacataaagattagcagttacatgataaagttgtatatgaacaatatgcatatacacatagcttttaagtttaggaccatggttcagtaaaacgagcacagcatatgaaaataaggcaaagaaaaagaactatcttaggttaagcattccaagatatttgattctgtgttgcattgcagcaaaattttgaaaattgattcaacaggagagagccctctagcaagactatgtgctaatttttaatatattcagtaatcatttaggagccctcaattttttcttttacaaatttatcatttgtccaaatatatatgaaatgtttcagaatgaatatcaatctagtggaaaagagagaaagacatggctgacgaatatgtcaaagtaaggaattatatgagaaatttttttatgtatataatattcacaagcactaatacttattgagctctgaccttatgggaagcattgtactctgctttttgcatgcattatctctttcatttttctgaacaactggatatggtaggtggcattttactctttttataccttgagtaacttgcccaagtggcagcactaggattcaaacctgggcagtctggcagtacaggccaggcttctaagcaatggtgcactccaccaacatccacaaaatgttctaaaaatttttgttgtgggagatagatgagagcagcaggtgggagtgtgggtgtgccttgtgaatgggatgtgggcagccaccacttggcattcagatagaatctctgccaggaaagaataatgaaactgggaatcaaatatcctatggctatcccagttactctgatttgatcattacacattgtatacatgtaccaaaataacacaagtacctcttaaatacatacaactattacatatcaatttgaaaaatatatggagaagcagagggaagtaagatagtctctaaagtgttgtcaagttagagtaaggatattcagaaaggtaactaagaaatgccaagaaagtagctggggtgcaccaaggactgatatctttggaatgaaatgtccaaacttgttgaattaggaagctacaaatatttaaaaagaaatacaagtgctctgagcagatgaaaaagtagtaattttctaaaaatagagaaatgataaaatattaataattaggtaaggctctagtttgccaggtcatgtgccccctttacaagtcacataatagaaatgacttgtagaaatttcaacaaatatatatttgaggcctataatggctgacagacaaaagtgaaataaaatctatttcatcatcctggaggactcaagttattaagatacacacaattgcagccacctgtataacaattattttgagacagttctcaaaatgataaatataaaatatatagcttaatccctttaaaagataagagatggtttaaagtaaaagtaataacaatatagtgaattaaaatatatgaccacaatggcacaaggggtgggggatgggaatggtggcatactattgtaagattcttaccctatatatgaagtgatgtatcatttgacggctgactgggataagttaaagatgtgtaatagaaagcctacagcaacatctacacacacacccccacacacactattgaaaaatggatcatccatttaaaagagcaaaactcacctatatgctgcctacaaaaaacttactttaaatataataatgcaaaaaaagttagaagtaaaataattgaaaaagctatgctatgcaatgagcaaatgaaatttataataatatcagaaaaagtagattttagagcaaagaacattaacagtgataaagaaattcatttcaaaataataaaggagtcaattccttaacaggaaaaaaaatactaaatgtttatgtatttaattagagattcaaaatacatgaagcaaatacatggagctacaaagaaaaattgataattccacaattatactgagagatttcaacacttctcttttaataattgataaaacaagtagacagaaaattagtaaagttatagacctgaaccacactatctaccaaattaacctaattgacatttatagaacacttaacaatatacactatttttaattgcacatgaaaaatttataaagatagaccatattcttggcaataaaacaagtttcaatgcctttatacaagacacatcataaaaatgatgttttctgaccacaataaaattaatttagaaaccaataacagaaatatatctggaaaagccttagatatttggaaactaacacactttcaaatagctcatgtgtcaaggaagaaataaaaaggtaattacaaatcattttgaactaactaaaaacacaatatatcaaaattagtgggatgttgctaaagcaagaattcaagagaaatgtttaactcgaaatacttatattagaaacgcagaaaggtctcaaatcaatgacctcggaaactggtaaaaggacagcatattaaactcaagttaggaagaaagggaataataaaaatcagagcagaaattttctaaataaatagaaaaaaaataaaatcaatagctggctaagagaaaaatcaataaaactgataaacctccaagctagactgacctcagaaagaagagggaatatacaaattatcagtattacaatgaaagatgtaagttcattacaagtttgatggatattaaaaggatattaatggtatattataaatttatgccaatatatttgacaacttagatgaaatgaacaaaatttttgaaagatataactaaagcatgttttatgtataatatccaggctctctgtgtacagtagatagcctgtatatgtgtgtgcgtgtgtgtgtgtgtgtgtgtatgtcagtgtgtgtctacctgatattttagttaaaaactatcacttataggaaactccagagccagatagcttcactggtgaattccatgacatatttaagaaagaaataatgctaattctatacaaattctttcagaaatctgaaaaagaagcaaaaacatctaattccttctataaggccaatattaccatgatatcataaaaccagacaaacattaaaagaaaagaaaattgcaggataatattcctcatgaacatacatacaaaaaactaataacattttagcaaattgaatggaacaatatgtaaaaaggacaatacatcatgagcacgtagagcttttacaaagtatgcaaagttgatttaatattcaaaaatcaatcaatataattcaccatatcaacaaactagagaagaaaacccagttatttttatggatacagaaagaaaatccaacatctaatcctactaaaaactcttagttaactattttgcagatataagtgtggtgtgtgtgtgtgtgtgtgtgtgtgtgtgtataccatttacgtgaagtttttaagtgtgtccaagttgtttatagacacaaacacaaatagcaaaactttttttttttttttccccgagacattgtcattctctgttgcccagactggagtgcagtggcatgatcttggctcactacaacctccgcctaccaggctcaagcaattctcatgcctcggccacccaagtagctgggaccacagttgtgcaccaccatgcctggctaatttttctatttttagtagagatggtatttcgccatgttggccaggctggtctcgaacccctgacctcaagtgagttgcccgccttggcctcccaaagtgctgggattacaggcgtgaggcactgcacctggcccagcaaaagtatttttaaaatgtatgcaatgatgaacaccaaaccaagtaaaattgttattgctggaggatgaaagaggaaaatagggtcaaggagggaacttgaagaagggtataatggaggagattcaattgtatctgcaatattttattaaaagtgaaaagatctgggcaaagatagaaaaatattaaaatttattaaatctgagtggaatacactcagttgttatattatttcttctctgtttctggagtcttaaagtatggttgaatattaagcaatcattaaaagaacacttataatcatataagagtatggaaatgtttatgatgagtaatgctgctttaaagcaagaaaaaattgtatttaggaatataggaattttgtaagtgcatgtatatatgtgtataatattcgactatgtaaatttagcatgttttctctcctaccagtgaaacattagtaactttcatattgttttcaaatgttcactattaaatacaatgctacaattaatgttcttatatataactcctttgcaaatatttttctacaaaaatatacttggcaatacaatcactatgctatctatacttggcctttataaagctataggacaatataatggaagatcccatatcatgtccaaagaaagattgttgaacttagctttttctctttgcctgcatcaagcagccaactgctacctgaatgaaaatttgggacaaatctaaaaccatcctttagcgctgaccaacagtcacacaacatcacctcacttcatctctctctacattcttttcaaaagtattgcttttccttcaaacctccttctttcttagaatcttacactcttggttattcactgtctcctttgtatgttcaacccactcttatgattagacacaattgagatacaggctacttgaatataaattactataaccgccttggtgggtgggtgacagtaattacatatcaacacgtaaaatgcataaaaatacataaacatattgaccaaacaattctatttctaggaatttatcataaaaatattgtcatgctaaaacaccaaaagcaatggcaacaaaagccaaaatagacaaatggtgtctaattaaactaaagagcttctgcacagcagaactattatcagagtgaacaggcaagtgaacctacagaatgggagaaaatttttgcaatctaaacatctgacaaagggctaatatccagaatctacaaagaacttaaacaaatttacaagaaaaaaacaaccccatcagaaagtgggcaaaggatgtgaacagacacttctcaaaacaagacttttatgcagcccacagacatatgaaaaaatgctcatcatcactggccatcagagaaatgcaaatcaaaaccacaatgagataccatctcatgcccgttagaatggtgatcattaaaaactcaggaaacaacagatgctggagaggatgtggagaaataggaacgcttttacactgttggtgggagtgtaaattagttcaaccatcatggaagacagtgtggtgattcctcaaggatctaaaactagaaataccatttgacccagcaatcccattactgggtatatacccaaaggattatgaaataatgctactacaaacacacatgcacacatatgtttattgtggcattattcataatagcgaagacttggaaccaacacaaatgtccatgaataatagactggataaagaaaatgtggcccatatacaccatggaatactatgcagccataaaaaaggatgagttcatgtcctttgcagggacatggatgaggctggaaaccatcattctcagcaaaatatcacaaggacagaaaaccaaacaccgcatgttctcagtcacaagtgggagttgaacaatgagaacacatggacacaggcaggggaacattacactccagggcctgttgcagggtggggtgctggtggaggggtagcattaggaaaaatacctaatgtaaatgacaagttgacatgtgcagcaaaccaacatggcacatgtatacctatgtaacaaacctgcaagttgtgcacatgtaccctagaatttaaagtataataaaaaaattacactacaaaatttccaaaaataatgcaagctcaatgcagaaaaacagtacaataaataacaattcaaagtcaaaaaaattctgtcatggttcccaacatacacatagaaggatgttcactggctcatccttgtaacaaggaaaaaccgaaaaataaaacaatttcttccctactaccttgaataaaaaatgctcagtacgttgcagtaataggaagaagccttcatatacccaggcttacactgctatgcctatttttgttagccttgcttccaaagatacaacagctgaaacctgaaatattgttgatccttatgattttctttcaccatcttatccaacacttttttcttcacttgtcttttatttattttagcatcatctagcatatgtgctctcaactttggctacacattagaaacatctgggaagattttaaaattagcgggtctaccttggatgaattaaatcagaatttgggggttagtatccaagagttgctttttcagaatgcttgtcaagtgattttaatgtctaccagggtggaggaccactggtcttggaatataatcagcattgtgtttttacattgcaaagataaattctttaatagacttccaattaattcctatctattctgaaagttgagaagatggtaaaatttattttagttccaggaatcctgctgcttgcctcttcccatctgctctatagttttaactctgctgatgtcaatctaagatattttgctatagaaacttgttacattgcaggtctacaacaattttcaccctgggtgaccagtctcatggcttcaagagttctgaagcccatacccttagccatttcaacattcttcataatacactgtcaggtcagcaccaatgtggtgattaattttcttcagccgcagcattctgactggttgccattttgtgatcttgagtgccttgttaaaccgcatgtctgttgggtagtggcacttttttatttcccacaatgacttgttgaaagaaacagtaatcttcactgttttatgcctgtttcttttttgggatgacttgtggtaaaaaaaaaaaaagaaaaaaaaagaaaaaaagtaatgacactttttaaaaatttgcatttttataaattttttaaaacaaacttgccagaacttgaacatgaaaatgagtatttacatgttaggagactatacactaattctacccctgttttttattttaaagaattgcttttggattcagtggcacctttttggaacatctacaatcatggcgaaatttcaacattggaggctgagtttggcatgtggagacagccgctaaaagttgttcagatccaaatcttatgaatattttgagttgcaaatttaaaaagttagtatcatttgattcaaaatagaagtgagactaaaaataataaaactattttctttgtgactacacctggctataagagtaattgacaaaaaatttctttttttttatagcagttggtagctactcagctgtcaaattatccctaggtctataaagccccatgttttggcctggtcatccctgttgttataggtatcaggtcatacagatgggaacattggtatgcagccaagtggtgagcttctgggttaggtaagttatttaacctcactcgtctgaacagtcctcatttgtaaaatgggaataataatgctaatcgcatgaaagtgctgaggattaaatgagaaaatatttttaaatgctttaccccaaggcttcttgcattctgatgtgtgtaggactctcctttagatcttgttaaaatgaagtttctgataagcaggcctgggtatggcctgagattgtgagtgtctaacaagctcccaggtgatactgatgttgctgatctacagaccataattagagtagtaaggtgttagtctagcctggagtaggtaactcagtaactcaaaaacggttttcttttttctataccttcttggttattcaggggtttggaatttggtcaacaaccgcaagcactgatactacatgagagatcctggatacagccacaaagaaagtaactcacaaagcacgcattagaaataggattagcctgcatgtttatgaacttcatgttttcactcaatcataaaaatgttcttggttccaattgcctgaacttccagtccaggggaaggatagacaggcatccagggctatagaatgggttgggtggagaagtgggaaccaaagtctttcttatgtgggagtggccttcaaaagcaagggtcccatgtgtcatttccatgggagtaagcaaaggaaaaagagctgggtcccaaagaactaaaccaggagaaacaggctttcaaaaggtcaggagatttaacttcaaaatatgtgttcagtcaactgcaaaagaagagagagcctttaatgaagtggttacaggggcatgtatagacagagaagaagttggttttgttaggaaatttattttatgggcagttataatgaaaatataatcattaccattccaagtcaataatgatattcagcagtagtctttgtcctcccttcactaagtatttctgctgactattaatcatttcaaacacaataagatataaccaatccaaatatgttgaaagaaaattaagtgctactcggctgtaagtagtattctgtttgaggggacatgatgtccagctaacaagaacaacagcatgcaatagtcactttatttctttgtatccgaacagatagtgtcacctcacactgcaaaacagctcctcaaaaactatcaagaaacagatgctttctcagtggtgatttgaggcgttcttgtgagtaggcttttagcaatccttgacatggtaacttcatcatttttcatgaagcttgaaaaatactctgttatccttgaagattcttagtagtgtctctcatgtcatgttatttcaaatcaatcattacatatcctggaaacagcccctccatgaggctttgaagtagttttgatccagtagtagtatttctactgtaatagagattgataatacagaccctccagcctcttggtgaacactttaagttgctttctgataattcatgtaacacacaaaatataaacacagatacacacacatgccctataaactttctgcctttgtgcttgtcttacttggataatagagatgaggtaagtttttttttttccattaattccttcaatgtctacattgtcctgattcattggatattcactctattctttcagcgcacccactgaagcaccccctgtgctttgtttttagctccctttcttattaaaatgcagtctgggtttacccattgtttttacagtttaccttatgaagtagagaactcataaatgttattagaaaccctcccagaaaataacttccaataatatgattcttttgataatcagatatcaaagaattagcattctatcctaaaagcagaatagattatgtatattctatatgtataattattgaacttaattagaataaaatgatgatctaaggcaatgagaggtcttgaaataccctgattcaaggtaatgctataattgttcagtgtactttgaaagtcaaatatattttgagtatgagggtccttttaaaagtggtaattttgatgtggaacatatccccctgccttctctgaaatgtaaaagtagaaaatacaacaacaaagacctcagaagctaaaagagaaaagaaaaaaagcctatgccttgactagaccagacacattaaccactactaaacaagcattttgtggtgtaaacaccattgaaacatcagaactatgttctgtatgctggttgtatatgtatatacttctccatgtgaagaaaatttagaaaacctatgttttatttcaacaaacacaactgtcgaatgagttaatggggcagccattgttccaggtaatggggagatatttaccctcaaacggggagagaaataggcaagcaaatagacactgaaggttagcatttaagattttacatatgtgaatttccgttatagatctccagtctcaagtgatttcctcacttggatctattgcatccatcaaactaatctacaaataagcagacttttgcttacatggtgtttgacttccaaatagtaaagggtaagacaataatctattcaatacaataatatcaagggtcgctacctgacttcaaactacactacaaggctacagtaatgaaaacagcatggtactggtaccaaaacaaatatacagacaaatggaacagaacagaggcctcagaaataaagccacacatctaaaaccatctgatccttgacaaacctgacaaaagcaatggggaaagggtttcctatttaataaatggtgtagggaaaactagctagccatatgcagaaaactgaaactagactccttccttgcaccttatacaaaaattaactcaagatcaaattaacttaagtttaaagacttaaacctaagacctaaaaccatgaaaaccgtagaagaaaacctaggcaataccattcaggacataggcatgggcaaagacttcatgataaaacaccaaaagcaatagcaacaaaagtcaaaattgacaaatgggttctaattaaactaaagagcttctgcacagcagaagaaactatcatcagagtgaacaggcaacctacagaatgggagaagatttttgcaatctaaccatctgacaaagggctaatatccagaatctacaaagaacttaaacaaatttacaagggaaaaaaaaaacaccccatcaaaaagtgggcaaaggatatgaacagacacttctcagaggaagacatttatgcggtcaacaaacatatgaaaaaaagctcatcatcactggtcatcagagaaatgcgaatcaaaaccacaatgagataccatctcatgcccgttagaatggcgatcattaaaaagtcaagaaacaacagatgctggagaggatgtggagaaataggaacacttttacactgttggtgggagtgtaaattagttcaaccattatggaaaatagtgtggtgattcctcaaggatctagaaccagaagtaccatttgacccagcaatcccattactgggtataaacccaaaggattataaatcattctactataaagatatatgcacatgtatgtttattggagcactgttcacaatagcaaagacttggaaccaacccaaatgcccatcagtgtagactggataaagaaaatgtggcacatatacattatggaatactatccagacatagaaaaggatgagttcatgtcctttgcagggacatggatgaagctggaaaccatctttctcagcaaactaacacaggaacagaaaaccaaacactgcatgttctcactcataagtgggagttgaataatgagaacacatggacacagggagggggacatcacacactggggcctgtcaggggtttgggggctaggggagggatagcattaggagaaatacctaatgtagttgatgggtgctgcaaaccaccatggcatgtgtacacctatgtaataaacctgcatgttctgcacctgtatctcagaacttgaagtatgataaaaaaaaaaaaaaaaacaaggataaagaatatttaatcagttcagtctctgaatcttcccataccacttgtccatcctcattagacttttagtactctgaggtcaaaagattctttttatttatctttgaataaatgcaaggaatgtgcaagagatagttataaaataaatgaggaagtattcaataatgaatattgctccttacagtgataccctgaaaattacaagaaattgttcagctgggaaggcaaaataatagtattttagcaacaatggttaaaactaggatgtttaattatccagaattatcctaaatccctaggattaaggttaatagcacttactttgtgtatctgcatagaaataaagagcatgaattcttgagacagctgcctgggtacaaaccctggctctatcacttactagctgggcaagcttggacaaatttcttactctgtgtttcagttactttagctgtaaaactgggataacatactaccttcctcatatgaggaattatgaggattaaattggtaacatttataaattgcctaaaatagtatgtggcacacagtgaatattatttaaattatgttaaatagatatatcagcacctcccaacctgagtcttgaatgaacctggtcccacaagatgctctctataattacatatcaaataggtttggggaatgttgcattttctggagtcataatataaatttataaagttttgaaaggtcatatagccagaaattcttgtttaaatgtaattatgccaacgtttcccaagttgagttctgtgcttaaacacttttcccctacctaacagatgttactagcccatagccccatttcgagttaatacaattttaattgtttacctgttactactctttgtaattatttgtgtgtacttttacatatatgtatatatatatatatatatatatatatatatatatatatatatatagcatatattttgcatcgcaactggaacgaggttacaaattgagattttaataacatttgtatttattgctctactgctctcttgttctctgttttgtcagaattcctatacagggtttcacataaataccaagtgtgctgatttcaatgtaatagaaaaatgttatttaaaacaacaaattcaagacctgtgccttgaacgggtctgttttagctgctacaaagcctctagccacacccataaaaatgctgtttcaggataaatgcttgaggtgatagaaacctcatttaccctgatgtgacttttatatatcgcatgcccgtaacaaaatatcttgtgtataccataaatataatatacctactctgtgcccacaaaaattaaaaattttaaaaagaaattttaaaaatgccattcaggcagaaaaaggctaaaaaagtgatagtattactaaaacgcaagacaacggaaaacctattgtcaaaacctggaaaattctcctttcagttatcaaggccctgaggctgactttgtcacctccaatatgatctacctcagcatggaagggaatcccctgaccgaaaaggagtcggtagaagcttcatcattctctcctttctttcctaccatgcaatctcagccttggcttatacaaaaaacaaaacaaaacaaaacaaaacaaaaaacaaacaaaaaaaaacaaccaaaaaaaaaaaaaaaaaaaaaccaccagaaaaaaatgcaggtaacctgctcttacagcatagagaatacgtctgaaacagccaggaaatgtctctcatatccttcagggcggcatcaccagaagggaatgagcagtaagtttgcccctttccatgcacagactccaatatgtatagcaatttaaacaataataaaaggagcatcacaaatcagagaagatatgtgtttagaaagaaaagaggtttggccgggcgcagtggctcacgcctgtaatcccagcactttgggaggccgaggcgggcggatcacgaggtcaggagatcgagaccatcctggctaacacggtgaaaccctgtctctactaaaaatataaaaaattagccaggcgcggtggcgggcgcctgtagtcccagctactcgggaggctgaggcaggagaatggcctgaacccgggaggcggagcttgcagtgagccgagatcgcgccactgcactccagcctgggcgacagagcaagactccgtctcaaaaaaaaaaaaaaaaagaaaaagaaaagaggtttgaaaaaattgctattgcacttgagggaaaaataaaagtggggatccccattaaactatacatcaaaacacattacaaaaaacagcctaagaggctgtccattatactagagtggtcaaaaacaaggacttatgtacctgacagacttgggattgattcctgactccatcttttcctaactgtgttgctttaggcaagttacatgaattctggacctctgtgtcttctcaggtacaatgaatagaatggtatttttctcattggaatcaacctaagtgtccatcaacagatgaatggataaagaaaatgttgggtatccatatacaatgaaatgttattcatcctttaaaaagtagatccttgcatttgcaacaacatggatggacctggaggacattatgctaagtgaaataagccacacacagaaagaaaattactacatgatatctagagtcttaaaaagtctaatacacagaaacagagagtagaacagtggttctactctaccaggggcagggtactgggggaaatggggagatgctggtcaaagagtacaaagttgcagttatgtaaaatgtaaatctagagatctaatgtacagcatgagaactaatttgctagagagtagacttcaggtgctctcaccagagaaaaagtaagcaaggagatgaacatatttgactgctataatttcacaatgtatatcaaaacattatacacctaaatatatacaattaaaaataatcacgttttacatcttaagtatatataattttatttgccaattatacttcaatgaaataaaaaaataagtttaaaatttatgatatgcaaaaaacactgtcaagaggatgaaaagacaagccacagactgagagaaaatattggcaaaaagtgtatatgataaataactgttatttaaaatatacaaagaactcttaaaactcaacaataagaaaacataaaacccagtataaaaaaaaaaaaaaaggaaataggccaaacacattaacagatacctcttcaagaagatacaggagatggcaaataagaatatcaaatgatgatccatatcatatgtcatcagggcaaagcaagttaaaataacaatgagatactactacatgtctattagaatggccaaaatccagaacacagacaacaaatgctgcaaggatgtggagtaaaaggaactcttattcattgctggtgggaatgcaaaattgtacagctagtttggaagagtttggcagtttctaatgatactaaacgtactcttagcatgtgatctagcaattacactccttgatatttatccaaaggagctgaaaacatgtccacacaaaaacctgcatgtggatgtttgtagaatctttattcacaattgccaaaacttggaagcaaccaagatgtcctttagtaggtaaatggataaactgtggcacatccaaaaaatgaaatatttagtgctaaaaagaaatgagctgtctgaaaagatatgaaggaaatttaaatgcacattactaagtgaaagatgccaatgtgaaaaggctacatactgtatgattccaactatatggtatttgggaaaggcaaaagtttggcgactttaagaagatcagtgattgccagggattgggaaaaggaaggcataaataggcagagcatatgtgatttttagagcagtgaaactgcactgtatgatgctataatggtgaatacgtggttactatacatttgtccagactcatagaatatacaacaccaagagagaaccctatgtaaactatgatctctgagtgataatgtacgtgttcagcaattataacaaatgtatccctccagtgggtgacgttaatcatggtggagggctatgcatatatgaaggtggagggtatataagaaatctctgtaccttctgctcaacttcactgtgaacctaaaactactctaaaaattaagtctattaaaaaaaagaaatcaaacaaccaattggaaagtgctcattccttttctattttctgaaggagattgtgcagaactgatattaatccttctttaaatatttcatagatttctccatgaaactattttaactcttggaggtaatcttttcaggagtttttgtactacaagttcaattacacagaatagagaacaaaaatatgtccaataaatttttgacacaggtgcaaacacaattaaatgaaaggaagagctttttcaacaaatggtgcttgagcaactgaatatccataggcaaaaagtggtttttaaaaaacgactttggccttaacctcacgcattttacaaaaattaactcaaatggattatggacttaaatgtaaaatgtaaaactataaacctcttagaagaaaatctttgggatctaggactaggcagaattcttagacttgacaccaaaagcacaacccatagaagggaaaattgataaactgggcttcatataattaagatcatttgctgtatgaaagactctgttaagagcacgaaaagacaaaatacggcctgggaaaaaatatttgcatatcaccacatatctgacaaaggacttttatctagaaaaataaagaactcaaaactcaacaacaaaatatccaaataaccccctggtcaaacgggcaaatgacagcaagagtaagtggatatacggatggcaaataagcacatacaataatgttcaacatcattagccattacagcattacaaattagtaccacaatgagatattactatacacctatcacgacagctaaaataaaaaatagtgacaatgcaaaattgtggagaacctggatcactcatagattagtcgtgggatgtataatggtacagtcactatggaaaacaaattgatcgttctctaaacaaacaaacaaacaaagttaaacatacaactaccacaaaagccagtaattgcactgttgggcatttatcccagggaaatgacaagttatattcacacaaaaacctgcacatgttatagcacctttatttgtaataaccccaaactagaaacaacctagacgtctgtccttcaagagggaatgcttaaacgaactatggtacaaccataccatgaaatactaattagcaatgaaaagaaacaagctattaaaaacctgtaagaataggccgggcgcggtgactcacgcctgtaattcagcactttgggaggccgaggcaggcggatcacgaggtcaggagattgagaccatcctggttaacatgatgaaaccccatctctattaaaaatacaaaaattttagctgggtgtggtggtgtgcacttgtagtcccagcttcttgaacccgggaggtgaaggttgcagtgagccgagatcgtgccactgcactccagcctgggcaacaaagtgagacttcatctcaaaaaaaaaaaaaaaaaaaaaaaaaaagcaaaacaaaacaaaacaaagaaaaccctgtaagaatctagatgaatcaccagagaattatgccaaatgaaaaaaactgaaccccaaaagcttgcctactgtatgatttcatttatatgacattcttgacatgaaaaaattatagaaatggagaacagattacttgttgccaagggtaaaggagaggatgcaggtggtagggaaatatggtggctataaaaggacaacatgggatcttcatgatgaaaaacatgttctgtatcttgactctgccaaggtcaatatcttggttgtgatattgtactattgttttgcaagatgttatctttgtggacaactgggtaaaggataagtaggatccctctgtatgatgtcatacaactacatgagaatctccaattatctcaaaataaaaggttcaattttaaaaaagttaactgaaggtagtatttaacaatgaccctattttcaccatggaatactatgcagccataaaaaacgatgagttcgtgtccttttaggggcatggatgaagctggaaaccatcattctcagcaaactattgcaaggacaaaaaaccaaacactgcatgttcttactcataggtgggaattgaacaatgagaacacttggacacaggaaggggaacatcacacactgggtcctgttgtggggtggggggaggtgggagggatagcattaggagatatacctaatgtaaatgacgagttaatgggtgcagcacaccaacatagcacatgtatacatatgtaacaaacctgcacgttgtacacatgtaccctagaacttaaagtataataataaaaataataaaaaaaaagaccctattcttttcatttgtggcaagtatacctctttaatatgccaatgttaacttttcttaagacaacattatcttaggaaattagcattaaccctaaacttacttgaactattttatagtgcttctcatgaaaatatcaactcgattcacagaagtctttaagaggaaaatgcctaatatcagaggaaatgaagtgctaaaagctcaattaaattaaatattaaataatgctcacagaagattatggattcaaaagaaggcaactatttcaaacaaaaaaaggaacatttaagaagtaatgaagaaataacatgctataaatgatatgacatattggtggcatttttaaaacccgcttaagtaaaatgggtatattccatttctaaatgctttaggaacttgaatatctttttacttagaacatttctccatgttaaccttgcttaaaatacattaacatgccctaatttccacctccccactgtaattgtctctctcctcataaaaatatatgtagacatattttaaaatatattcactatttacattttccaattgtctgttcattcttttcaacctgatgattcctgtcttcataactctgtttattgaaacagcactgataaggcatcagtgacttgcaaatcttaacacccaagggttctgagaatcttgtttcttgagactcgtttcctttggcctctctgacagtgtccactcccgtcgttctattacagtttctacttcttggtatcactcactagaccttcttccttctccccttaatagcaacaacaatggcatttgtgaagcaatatttctgcataccttatttcatttgtatttaagaagtttatcatcacattttttataagagtagacaatgagacacaggtaagtaatctgatccagattatgctcaaagtcatgtaaatcctagtcctcacttcttgctattcttatttttcattaatcttgtctatttttatcagtttgggtgtcacctttatggagatacctttaaaccatactgatgatacacagatagtttccaagttctgcatttttaactgcctattagatagcttggcacaaatgacccagatacaaaactcttcaggtccctaactcagcattgcccatagaagtcagcagctcttaatgttccttttaatgccctgaccatttctctagtcatccagatatgaagcttgaatgttaaccgtttcctccttcacatcaagtccactatcaaatcttacagattccatgtctttcgactttgattctttctacccattctctctcctctagggctctgtcatccctcactcaactagaccagtgtgtagctgcttagctggtctactggcctcagaactcttcctagttacagtctattcttaaatgactgtctggttaatattcctcatttgtagccttctgcttaaaagaaatacctccaactgcttgatcacctgctgtcagctacttctgccaactcataatgtgcttgatgtcaaaactcaaaagaagactcagagtgagtcaaaaatactttttagagtatttttacatgcaattatttgaagggagtctacacttcagaagaactagtcttccagtataaaggacacagcaggtatttaaagacaagaaacaacaacacaaggctaccagcttggagtaggctgtgtaggggtgggaaaatccacatgaataatctgcttacacgggtcatcacagatctgcagacataaacatcacaaaaatgtctgagatgtagagttttctttaaaaacttaccaacttaaagggcccaaggctttatttatttgggggactagaactagacaaagtagtcttcctttttgtttattttagggtgtaaagtactttatttataaatgaaattcatggtgtgcatagacacatggtgacagggcaagatattagctttgttttctcatctactatatggagcccttctacctttccattatctttttcctttaaactagtaactagttggcttagtgggttccaaagaatcttgtagtattttcttacttctatgttgcttttgcctcaaatactttagttaccaacaatcgaaacactagcacttccttaaggtctatataaattctatcttagcaacactttgctgatactacttttctaaaattattatcatttttctttaataacacttatgaatcttacttttactgaatgtattttgctttgcagaaaagtgtgtattatcatctaattgccaaattttatttatttccatttattttataatggaattcaattctatagtgtgtctacaccatcattgcacttctgtaaaatatataggcaaagacaaaaaagaaatggggaaaaattaaggtttcataaaataaaattatatgttagtactgtatatgactggtgagggtaactactggtgaagagagaaaattagaatggttgtgtgtatacacatgtgaaatgcatttgtatctgccttcaagcagcttacaataactataagtgctcaataaaggtttaataataataaatgctgacatttactgagtacctactacgtaccagtcatgccttaaataatttaattcccaaaatcacttacagaatagtaatctagacacagagtggtaaatgagcaaggttacacagataatatatagtagacacaaaattagaaaatctggccatctggttctagaactctaaccattaagcaacactgcaaatttgaatggaactaaattagcacacattttgaacacacaagcatgtaagcatttagtctcttcccattttcttctatttggttaccatggttacctcttctaccttcagttaaagccaagattttatttgtaccaactctttttttttttttttttttttccagacacagtctcactctctcgcccaagctggagtgcagtggcctgatctctgctcactgcaatatccgcctcccgggttcaagcgattttcctgcctcagcctcctaagtagctgggattataggcacgcgctaccacacacagctaatttttgtatttttagtacagatggggtttcaccctgttggccaggatggtctcaatctcctgacctcatgatctgcccatctctgcctcccaaagtgctgagactacaggcgtgagccactgtgccccgccatttgtaccaactctttctggctttgaacaacttttgctgaatagttggaaatatgcttgtaaggcataactgagatgaccacaaactattttctaataaaaactgatactttattgaggtttctttgttaaataggtagctaagagaccttagcacgattaccatgtcaatgggtaaatttcactgattcaatggaaggaaacagttaacaccactactgacttagaatcagtaacttaaatatagaaagaaatagccttaatgcataacatgttgtttccaagagttatataaatgtggattaaccacacacttgatttaaatcttcctaggtgtcatgactaatctcccttttactgattattacactacaaaatttattctgatattcctaatgtttccttcaaaataacaaagccaccagcagcacatataatacattgcaacatttttttgacattttcatggaattgatactgcagtaatcactgggtgctatcagggatgagcagtgcatttcaggaattatatttcatagtttttcagtctgtagcaactggagaacaaaatatgcaaaggctaccagagagtgtctatttagtcatagagtctattagtccaccatctctcattccaaaccatgaataattatatattattgagaagtgacacttacatattcattatatatgtgtggacccatgttgatatatgtatatacacacaaccattctacttttctcctttcaccagtagttatcctcaccagttatatacagcactaacatttaattttattttatgaaaccttaatttttccctatttcttttttgtctttggctatatattttacggaagtgtaatgttggtgtagaaacactatagaattgaattccattataatggaaacattctccaaattattggcagtcataacttccattttcgttgattatgtatctttttttagatcttaatcagtaattgaaagaactttcatagataattttaagataaatagctttatgcactagtatgtttttctacttttgaataattttcttggtataaatcttggaatcattagcattcaaattatcttgaaatgatacatttatcattttaaaaaacaaacttactttgcattgtcagtgttagtaccttgattactacattttttcaataaaaaatagcaaagtatattagaagattctctttattctattctaacaattattaatacgtgcctaagtaaaaacaaaaaaataagaaaagggaaggtatactgagttaagctatgcttgaaactttttaaaagcacttttatttaaactaacttttatgatttcaagaatattaattctcatagtaaaaaatactaaaaaacaaaacaatcactcatgattcattcttccttactttattctatgtataaatttcatacgtagatataataaaaacccatgtgaatttctctgaggcataatgtcttgttataagcatgattttggtcactgcattttactaatatattctactttacttaatcatttggttcctggtatacatattagtgtaatttaaaaattttcagctcttaaaaacagtattgcaatgagtgagggtcaaatttgtatacatatctatgattatttttcctagaggtgatgttactacctacgattataagtagttttaaggttcttgatacgtggtatcaaattttttaaaaagctgtatgaaaaagcttggataaaaaaacaattttcatacatgaagtaaaatcattatatggaatgtgttacaaatagctaacatatacatataggatagttactctttaacaatggataatgaactccagaaatgggaaataaatcaaatgaagcagagcagaaatagaaggtaggcagtgcaaaggatggagaaacaatgaaaacttaatatacatcgtgctttgcctgatcgcacattgtacactgataagctggttagagaaaggagccagaagtggtccaaggctttaatttcttttctaatctttctggacatatattagaaggttgatttggattattacttgaaaactatgctgtttggcttctatggagaacatagtggttcttaaaaacaagagtgaaatctgcttgagaattagagtagccttagaatagtcatatcaacaaattaatagaggagaaaaaagaaaccatatatctaggataaaatgccaaaataatacatggaaagaatcatactttattgtgttaattcatgtcttcatgtattcattcattaaactaatctttgttgaacaactattatatgccaggcacgtctctaaatgctagagatatgataatgaatcagagatatagtctgtatctttatggagcttacagtttagtgagaaatactgacaattaaccaggtagttatagtagggtgatgtcaagcttagtgggataaggaaacaaggacaaccaaccctgttcgggcagttagagaaagtatgaggccagtttccaactgaaaactgaaaggtagtcaatggaacagagtgagctgaagaaccaaaatactgcttatgtaacttttgctatccaacgtaagtctcaaaataatagtacacctgtttggaactttatagcttcccattatgttctggtggagagagctagacgactttaaaactgctgagatcattatagccatggacaacctgtgatactactagccaaattttagcaacgcaaatatggggtaggaaaaataaagaattcaaaaagacagaaacaaatatcttaatgagggaagagtaagaagtaagactagaactgtgtaataaacattctgtccagttacaaatgtgcctgagttcattgtatagttcattgtataggcttgtttgggggtttttctatttgttgctcttgttgttttctcttgagacctgacaaagtacccctttgaaagttgtagagaacaagtctcagctagatggacccaagtcaaaatctagccattatattggtgctagccaggaataaacttgattagattggccaaccagggggacactggcaaaagctctcatcttcagctgacatctgtgaagaagcttgacttgatgatacctggtagcttcacagggatcatccaaagtatgagggaacttttcacagacttttatgaataatactcaatttgattcttaccataaggctatttggggccagagaaaatactgctctctttacttttcaaagaaagaaacagattcaaaggtagcgaatgctttgcctaggggcacccttctagtagctgtcatggctaaaagtgaagtcttcagattcttagtctattgctctttctattaacatcagtttcttcaacaccactggattgccattctttatgaaatgtgatcagtaagacctactatatatgggaaaaattcttaaagactatggagactatattttaactcattgcaaacatagagagttgatcttttttattttaattaaactttttattttaagataattgtagatttacaagaagctgtaagaaataatacagagagattccaggtgccctttactcattttcccccaatagtaacatccttcaaataaatacaatgtcataatgagaatactggagttaaatatagaacatcttcttcacaacacagatctctcatgttgtccttttatgtccacacccctgcccaatcccctcattattccatggctaccaccgatctgttctccatctgtatgatttcatttcaagattgtcaaataaaacaaagcgtgcagtattgtaaccaattgggtttttttttttgagattcttttttttttaattttttaaaaaattttattattattatactttaagttttagggtacatgtgcacaatgtgcaagttagttacatatgtatatatgtgccatgctggtgtgctgcacccattaactcgttatttagcattaggtatatctcctaatgctatccctcccgcctccccccaccccacaacagtccccagagtgtgatgttccccttcctgtgtccatgtgttctcattgttcaattcccacctatgagtgagaacatgcagtgtttggttttttgtccttgcgacagtttactgagaatgatgatttccaatttcatccatgtccctacaaaggacatgaactcatcattttttatggctgcatagtattccatggtgtatatgtgccacattttcttaatccagtctatcattattggacatttgggttggttccaagtctttgctattgtgaatagtaccgcaataaacatacgtgtgcatgtgtcttcatagcagcatgatttatactcctttgggtatacacccagtaatgggatggctgggtcaaatggtatttctagttctagatctctgaggaatcgctacactgacttccacaatggttgaactagtttacagtcccaccaacagtgtaaaagtgctcctatttctccccacatcctctccagcacctgttgtttcctgactttttagtgattgccattctaactggtgtgagatggtatctcattgtggttttgatttgcatttctttgatggccagtgatggtgagcattttttcacgtgttttttggctgcataaatgtcttcttttgagaagtgtctgttcatgtccttcgcccactttttgatggggttgtttgtttttttcttgtaaatttctttgagttcattgtagattctggatattagccctctgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaatagagaatcctttccccattgcttgtttttctcaggtttgtcaaaatgtaaaagtacggaaattataacaaactgtctctcagaccacagtgcaatcaaagtagaactcaggattaagaaactcactcaaaaccgctcaactacatggaaactgaacaacctgctcctgaatgactactgggtacataacgaaatgaaggcagaaataagatgttctttgaaaccaatgagaacaaagacacaacataccagaatctctgggacgcattcaaagcagtgcgcagagggaaatttatagcactaaatgcccacaagagaaagaaggaaagatccaaaattgataccctaacatcacaattaaaagaactagaaaagcaagggcaaacacattcaaaagctaacagaaggcaagaaataactaagatccgagcagaactgaagcaaatagagacacaaaaaacctttcaaaaaattaatgaatccaggagctggttttttgaaaggatcaacaaaattgatagaccgatagcaagactaataaagaagaaaagagtgaagaatcaaatagatgaaataaaaaatgataaaggggatatcaccaccgatcccacagaaatacaaactaccatcagagaatactacaaacacctctatgcaaataaactagaaaatctagaagaaatggataaattcctcaacacatacactctcccaagactaaaccaggaagaagttgaatctctgaatagaccaataacaggctctgaaattgtggcaataatcaatagcttaccagccaaaaagagtccaggaccagatggattcacagccaaattctaccagaggtacaaggaggagctggtaccattacttctgaaactattccaatcaatagaaaaagagggaatcctccctaactcattttatgaggccagcatcatcctgataccaaagccgggcagagacacaacaaaaaaagagaattttagaccaatatccttgatgaatattgatgcaaaaatcctcaataaaatactggcaaaccgaatccagcagcacattcaaaaagcttatccaccatgatcaagtgggctttatccctgggatgcaaggctggttcaatatatgcaaatcaataaatgtaatccagcatataacagaaccaaagacaaaaaccacatgattatctcaatagatgcagaaaaggcctttgacaaaattcaacaacccttcatgctaaaagctctcaataaattaggtattgatgggaagtatctcaaaataataagagctatctatgacaaacccacagccaatatcatactgaatgggcaaaaactggaagcattccctttgaaaactggcaaaagacagggatgccctctctcaccactcctattcaacatagtgttggaagttctggccagggcaattaggcaggagaaggaaataaaaggtattcaattaggaaaagaggaagtcaaattgtccctgtttgcagatgacatgattgtatatctagaaaaccccattgtctcagcccaaaatcttcttaagctgataagcaacttcagcaaattctcaggatacaaaatcaatgtgcagaaatcacaagcattcttatacaccaataacagacaaacagagagcaaatcatgagtgaactcccattcacaattgcttcaaagagaataaaatacctaggaatccaacttacaagggatgtgaaggacctcttcaaggagaactacaaaccactgtgcaatgaaataaaagacgatacaaacaaatggaagaacgttcaatgctcatgggcaggaagaatcaatatcatgaaaatggccatactgcccaaggtaatttatagattcaatgccatccccatcaagctaccaatgactttcttcacagaattggaaaacattactttaaagttcatatggaaccaaaaaagagcccgcattgccaagtcaatcctaagccaaaagaacaaagccggaggcatcacgctacctgacttcaaactcaactacaaggctagagtaaccaaaacagcatggtaccggtaccaaaacagagatatagatcaatggaacagaacagagccctcagaaagttgatctttaacacaagtttgaaaaagaaaacaaattgctttttgtctgctatctaacttttcagtaagactcaacaaaagcagtaagtctgtgaacattctactttatcattaaaaattttataaaaatgcttagaacaatgggattccaaatatgtattcaactacttaaagtatcacataatgagtaaagccaaagccaactcgaaaatactttaagactctatgataccagcactttctaatacaatttaacattgatcaactgatcctaattccacatagtggccattgcgagaaaacaccaaatgacaaatcatttgtagagtaagattatcaaacctatgaacaatatcatcctcaggcacttacttaatttgctttctgttattatttccaaatttggttatgttgaccctcaaatttccatattcagaaaactgaacagcactttccaggccaagccttgctgcttctcccacaggcttgcaaaacataatttaattgtgtctctctctctcttttttttttttttaagatagccagtaacttggttttcttcccctaaggaaacattacgcacctcagagaaacaaggaaaaattttaaacagatactttgcaaaaataattacagttgactcttaattttctgtggtagaggaaagcagagatagcatgtgtgactgaaattcatggacatgccccaaatttcattttgaaaagcaatttcaacttctcatttaaacaaacctgttatttgctgcaaaattggttgatgtgagctttgcttcttttttcgagccagccagagggtaaagcagggaatgtataaaatagaagtaccctcaaacttgataatcaattcccaaggaaatgaaagttaaccataatcacttggcactgcataaagaaagaattctacaggaaatgtaaacacagctaaaaccgtctgatgtttactgttttcagagtctaaatgccctctttaaaaccaatatgtaagaaaagtcattagattttctttaccaagtctgtgattatttaaaaccaaatcatgaagctacagatttagaagtatctctaggaaatataaaaatgaagatatcacgcttaatctctatatttctatgtgatgacattaattgggaggctaaattgaagctgtgcataaaaagcagcttctctgcttccaaaaaagtgattcataattctaattgtttttaagtgcaaagtgactaaagaggcaagtttaagctttagcttgtaaggcccaaaatgcattttccctctatagaaatgttcattgttctttctgatccttaaatgtttgaaggatctttaaagaaggtgatatcctttggatgtttggcccctccatatttcatgttcaatgttcagggtggggcctagtgggaaatgtttgggtcatggaattggatccctcatgccctcctcatggtaagcagtttacattagaactggttgttaaaaagaggctgggacctcccccctctctctcttgctccctctcttgccataagacatgcctgtcccctcttcatcttatatcatgaataaaagcttcctgagatcctaaccagaagcaaatgctggcatcatgctccctatacagtctgcagagccatgagccaaaaataaatctctttataaattagccagtttcaggtattctttatagcaatacaaaatggacaacacagaagataagacagatgaaggcatgctcttgttctctggatacccattcaaccaaggatctttttccaaaatggctggtttcatctatctgaataaactgttgagacatgtaataaccatgattgatgatctccacagttgtttttaggaaacaccctcaattaaatagcagttctcaaagtgtggttctcacaggccaggagaatcagttttatccaggaatttgttggatattaaaaatcctgtgccccatcctggggctgttgaatcagaaactctggattgaggcccaacaaactaaattttaacaagcccttcaggtgattctgatgcatgccaatgtttgcacacactcccttagaaggcctgacctcttaccattgtctcaaacttatgagagcctaagaaaaccagaacctctggaaacatctagggggttgcaacaaactttcatcaatggcttttatcatgcttagcctataaaagtttggaataaatgtttagccttcttctgaagtattagatcactaaacatctattgtcaatactcatcttcaaaaatgtttcttttcatcttttatcaatacctttgttttaccactttctgatcaccatcgattacatagaatgttaaaattcacatgttgtatgtttcttatttcattccttcagcatctttataattggtgagtaactcatttcgttaatgacatttataaatttttaaatacttttagtcactgttattcattaagattctccagagaaatagaaccaatagaatatatgtgtgtgtatattcacacacacagacacacacacacacagcacacacacatatgtatatataaagagatttgttataaggaattggctcacacaattatgaaggttgagaggtctcaagatctgcagtcagcaagcttgagacccaggacagccaagtaccaagtacttggtcacagtccaagtaccaacacctgagaaccaggaaatctgatggtgttcagtttcagtccaaaagctggcaggctcccagacacaagaggaaccaatgtttcagcttaatgacaaaggccaagaagaagaccaatgtcctagctcagagtatccaggcaagaggagttccctttctcttgcaggaaggtcagacatttttgttctgttcagaacttcaactgattggctgagacccactcacattagcctgggggcggcggggaggggggcaggcggtgtttatggggtgggcaacttgctgatccaaatgttaatctcatccaaaaacaccctcacagacacatctagaataatgtctgatcaaatatctggacaatccgtggcctggtcaagctggcatataaaattaaccattatagtcatttttaaattactacttttattttccacagaattgtataagtgttctgactaatatgttcaatatgctcatcactttgctcttattggacatgatgtagttaatattatgtataaagcaactataaatcaaacacaaacacagtctatggaagacactaacaaatgacccactggcttaaattaaaagagacaatcatgatgacatagtgcactgctgatgttgagcagtcaacaattttttgctatacagtgtacctttcatacattaataaaagtttgtagttgaaagttaatcaggagagaggcttttttttgcatagtgctaattcaactgcaaatacatgaaaaatccatccaaatagcaaagcattttttttttttttacacctgatcatgcagcagagtgtttcattaattggctattttggcaccaggcaaactgattctaaatcagaagaaaacaatatttctttgaggtggaaggaatttcaaataatgaacagcaaaagcaaatacttatggcatgcctattatgcatgaggtactagctacatgttaggccccaagtttcccaaattaatgcttcaaaactaaacattccaaatcaggcagctaaaaaaaaaatggtaaatgtatctattctatactttaaatgcttctattgggcaagttatataatgtgtaatttttaatattttgtctacctcatttattaaatcaatgtgaataagaaattcttttgtttcacctttgttatttataactctgggaagatgagttacacctgcccaatataatggactaatcaaattattgtacagagaattagaaatacaaattaaccaaatcaggaaagagattatatgcaactattcaatgttaaggcccaagagagcctatttttaaaagaccatggacagttactagagtttatgtaatgtaattataagtttaagaccaaagaaattgaaatggcatgactatataaagttttgaacacatacatagaaaagtatggaggaaaaaagtgatttggcattcctgaaatataaaaagctcttaagaagagaaagtaaacatgttcaaaatttgaataaagtaagacaagattaggacaaagctttctcttttcaattagattaaactgaaacactgtttattttcataagtgtccaaatctgggtcaaaaaacttcagaactatagatgactgtcagtaagtaaatgtgatatagtagttacattcagtattgctgggggttactgcaaagacccaaacacatactctttagtttttataactagttccaaattgactccacttcaaggctataaaaagatccagggatctcttcatgcctacaaaattgagaattatgggttgctgttgttgttgttgttgttgttgttgttgatgtattgtgtgtttgaatgtgtgattccatgtagttaaaaaaagagtaagaaggtaagaaagttaatgatacagacagcaagaataagctagtgcaggtaagcagaggtaagaggaggaaaggaaggagggagagagaaggctactggtttgtattgttactgataaatacatttatcaagatgcggaatttaaaagcatcaaggaaggagggagagaagctattggtttggattgttactgataaatacatttattttatcaagatgcagaatttaaaagcatcaaggagaaatcagagtcaggctttgctccggattctattttgttacagatttacataagacattgaatctgaatctcacctagaaattcctatgttgccgccacacagatgaggtaatataaatgaaatctgtttagaaattgtaaggcactaaatatgcaggacacgccatgaatcatgacctcagtaggttgtaaacaatcctgttttgataaccatcatccttcttgttttccaaatggaaatgaagttaaatcagaggtgcagagccagttaatgatgcacctgaggacaggattgtaggatgtgtccaaaactcaactagtgttccatgcacactggcctagttccttctttaaacaagagattattttacagaccacattgtgtcttatgaatcaagaatatggtatatcctaaaacaccatttaaaagttaaaaggatattgttttcactgattctaagtcaccagtgacttgctagctttggacaagggcaatgtcaatagcaatgccatatattcagtaataagaagtatatgcaatagaataaaaaattagaaaagtaatattctcacaaaatccattataaagaatgaggtaatttctcttctaaatgattctatagtcccaaaagatataatgccattatagaaacacatttaaacaaacataaagctaaatgaactcataatatgtggcttctgctaaggcaagactgtataaaaggaggataagaaaaatacctcagtgctcaagacaagaacaagtaagaattgtttagattctcacactgttttcttggcgattcagaccttttctaatttaagcagccacctcatatttctaagtgcttgttaattctatacactccaggaattactcttttaacctgaagaactgttttattggaaaagccaacttacaaaattaattctcctctaaaactatcgatgcttttttaaagtatatatctgtatggccactgttgtcaatgctaaagaagtgagaattgaagggaaaactacagattatttcagctcaatccagtgtcacagttgattaaaacgcagtctgtatttgttacatttttgaaaaaccggtgttttcagtttatttttattatttttaaaaataatcttattacattatggatgaataatcatacctagtatctttaaagaaatgcggttctgtgatgaacgtggatattatactaatgctagcatcaatgcattttaattttgtgtcttttcagaactaccgtaaataatgagtatgtatttaatagctgctttcttgccaaatacattgaggcattttcttactaaacaaataaagcattcccttgattcaaaattttatgctccatgtagtactcatgacaggggatgaaaaggcctgttaggctgttatcctaactgttttaagataatttccccaagtttgagtcaacataactcagtttaaacagtttttttctttaacttcccattactctttcctttcttttctctaattttcataccttctttaaaagtagattgacaggaaaatgtaagttgaggtccattacatagggcctgctttgaacatggcccaaaatattatttgcagttacatagtaatatcagtcatactgctttgctatactgtaggtgttataatttatcaattgtgttgatctggctctactaagtctcttaatactttagtacatgtcaggtttttatataaaagatttatatatataattatataaatgtatggaagcctatcttttttctctattttatagtaacataatttagatttacagaaaacttttaaatgacatatattaaagtatattttttatgctttcttttcagttaaagaaaaaattttaaaatgaaacatcattttataagaatggtacttaaagtttaaatgagtcaggcacatagctatgtgaagattggtctttcctatcattaaaaaaaataagcatttatcaaccaattaccatgtctaaggcattacatgcaaggctttgtgtttgatgaccatgactggcatttgcaacctcacatgatttcttctgagttaagaagtcttcccataaaaattattatggatttactggggattcttctactagaaaattagaactctttggcatttattacataatttcgtccaatcctcttagtttttggaatgagaaacaacatggcgtccagtgatattaaatgagttgcctgaagttaacactttctgatcaccccttacaatcaagcagaaaagctagtgctctgcatagtacagcgtctgggggagctgtcaggagacagggctggtgcatagcctcagggcacagactgaaccaaaaaacagaaccaaaatctaagtcctagtcacgggcaagtgtgggatgcacagaaaacttccaagaaaggggcaaaggaaaaattcatattcaagttcaggtactggagaagtagaactgatctaatgaagcttagggaggcagtaccgatcagagagagaatgctttttattgggtagctggactaagaagacaatggaatagtggaaaactaactagtggaaaactaatttcgaaatccaaaggggttttcatgaatttcaccttttatttatcttttaaaatgtttattggcaattttatgtagcctactactctgtccctctagaaatattctctattttccagaatattcctgccttcaatacttatgcccatggtaccacttactcatgaaaagggctcatcatcctttaaccagtcaacatattgcctgcttcccactcaaagtcatcttcccctttatccccagagtttttattacatgtataactcatttggagagggactctactcattagtagggtggtaaggtttgctcaagataaacttaatttattcctgttgttctgatgtaattattagtcaacccccttccttctgtaatggtttggatgataagttatatggtcatttaattcctttagtatttagtgtttatctcctaacctaacctatatctttcacattagaccatagctgcatgtagtagatgctttatcagttttcctgttgattccttgagtggtgagttaccacagtccttatcaatataaagtcctaccaatcacaggacagctttaataactacaatttttatttagactcattatgtgaattttaaccatgttgcccaaatgactatagaaataagaataaaatggcaggggtgttttcattgtctcttgttttatttttgaaatttatctttctgaaatatagagaacattgcaaaaaacaaaaagaaagtaacattattccactttcaaaaaagatccctctccttctcaccaagtcacttattccaagtgagcaatttatctgacccaatgatataactgataaactttctaagtaatttctatcatgaatgccatttcattcattcctgcttaactcctaaacaaagacaatttagactaacactgaaatattaagtgtgtctactttgccctcacccatgaaatactatgaaattctacttttcaaattccagctcagatgtcacctcctttgtgcaccctttcctttcactcttttctcctcctttcccttctctgagagagtgaggcatccctacatctgtattcttacagcatcttgtacatattgatattatagcacttaccacattgtaccataattgtttacatgcctatctgccccattagactgatctcctaggagtcagaaaccaaatatttttcatttgtcaattcccagcttccagccaaatgtcccaatgcctagaacatatcacggttttagcaaatatttgttaggtaaatgaatcagtgattcaaacacttttaaaaagttatcaaaatgttaagtaatgttctgtatataaaagacattaatatcctaaatgagcacagctctaacctaatagtgacacatatgtactgttcatagaatttgtattaaagaaagatcctttcaaagacagaaagtgttcacgatcacaaagtcattctgacgaagtgacaggcaaatgacttccaaagagaaaatgctattctggagtttacacgtagaaaagacaggtcggaggaagcacctgcagcagtgtgaaataatgtcacggaaccattaacatctaggaggcaataccaatgaagggaaactgatcagagatgaggtgctttcattttaacaaaacataaggaaattgtgccctagattagggcctagatgtgtcagttctctctacattttgcccaccacagaggcaatcaacaaagcaaacaacaaagtcagcatagtcagctttgctcagcaaccagtgagaaaatcagtccaactggtgatgagacattaataaaaccaagtcaaaagcaaaatcaaaatcaaaagcaaatagttgcattgaggtcttcttcatctatctttacattttatccaaatagagacataaaataaaaacaactagatatgtatatttgattgcattttttagccataagttatcacagtcctttcttgatgactgtgccacacacagcctctgaaaaataatgacgtgcttacaattccccaggtccttttaatagaaaggaataactcaagaaccattaacatggattaatgtttatgtgcataagcttctatgtatctataatcttctgtgatattatttgggtatataaagcatgtattgaaatggagtataatgagttatcattatattatttcccactaattgaatgctagggttccttaggggaagtacctaataaatgtggttaccctcaagaacaaagtaagctctcttaggtttggggtttgtaaaagtgggaagtaaggagcaataaaagaacaggattgagaaagagaggctatattttacaacatcctagctggccttttagggttcatgtaatagaactagaaggaaccatttaagaccaccttcttatccacttcctgcttctagacaggattatatccacaacatttccagtatgaggagtaattctgtttttaataacctctgaaggagatttaaacactttgatttgtaacctatgctgagttttgacaacattcataatcaaatcattctttgtagagctgacctaaatccctcttaacccagtaggatttcatttcctatctgtgctccttagaggagtaagcttatcaccttcttccatatagtctttcagatacttggttaataaatcttgggtctggaaaatgcctgagagggctgggataagcactaagctcaatggatcttgatggaggctcatgcttagagggtggtcctaaaagtgactcttaattctcagggccttacactgacaagtcatggctaagggagggcgacactgcaggatcatctcattggaggtgctactggcatcctggacagacaagttctttgttggtgggattatcctgctcattgcaggacatttaaaatgtcttccttcaccctcagactcccccgacaagatgctaatagcacaactcttcagacattacagcaaccagaaatacattctccatatccacatttccaggtgcctcatgagggggtgaaactgcccctgtttgagacccacgggtcaataaccccgagatgtacacttatcaattaggccagaaccaatcagtttgtatatgcggaagggaaaagtcaatacttttctttggtatatttcaaatagacttatactttctttcatattcctggtctgttataagccataaagaaataatttataataacaacaactgtcacttactattacccagcagattctgtttgccatttttatatattacacaaccatatttagataaaactaataaactcattttaaatatgaagaaaatgaagatcacagagatcaactcccctgtttgaagtcccccagattagaaccaatagaaccaaatctacatctttccacttccaaggcccttactcttttcagaacatcgatctgtaatatatgctgccatatacttgtagatatttttctaggtgggtcccatgcacaggaaggagacctggggagaagataacactacacatgtgataagcgaagtcacaaacatgaggaaggttactcagagacttgacagagtaaggagagaaggcagtcagcgtcacaaccctagaaaaatagcagagagactagagtcagggaaagaagaagaagaatttgcataaatgtgtttctcataaaaacctaaggcattaatttagaaacttcagaatcacaacctttatatgacaacctaattacaccaacatcttactgcaatggtgaagatgtgcgaaagaatagtctttagggcaaagacaaaaatgcaatgaccaagtaaattttttttttatctctgtaatcctacaattttttttataatttaagaaatagcaattttaattcccaacacagaattaaagtattaattctaaagtgtaggtaggacaaattccagttttagtctatatttctatcttccaataaataaatattttgtttcaggaaataaaatcgtggagtcaagatatacacaaaactgttcaatattttaggtacataaacatgaaatgcttaaacttccccttgtaaatagaattttctgggatacatgtgtaggatgtgcagatttgttacataggtatacgtgtgccatggtggtttgctgcaccaatcgacccgtcatctacattaggtatttctcctaatgctatcactccccttgccccccacccaccagcaggccccagtgtgtgatgctcccctccctgtgtccatgtgttctcattgttcaactcccacttatgagtgagaacatgcggtgttttgtttcctgttcctgtgtttgctgagaattatggtttccagcttcatccatgtccctgcaaacgacatgaactcatcctttttttgtgtggctgcatagtattccatggtgtatatgtgccacagtttctttatccagtctatcattgatgggcgtttgggttggttccaagtctttgctattgtgagcagtgctgcagtaaacatacatgtgcatgtgtctttatagtagtggaagacagtgtggtgattcttcaaggatttagaaccagaaataccatttgacccaggaatcccattactgggtatatacccaaaggattataaatcattgtactattgatgaactcttaagggtaacttttccttttctttatgggtattaaaacaaaagggagacgataaaaacaatccagattttcaaaatgtaaaactgttttgctttattgtgtgttaaatattcttttcaaccacctgaaatcttttgtggctctgtataagaacaataataagtagattattgctaaattttgagagaatctagcttgtaataaatccagaagtgaattatggaagaaaatatggacaggcactactgacaaattcggctagacaaggatccatgaaaaatgcaatggtgataaagttggttgtgaagaacttggaatctgagtcctgaagtgtttatagtgaggagggccattgagtttttgtgagtagagcagtgactcttgattgtcttatccattgtaagggcaataccaatcaggaggacctatttagaggctattgcgatagtgctacaaagatgatattaggatggaaagagctaatagaaaccgaagaatgagcagagggtttgcatacatgtcaggagacttggtaccatataaggcaaagaaaggcagcctatgaagaaagatgtcaagggcagagtatgaacaaataagaagtggcagaggaaaagttattggatttactgattagggggccactgatgagttttgacaaagtttgtaagggcttttggaagacggagttagaaaagggatacaattttcattgttgtccagccatcctggtttcctaatcctgctttaatgaatttagcattgattctacatcctgaaatcttcaagtatagactattctacaagtaaagtgttccctcatctttccacattctttccttatcccacatcccaggcactgcagttattctcagttcttggactattataattccatatcctgtccctaatcataagatcactcattttttccacatgatcctattgctctgcaaacagtgtctttgttggggctgttactgaatactaacgtttctgtctctttggtggagaacagtacactgtaacttgaaaagtaacaaacagctgataaaataccagtttttgcctggctcttgttttgacaaaaacacatttaagatctttgtgttaaacttacagataattttaaatgtttaataagattaacggggcttctcccagtgatacaacagaaggggcaggtttcagagctctgaaccctctaatcacgtaaggttgttttcatagccttcatgccagatgctctttttggactggctaagcccaatatagtatgtatataataaggatccattatgtcatcctcaaaatactaaacattgtccagaaaaagagcctaaacataaatctgtattatactcattatcaatagattctccaaacatatttcatcttataaactaggccttgtatttttttaaagcacattaattactataagccttctaggaaagtatcaaagaagagaataattagtgactttcaggtttgctgtgtgaagctaggaatcacagcctatgatcccccagttaacactcacttggaatggataagcttcaaataacaaacagccactactttgggtcactttcctttgtatgactgggtgggaagcacgtctttgatctctaacacagacccaactgcagaacccaaataaggactctttgggagccactggttttcagagtttcactttaattgtctaggtctataaaagaaacacttatggatataatgtgtttcttagttaaaagataaaattcacattaccctaaagtttctggttgatatttacttctgtattattaaaagaggtgagtggatagctgaggaatggaatgaaaataaaatggaaatgtatgaacaagagtcaacttttcaggtgcttccaggaaaaaagaaaaaaaagcattttttttctccctaaaactttaaagatgtagctatgatatcctcggcaaaactaacattcactatgttccacacgtatacaaaattattcagaaattctaccttggccaaagaaatttcagaacgatggcaaattatgcatatgaaagcaagcaggtaattagtacaaacaaatgccattactataatattgtatttttaacatacagaggagcctgtggtaccaatacagccataatttaaattaacaggcttctcatactacattcatgaggctgcatatagcaggaccgatttaacacataaagtattttatttgtgggctggatgtcccatctcagccttaaatgtttctgtcaaagttttcacaatggtgtctcttgacacctgtttttaataccttctcctgtctgattttctttcctagtgggtttagaaaacattgtaaaagcttttctaatgttgaacctcacatcatttattcctggcagagtttaaggctgtcaccccaagagctgtcctttttgttaatgagaataattgatttctgtcccagtgtatatttcattgtatattttggatcattctcaagtgtcccttaagttttttttcctttctttccggctcaaaatatcaagttaggttcaccttttctgacaaaccttgttttctaagaattttatcatttttgtttctctacactcccttcaatttgtcattgtcgttttttttttttttaacagccccacgagtaaaatcctctagagatcattttagcagcagctagagaactacaagaacataacttttatttcatttccagtttttttgcttaaacaaccaacaaaaaagcacacgtggttccttttgaactgaaagtcattatatatacgtaacctatatatatatgtgtgtgtgtgtgtgtatatataggttagcacatagtatgtgttcaacaatacttgctattttttaaataatattgctgtaactgataggtgatagggagacaaagaaggggataaagagagacaaggagagagagggaaggcaagcagaaaggttctgtgggcaaatgtcatgatcatcattgttattctgaccccttgggctactgtgagcacagatgacactctacctccaaaatattagtacttacgttcaaaaaatttctcaaagaaaaagaagttgatgggttcctgctcttactttctttttcttttttttcttttcttttttttttttgtcaatagcatgcttttattcagcatgccatgttttggttcttttacctattcacattggaaggtgtgcttttgcttattttcttaagaattcattctgagaaggtcattatacattgaagatgaaatgtgattttttttttcaaagaaaaatgagcccataggggaaaaaacaacaatgaggactgaggtaagcttttctttcattgtctcctctccctttattttatcttttaccgagatttaactaggcacctttgcgagccattctccttgctttggttgatggctaatggaaaggaatccactgccatgattttctctgacaactccaaatggcttctgacactttcccgttcacgtaagtgtggacctctcccctccttacacacccatcaccatggctacctttcaatcagcccttcttcattaatattagcaggggaaaccgtttgtgtaatttgtgtccctataatagccggatagaggtaaatcatgcagttacatgtgttttcatcacaggcttctccccatcccaagttatagctgttagcttcccaaaggaggaaagtggaaaaaaaaaaaaaaaaggaacagatgaagaatttcatagatgaaattgtatctgaagaccaggtgtatttatgtctctttagccatcataatgtgatccgaggctatgatgttcaaaatattgtcgagctgagtgcatatttctgaaaaagagcagatttagctatcttcatatgacagcctacgggaggactataataaagaaaagaaattagttttattctgtgtaagtctagaaggcagaagacacagaaagcaagcgcatactaactcagcaaagggaaaccttttctaatcactagaggtggctaaaagtgaaacattccccttcagaggtactaagttctaacaccagtagcattcaagcaggggtgaatgagcttcattattgcaagatgtaagtaaaagttttatattatactggagactgggctaaatcactggtttccaaacgttgttactcagtccagcgcattgcattagagtttagttaaaaagtaaatactgaatcctccccttcaaggactgacccacacctttgtaggtgagactagggaaattggcattgaacacatacccctggtgaatccctgaacacaatcaggttttcttctcactcctaagcagagatgactcctgagacccccagctgacccaaagcttttcctgttattgattatacgatcaggagtatataaacgctatataccacatgactcacccctcctttatttcatgtgtcaactctttgggtctcagagtccccctgttaaggagctaaatatagtcacatagagataaactgtattttaaaatacatgtgtgaaatgttgttacaggattcataatgtcctaatgaaaatgttaattcctaaaaattggaaatgctaggcataatttttaaacatgtagagcatggaactcacagaagagatagatactcagctcagcagagacaagaccatacctgcataatttcctagtactttgtccaatgtgtagcacagaaatgttgtccaataaatgtatgttgaatgcattaataatttaaaaggttgccatgacatccaatttttctggataactgaaggaaaaaatgagcttctaaagtgcaaaatgagcttatagactgggcgcggtggctcacgcctgtaatcccagcactttgggaggctgaggcgggtggatcatttgaggcgaggagttcaagaccagcctggtcaacatggtgaaaccccttctctactaaaaatacaaaaattagttgggcagtattggcatacacctgtagtcccagctactcgggaggcgaaggcaggagaatcacttgagcctgggaagcagaggttgcggtgagccgagactgggccactgtactccagtctgggcaagagagtgagtccttgccttaaaaaaaaaaaaaaaaaaaaaaaaaaaaaaaagaaaaaagaaaagaaaaaaagcaaacagaaaaacttatattcatatagcaaataagtgtgggactgacaaaaataatgtgttaatcacatttagcatattaaagagtatgtagctttgaaaaaaccccatgttcatttagcctcttgattgatttgtgtctagcctcattttacaaaggctttgtggtagctgtactaaattacccaatgtaatgataaaatgagctatcacctattttttagcctttcaccagaaggtcaaggtgtcatttaaaattatattgctggtctctcacttagcctttggctgaggttgtctggctcactacgataaaggaaaggaccaaccaattattttcttcctaccaaaaacagattcaagttcttattaaatactatgtttcaatatgtttagttctggcaggcttaacaactggtttcttttttatgaagacaaaaaaaaatgtggtcctagattaaatgtctgaaatagtgcaaggcttttaaaagaaaaaaagaaacacacattagaagaagggaccacagagtcttgaccttttatctctactgaaaggatcatttaaattcacttaatccttgtggttcacagaagtgtaagaatgtacaatgaaaagcatgaacacttttatcagtgcgaggtggaaaggaacatgaacaataagcactggctcctttgaagtgagaggtgaagaaacacgtcctatccccaacatggctaagaagtatgaatagaaataaatgctaatacaagatttacaaagatcttctgcttctcaatttttagaacgctaaaatacaactgacaaatgtgtctcagagaaagataaaatagaaaagaagaaataattatatcaataatttactgtgacggatccctgttcccataatatgcctagggtttgtcaatagaagtctatgaaaatatagtagtccaggaaagttaacattatttttcagtactctctttctttaaacagaagttgagatatcaaaattgctttcacactgtcaattggagttttctatctagaaatatctttggaattaagccaatattctttcgctttggtctttcacaatacaaagcagtgttaaccataatttgtggaattagagattgaagttgaaatatgacattgaagtgtgagaaattttaaaatttacatattacattttagtaaatgtttaaaattatctatcctattgcagagtttgaccactctagttcatagattataaccacagtacaacacctaataattccacgatatatgttgaaaattctgtaatattctcaaaactcaatatattacctttagaacaaagagcatttatcataattattccatattctataagctgatattatcagaaaaaaaccattcttttaaattttcaaatcaaggtgcaatttaaataaaatgctccaagtttgatttgtttttcaaatacatacatctatgtaacctccaatctaattacgattgataatatttccatcacctcaaatgcttcatactccttcgcagttttctctctgtctcgcccacatgaccgtcaggcaactattaatctgctttctgtcactatagattagttttgcctgttctaagatttcatatcaatgaaactacacaatgtgtatctttttggatctggcttttttttttttttttttttttgctaagcttcagtgttttgctaaaatttatccatgctgttatatgtatcagtaattcattcccttttattaagtagtatttcattgtaataagatatcacaatttatttgttcactcaattgttgtatttgtgttgtttccagtttggggctcttaggattagagctgttatgaactttcttatgtaagtcttattggcagtatttcttttggttaaaccaattatgcaattttaactacatgtttatctttttaataattgaaaagccatgaatgtggtatacagaattctcatgcaagtataataattgggtatgaaatcatgttttgcaagagttattaaataagaacttttcctctatcaaaactttcatttggctttagaccattttcttagaaaaaaatcccaaatatttaaagaatttgaacatactacattttgtagtttttattttcctatcttttaattcttgacaaaattctatacaattttaatatacattaaaatatagaattcattcattcaaagacacacttagcgaatgtgctaaccacactgctcacaatgtggtgaacttgaggcgggagtgaatcgtacatgtaaatcacagagcagcatatgagtttccataataccatgtatgtttcacaacagggaaggctgacagttttgctaaattcccattcctctctgaccgctgctccctgcttaactgtcatcatagcattaagaagcaaaaatatttataaaatttgaagaactgtagacattagcttgagaatgtgagccactcaccagatactttttgtccttctttaaacatttctaatctatatctaggaatagagagtaattctagcacattgggtgaactatatttgtttatattgttgtataagagagagcacacaaaagatactgaatataggaattactcatgttttgtttctactcagggctttagatttaaattctgtccctacagatgtctcattatttcattgaccataagagtaaaaacattactactggcctctcaggaaagtgggagagaggatgaaaactttttaatgattgcttaaatacaggtccctcaaaaatatttcctgaatagtcactctaaatggagtactcagcagatgagcaagtagagtaaaaaatggtatcagaattccttcccgatcttaaatcctgtgggtttaatgtaaaatgacactgcatgcaaagctgcactaaacatgcacattcatagagcacaacattttcacatggcttgcaagggtctttacaatggccttgacttttcttttccatattctttttaattcatgagctcatattctaccttccatttcttttaaatgattcttaaatccttacctctgtgacttctcacatgctgttccctctgcctagaatactttttaacctggataacctttattcctttttgaggacatgtaaagacttcatcttatccaagaaaccttgagcctgggttaggtaccactcttacgtgctttcatatggcccctctagttgctatttatttcactctgttattgtctcttgacatcttaacattccccactaagtgcaagctctgtgaatgctagaaccatgtgtggcttgattcctgttttactcccagagtttattgcagggtctggcatgcagtggacatcttatgaatatttgtaagataatgaatgaatgaggttgaatacagcaattactgagaaaatggaaaataacagggtacttagatgaattaaaacaggctccctgaagtgggtgagagccttcatcctgattttaaagagaatgaaatctaatgactgatgcagaacagattggtgtatgatattgtataaaaaggaatgtacaaaagtcatattctaggaactgcaagaagtttagcttgaccaaaagagcagactcttttagtgaaaaactagagaaattgagttgaaaaattaaaaatcagtggtaggcaaaactatggagacagtaaaaaaaatcagcggttgccaggtgttagcagggaagggaagatcaatagacaaagcacagagaatttttagggaagtgaaactaccctgtatgacactataatgctggatacatgtcattatacatttgtccaatctcatagaatgtacaataccaagagggaaccctaatgtttactatggactttaagtgataatgatgtgtcagtaaaggcttatcgattgtaaccaattaccactccggtgggcatgttaataatgggaaaagttttgcatgcgtcggggcaggggaaagtctctgtaccttcctctcaatcttgctgtaaacttaaaactgctctaaaaaaaaataaggtctttaaaaaaatcagtggtggttggtgaagcatttgaagagctgaaagttaaagatttgtattaaaagccctatcagtaagcaggtttttacatggatggatatcatgctgaaaatgatctttgaagaagaaacactaatatgtaatcatgtttgtaaataaacatacaaatgaaactatgagtgtgtacctgtagactgcaggtcataaaagaagagactgaatggtatttatactgcagaaagcaggcagtttttgagccctgtgtccacggcttccctctagacggtggtgtgtgataccttagggagcatcctcaggctgccactgagacacttcacagcaatacagtgtcgattaaattggacactagtaaggcatgggttagtggtctggaaagaaacattctgttcattcagtaagtctgctctcgtttcattttaagtctttaggattcgattaagtgttaagagctgcaaagggagaagtcagggttctggttagacaataaccaggtcattaattttccatatttacatataatgttcctcataatacaaatctagcttccgaaagctctgaaaatcatcatgtatttaagtatcacattgtgtctcttcagtttatcctttgtgatcaaataaatccggaacaaaaaacgcatgctctaatcattgaattaaatagcacacgtatgaagtgtgtggctgtattgtctaaataattaaccactacttagtgattatgctaaccagtgcatactggaatgcataagattaatgaagcctttggttacaatttaaaagcctccctatcaacggtttctttcaccgaactaaagaaaaaggattttgcaacttttacttactagtcttatattggaaacatctggatcatatccaatactcatgcttagaggccgcatcagagatcagtatctagtgagcaacatgtacggtgaaaatctgaaaggataaaaaatgaagtgcaccagggaggcagcatgctatggtagaaaagtgcgcctctagagacctagaaagctgattgtttatcccatctttgccacttgctggttgtgaaagttaggcaaagtctttaatctccatcaatctcagcttccttgtctgaaaaggatggagaaaaatgcctgtcacatagtgctttgtgtaaagcacataatatagtgctggggacaaatcaggtgctcaattggcatttactattagtattggtggcagttgtagcattgtaacttctattattttctctactccccttgggccaaaatatatagtgttacttacagtatgcttgtataaaatattcttacgatgtgtacaatctgttaacaagtctctgcattacgggtcaagcagaatcaaaaagtttcagagcaagagaaaatcaattaaaacatttgtatttactactggcatcacaaaagagaaatttttcttcctgtctacagatattttcaactcctcactatttgcttcttgctaaatacaaatgttcagaggcttgggaaggaatcatggcaaggtattaactcttctttgggtagatgagattgttgccttctgcctttggattgtttccccaaataatgagccaggatgctagaacagtgctcacttaatccccagatgagctgatctcacccatccttaaggtgattcttttttccaccttatgttagtagttcaaatggtttccctggatcattgcatttccttctatcttttcaaggagttgggtgctgcccacacccaccgctggctccacggtgagactgtctgctttgtatttctttcactttggatatccttagaaaagtgtctgctgccatgattttgctggtcaggatcaaagctgccatagttccaagcacaaatgtttattgaaaggaaaggattggggacagtgaaaagagctttggaaacagacagatttaagggcagatccttgttccacaatatagaagctgcgtgaccattgataatttcctcagcatgggaaactgggagcctcagtttcccatgctcagataaccattttgtagggttgtcaggaggaataactaaaacaacaaatccaaagtacctagcataagactatttttcttcctgtccccataggtccaggtctccctaaaaatcattctcagtttttgttagcaaagtcatatagttcttttcagccaaattatacacctacacacctaacacatatgtacaatcatggaaaggtaaataatgctaaagttttcatcttttaaaccaggtggaatcctacagtagcatcgctctcatgagttcttctgtctcccatttgaagtagtcctagaattaaggattttctttctgtctcattaaggaacacagtctaaaaccatgctcaaatgataaatcagagaaactgagttagcagtacacacatacacactcatacacagagactctgagttctagtccccaagctcaactaggagtgcccacaacttactttaaagagtttcatctcctaacagtacattttaatataaaagaccccttccataataatggaagcaacataacatagagtaaacattgagacagccacacctggatttaaatcccagatttgtcatttactaactgtgcaactttgagacatagcttataaaggccaataccgctttctccgtatgttaaaagctggtaatatctacctgttattgcaattaagtcaggactttatataacatttaatacagttcctggaacataggaagtgctcaataaccataggtatttattattacttgttggtgttttctggtaatcagaatactaggaatactggtttccttataaagtctcctggtccaggcgtggtggctcacgcctgtaatcccagcactttgggaggccaaggccggcagatcacgaagtcaggagatcgacatcatcctggctaacacggtgaaaccccgtctctactaaaaatatgaaagattagctgggcgtggtggcgggtgcctgtagtcccagctactcgggaggctgaggcaggagaattgcttgaaccagggaggcagaggttgcagagagccgagatcacaccactgcactccagcctgggcgacagagcgagactctgtctcaaaaaaataataaagtaaaataaaataaaatgtctcctgaattgttcataaatacatatagaacacatatgcaaataatcttagcctgccttccccatgccttttctaggactgaacaagcactgacagtcacatttacaatgcttccaacatgcacttattttaaactgaaatcttcctccttgctctgtatctgatgtcaaacagagcaagtgtattcctcctttcacagagaagcatttcaaatatccagtggcagccttcacatacccttaagtctttcctccaggctaaagagtctcagttctttcaatgtagtcatattttggggtttctagacatttcaccactggtcatccttctatgcaagagtgagtgactgaatctcagcagagtttaatgtctaacttgttagggaaatactaacttggtatttaaaaaagacaaacaaacaaaaaacccatatggtcatctaagaaaaggaggatttagtggggggaaaaattccaccatgctaataatacaccatcttttattacaggaatggtttgacaattttttagagctaagaagcaagagcatttgaagcccagtgggcttgtttctgctgccccatcaggaggcttccagaaacaagatttctggtattctcttatcctagtttttaaaagacttttctgtcttctcattgtataccacatagttcattttttttttctttttaaaagcatgacagtgttttgctctgctgcccaggttgaagtgcagtggcattatcatagctcactgcagccctgagctcctgggctcaagtgattctcccacttcagcctcctgagtagctgggacaacaggcaggcactgccatgcctggataacctttttatttttgttttgtagaaagagggtcttgccatcttgcccaggctgctcaaattcctggcctcaagagatcctcctgcctcagcttcccaaagtgttgggattacaggcatgaaccactgcacctagcctcatttcttttttgatatgacataatcactcaatttttacaagttaattttctaagcaagacaacttcttaaaagcaaatttaagctcaactgaattaatgttgttcatcttacctactctggaaatgattaaatgtagcctaaccctcctactgtggcaaaatttaatatccttggctgtgctatcaacaaggagtacattaatcccaaattactattacttcatatacctagagttatatacttgaattaatcagttggtatgtgccacaattgcttttttccttcatccacagatgaaggacaaacatgttagtttgcacaagttaagtgatacaaatcttgcatcaggtttcctaagactttctcattattttacacattttaacaaaaagtaacaggcttcttttattccaagcacttgtcattactatgcaaactgatgaaaaaaaaaagattgtcagttttctgataaatagactgatcaacagaatgtaagagttacttttcatgtccactttaacaggcaaaccaccattcaggatgtgttgagtggtttgatgctctcattacttcattcttctttgagatttattttcatctagtgatcgaactagagaggttgcttgaataaagcagatcaattttagacatgatacatgggagaacactccagttctagagaccaccaatccagcctttattttaccacactgcaatcaaaatgacccttattttgctttcatcattcaaagcttttaaatagtttacacaactacaacatgtgctatgtggatcatgtatttttaaatgctgttatcacaaggtgaaactataatttgccaattggctctccactctcatttctactatctttttccttttcatctctctaacatttttgatatttagtgtttaatctcttttcacatgttttttcttttcatttagggagagctttggaagtttgtcctctacatcactgagttgattctccgcagtgttgtctgttattctattcatggaaatttaagcctgttgtttatttgtatggtggtctggcttattgaggcttggtctatttcacttcagactgcttctcagtctgctttctcattttgataggaagtattatgaaataagttttaaatactttaaacttttgagactgagtgcacggacttaaattctagctatgccacttacattatttttcctcttaaccaaattattaaatttctgaaagctttggctttctcatctttacaatggatatgctactagtatttatccaagggctgttataaacattaaatgagatcatccacctattatacttagcatagtgtctgacacataatagcaatacaaaaaaagattgccatgaatacaaataaacctccatcctcatctcgtagagcaaatgtcttttttaacctcactgtaaaaaatacaatggacatttcctaaaatgctctgccatttcctgtaatgaataattttgtgagctttgcaatttttttcaggtctttaagatactatttctctccctttttattatgtctacattgcctttccccatcctctctcatccttaaatgatgaatacactttttgaaactctgagatatactatagttattttcttccagctatagaaaaaaagtatacctattcacttctccttataagattgttaaaggattttctattgtacatgtgtacaagttcatttctttaggatgttaggaggactattaagaattcactattagcctgcctctgttagattaatctagaaataatttccatgattaccaaagtgccttaagtttaccttcagagaatctgagtattccttttttaaaaaatactaatacgaatgctttccactacagtgaagttacaggaaattatattcatatttccaataagctatatcagtgaaatcaaatgagtttgtcaaaactgtgctgatcaaataaaatcttcctttgatattatactggttgatcattcctaatctgaaaattcgaaatccaaaaggttccaaaatctgaaaaatttcaagcaagaacattatgccacaagtggaaagtctggcatctgccctcaagggacaggttacaacaaaggtccacaacacagtttattccgcatcccctaaggaaaaaaagatcctcccaggctcattcatttggtgatgccactgtgctgcttagttaccctgaatacattatcttttcactgtatttatggcatgtcatgtttttcaccattaggaacttatgtgtcggtacgtttaagaaaataattgcttatatactatcctgatagatacttatttatcctgattgtattagcctgttctcacactgttaataaagatataccccaaactgggtaatttacaaaggaaagaggtttaattgactcacagttcagcatggcttgggaggcctcaggaaacttataatcatggcagaaggggaagccaacacgtcctttttcacgtggcagtgcgagagagaagtgtcaaacaaagcggagggaaagccccttacaaaaccatcagatctcgtgagaactcactatcagaagaacagcatgagggtaaccaccccatgattcaattacctcccactgggtcactcccacaattacgggaactacaattcaagatgaaatttgggtgggaacacagccaaaccatatcactgacagtatataactttaactttacatacaatatacttttacctttatatactatttagagtcagaaatgatggtgataaacaatcacagattgtccacgtgggtgactgagagtgacacctttgctttctgatggctcactgtacacaaactttgctgctgttgttgttttgaatcagggtctcactctgtcacccaggctggagtgtagtggcatgatcttggctcaatgcaatctctgccttgcgggctcaaacaatcctcccacctcagcttcctgagtaattgggactacatgccacatgctcagctaatttaaattttgtgtagtgataaggtctcactgtattacccaagctggtctcgaactcttgggctcaagccatcctcctgcctcggcctcccaaagtgctgggattactagtgtgagccaccacatctgtccacaaactttgtttcatgcacaaaactatttaaaatattgtatgaaattaccttcaggctatgtatgtaaggtgtatataagacaaataaattccatgtttagatgtgggttccatccttaagacatcgcattatgtatatgcagatattctaaaatacaaaaaattccaagatctcaaatacttctaggcccaagcattcaggataaggtgtactcaacctgcttattgggttcatccttgcatttgaagtcttattttgtattttcctactttacttggcaattgtgtaacaaggttcctcatataacattaagtcagtatcttgtggcttgtttttataatcatatataacactttggcatctatttgtgaaatttcttgtctttagtttgaaagtcaaaagaccctccaaccataaaaagtgagtaccaagaaactttcaaaacttaaaaaatatccatataacttttatatcaaaataaaattcagaaaattaggccacatggaaacaaaataatgtaagtcccccatttgagaagagaaactatgaaataaaaaccatgaatttctctctaagcaagaaattaattttagttaaatagaaattatgaagcaaatcacttggacctaaaattattttatttatctactgtgctataaattgttttctcatactgagaaaaagccaagcaatcagtaatttgtatgacccgccaagctaagcaaataacagatttattttgctatgtaatgaggttgatagaacagtttcaagtcagattacatttgactatgctctgtttctattacatttgccacttaatggtaggagatagagattctcctcttgatagactgttttcctctccaatctgtgtttgcccattggaattgttatgaaacatgttgtggatgtttgtgaaaagcatggtcagtgtaggagatagttcacatactatgcttattaatcaattcagataagactcaaattaaaatgaatttggaagcttcttgtttatcttcttcctaaaactaagttctttatttttcagctccacaaaaaccttaagaaaatatgtggtgtttgagagagaggctcaacctgctaactctcatcttttaaggttttagtaaaagtccatctgacagtgtttaaacctgaaacataatttaaaactttgtttcttctagtcaattcttctcaaccactttgaacaaatcagtatacctaccatatatattggcaattttctgtttgatcaaagattgaagatatctgactgttaggatatatattgcttgtgatggaataaacaaaaaacatgattatgaattgagttgaatttaccctaaagtcatatcaccaaattgaggtttatcatttctcatcgtgacacttttcaacagttctctgacacctttgtatagattcaacttctcttaaatacactctgtcaaatgggcataatttttacttaagcaaatggaaaaaatacttaaaagtaatatattaaatttaaataaatttagtatagtaagtgtgttacatttacatataatttaaatatatgaaagtatattataaataaaatattaaattttaatataaatatctaaaaagtaatccatgaagtctacaatatattttgtttctataacattgaaatgtggagactgataaaaatccatgttgtcatttcttcagtttttccattataaaaattttacagtaagaaagactgaacattaattataaattagaatataaaatcaaaggttaaatctattttcacctaacgatatcaatatctggggccttcattagtatgttcactatataaacatctggttggtttgatcagactctgtgattttgactgtaaacaagattccaggaggtgaattattacactgggtacatttggcatggggttgggaaaatttgagagatttggttaataaaatattgttttgttcaaaatgtggaaaggaaatgcagatcatatttgtaataaaatgtaaggtagagtacatgtgggaccacagtttttaaatacatttgatgatgattttctttcttttgctcttcagaagccaagggatacataattcatgtttggaatcttacgtagggtgtaggaacactaagttcacagaaaaggtggtatttgtgctaagaatttctctaatccaggttagttaataggaatcaaaacaagctcaccctgcctttttccttttctttcttccttttcttccttccttactttcctccttccttccttcataaactttacttttttggaaactggccttggcctcatacgggttaataaaatgtcaatttacaaacagctatacttgtttattctcccaaacacttccagttaaaaggctttcttataatcacgttttcacttttccttaaaccatactaaattttatcatttccaatcccctgcaacctttgaggagaactaactttttggaatttccctaaggtttcaatgagcaacaaatgtcttcaggagaatatgatgcatcatatctatttaggatgtgccaggattctcctgctgatgaattctcataattctagacaaagttaatagaagaagggaactccccttgagaaaggaataaatggtggagagtgatctgaacacaaatggtacagttcagtgcaattatgtctagagttctctactggatatcaagtacaactgtcatttggtatttcaaaaacattcacagtacacatggttggtctaatgggaaatacattattcatttgccaaagtttgattactatttgaaatcattttccacaaatcacttatgtgaattgtagaaaaaggtatgcaggagagcaaggtatacatgccagattaattttccattaaaaataatttatgcttctcttgtgacttaagtaataacttctaagagctgtaatgtataaaacattacaagcaagagtaaggattcctaatacttcttgatttacttaattgaaagttctttttatcttgtttatagtcactaaatagaataatgtctcatgttacttaactttgaaatgaggataatactagcaccttcctcactggttagttataaagattaagtgacttaatacatgtgaaataattagaacaatgatagagattagccccccaataaataaaagttataaaaatattatctgctatggtcattaaagctgttaataaatattccatttctttcttctttccagacaagatgattgctcttccccacccctttcatgtggggtgattagatttggaggtagaaaggaagcatctattataaattccaggagcatttattggatgactaggtagataaaactggtcaacaaagagctgaagaaatgataaattcaattttggacacagagtgtttgtgagtatttgtgaacaattgggtggaattgtctgctatgcagttggttaaataagtctggggctagaggcagatttggagtcaccagtttataagtgactgttgagtcatgggttaaaagaatcacccaagaagagtttgtggagaaatcttgatgagtaatgtatgaggaataatgttggaagattttcaaaacttgggaggtaactaagcaagggtgagaaagaagactgaaaaggcatggccaaagttagaaagaaatgcagaagtaagtgacatcatagaagtcagtacagaaaataaagtttaaaaaaaatcccagagccaaagaaaatattgagttactgcctaggaaaatagtagctttcaatgaatatgtatagtgttcaatttattcttgcaaaagtttatatttcttaatttcatctgtaagaagacagtgtctgttttgaatatgttaccatttaaagtgcataaccccctggctggattacaattccaagttgtatctagttgtagaagcagactgtaacacaagtaagagggttaaagaaagaaattaatattaatggtgcaggttttgtggcaaacattttgagattgaacgtgtgaagtttcagaatttctcatctgctatctaaagaggctaaatcattttgcgttgaatggatacagatacagtttttcatcttcataactctgactgtaaagataatatgactgttctagatacaacagtggttgtccatgaactaatgctccaaaaagcacttccctatagatatgaatcacaagccaattgcttcaaatatgaggagtgtggtaaaacaaatgcataaactctgcatttctgatgctatttttaaaagtaatttatcacttgtgttttgttacctgaaacttagtttatataccatgccaccatgggtttattgatttggtctttttctcacattaaatggaatatgtgatattcaagatacacacacacatacacacacaaacacacacacacacacttttcttcaatgaacagcttagaactagaggaacaaaattagttaattaaagaataccatatgtaaaaatcaactcgttagattaaaggcttaaatgtaaaacctgaaactatcaaaaccctggaagataacctaggaaataccactgtggacataggccctggcaaagatttcacgacaaagatgccaaaagcaattgcaacagaaacaaaaattgacaaataggacctaattaaactaaagagcttctgcatatcagatccatcaacagagtaaacagacaacctacagaatgggagaaatatgtgcaaactatgtatctgacaaaggtctaatattcaaaatgtataaggaacttaaacaaattacaacaaaaaaccaagcaaccccattaaaaagtgagcaaaaaacaggaacagacactttccaaaaggagatatacatgtggccaagaagcatatgaaaaaatgcgcaacatcactaatcattagagaaatgcagatcaaaatcacagtatgataccatctcacaccagtcaggatgactattataaagcagtaaaaaaataacacgctagtgaagttgtggagaaaagggaacacttacacgctgttggtacaagggtaaaatagttcaagcattgtggaaagcagtttgaagatttctcaaaaaacttaaaatggaactgccattccacccagcaatcccgttattgggtaaatacacaaaggtatagagacacatgcatgcacatgttcatcacagcactattcacaacagcaaggaaattgagtcaacctaaatgcccattaacagtaaactggataaggaaaagttagtatatatacaccgtggaatactatgcagccatgaaaaacaagaagatcatgtcttggctgcaacatggaaggagcaggaggccattattcttttttttttttttttttctgaaacggagttttactctgttgcccaggctggagtgcaatggcatgaccttggctcactgcaacctctgaggaggccattattctaagtgaacaaatacaggaacagaaaaacaaatactgcaggttctcacttgtaagggggagctaaacactgagtacatgtggacagaaagaagggaacaacagacactggggcctacttgagggtagagggtgagcggagggtatatttacaccacagaaattggcaaacactgtaaattggagtttcctttcctttttgggggaagaactggtttaccagttaatatagtttggctctgtgttcccatccaaatcttatcttgaattgtaatccccacatatcaatggagggacctgatgggagatgattggatcatgagggtggtcccccattgctgttctcatgatagtgagtgagttctcacaagatctgatggtttataaggggctcttcccccttcactctctcttctctctcctgctgccatttgaagaaggtccttgtttcctctttgccttgtgccatggttgtaattttcctgaggcttccccagccatgtggaactgtgagtcaagtaaacctctttcctttataaattacccagtctcaggtatttctttatagcagtgtgaaaattgactaatataccagtgcaccactgcttttaattccagggtaaatctaaagccagataaccactgattttctccttattaaatgtatataaggactgctcaagtgatgctgacaaactttccttcagtggactgagaagaagctgattccagtggactgtgaagaagctgattctcattttgtttgcaaacctggtgtttgggtacatcgttttgtgtcatgtaggccaatattttctgggagaactgtgaaagaaactagaaacagataattttatatttttcctatgaaaaaatagctgactggattaacgtccttttgacttaacatttccaggcaacaaagagtgactggaaatgaacttttctaaagcaaattcttataaagatgccttaaactgtttgttcctagtttttaacaaatgacagtttcctgctttcattgtctttgacaaatacactgccaatcacagcaagactgtccatcaattttctcaaatgggcaacaagcacaactagctgagttctagtggaaacttaccatagagtagctatgtgatattgaaaacctgaagtttctagtttttatattaaatggagtaaatggtatctcaagcatcatgcccatttatcaaaaattaatattctggttaggagtcatttagtaaatgatatggtttggctgtgtccccccccaaatctcaactttaattgtatctcccagaattcccatgtgttatgggagggatctgggggaggtaactgaattatggaggcaggtctttcctgtgctattcttgtgatagtgagtaagtctcatgagatccgaaaagtttatcaggggtttctgtttttgcttcttcctcattttctcttgccaccatcatataagaagtgcctttcaccccccgccatgattccgagaccttcccagctatgtgcaactgtaagtccaattaaacctctttttgttcccagtttcggttatgtctttatcagcagtgtgaaaacagactaatacagtgaactatatgagaaacttagtactttgaagtcacattaagaaatttaaatttttataaatacacacaaaaccaatatatttgtatctatactgaataaataacccctgtccttacataatttatattaactttgggaagcaaaattaatgaacacaaaacaattagccaacagtgtaatccaatcacatttaaattatcgactcctatattcaaactggagatctgtctaagagggaaatgtggagaacagaagatagcttggcaaaggtagtgaaactgcagccagccctgaaacaatgcataggactgtttttggtttttgtttttctcctttgaaggtctagggtagggcattagaaatgggaaaatagcagtaagggaaaaaaaagaacaccgtgtgaatacaacagactcaggtcaacaggactgtgagtcaacaggccttggtgtggaggtaccctggagagcaatgggaatgacttggccctccagaagtacatttcagcctcctttgtactgaattctcacttctagctctggaatctacattgtgaaactatcaaagaaactaacaactactaaaacccccacctgtatctgaatgcagctgggtttacctcaagagccacacccttaacttaattaggggaataggaacctaaatgttttgaggactgttagtgaataagatatcaatattaaagaataaattagcaaagaataaaagaaccacccattagaccaagggaagggaaaaaaatgaagaaaggatgatggcagatagtttttaaaaattatataccaaatcactgaggttttctaaaatttaacatttaattggtgatgtgttattaacaaaaattccttaaaatatgcctgaaaggtgaatctgtgactatacttattggatatgcctaaatatgatttttagtgtaattataacttctgactctaaaacattgctaagttgtgccagacactacttgaaacttcacacttaacactcattctaaaagtaacaataatacctataggcactgattcccaaataaacattattatttctctacttagaaattcttatgattcaaatacaaatagtttaacagattgtattttatgtgtatgtgttttcatgacaaaagcaactacacttaaatgtgcaaaaactctactctgggtgatttgcattcttatatctcattatagagtttcctatttgaatttccatctggtccctaatatctttttgtgtttattgctttaatgagataatcttgttttacatacctagatttcattactatttggcaaaaacattctctaccctgattttactctcataaataccttagccttaaccttggggcttagtgcagtctggtatgagatacttctaaaatagtaaaatggaaagaaaaagcattcaaagtaaaatgtaagtaaaggttagtcctttatctcttaaaatcataacagatagactgtttccctttataagattaatctatatccacccatataatgcctcattgaagatttaccatgataaagtaatatattggtatatcttacattaaagcagaatttggaagaattaaacagattccatgaagattttccactgatggggactgacaaggcttaaagttgataattcagttcttatttaacagtcataaatgttatcttcaatctgtgctatcaactaaaattttcttcattcgaatgcattcatattcatgcagcttcctttgaaaagactgaaaaccattcctaaaactcagacaggaagagctcaatgaaaagaaattatgacctatatccactttaagatttattcaactgataagctcacttcactataggtttaggttgccaataaaattctctctaattctgaagccatcatctttcaagaataattcagagccttttctgatttctcagcatgacagagtaaattggcaaagcacagtaaatgataaggtatttacttatttgtttatattagtgaacacacagtgtttattgtatcccaggcattcttctaagtattttacacatgttaattcatttcattctagatatcatatagtccccttgggacttaatgggagaatatgtttcaaaaaagaagtgtaatgaagtgtctgtaaatacaagctctctatattttgctaagtgcatctttaataacactaacaataactgctacttattgaatgcctcctaagtggtaagctcaccctcacatcaaccctttaagataggtatcaataactccatttcatgaatgagtaacccctaagtctcataaatagtaattatcagaggcaaatgtcaaggattccaaacactttgactctaatactcattttttaaagtaccttataagacatttttctcttcttagttcctatattctacttttcttaatattactcagtcaaactccttcatataataaatacccttccaatctgtctccttctctccatccccgctattagcccactagctatgctctcatcatgcctcacttgtacttctgcaaaagattcttaactctccctctttcagtccactctccacacttccaatgaattgatctatagaaaacataaatctgattatattactacctgtttaaaatgcctcactgctttcaaaataaaatctgacgtcttaactatgtcatacaaagcctctaatgagatagagctcatggccagtgcagcttcatttctcccaacaataccccaggcctccctgtccccacctgcaacatacacacccccacccccactccacacacacctccctcaggcttcaactagataaactgttattttgcttcctctgtgcctctgcaaattatcatctctctaaggaaatgccctttatctccttcttttctaagcttctacatatccctcaatacttacctgtgatttcatctttggtaggaagctttcttagacatctctggcctaggtcagttgtctggcctgtgtttcaccgttagagcattcatcatacttttcccatgtctgtggccatcacttcagttcacgtttattttgtgactatactgagcaccatataagctagaacacacagtacaaattacatttactatcccagtcctcaatgagtttcttaggagcttagttgaaataggccctgaagatggcttgccatccggcagaatttatatgtgtttgtgccttagctaattcctcatttctcatcttcagctgctgtcctcagctatatctcttagtatcttctatgcttggctcctggcatttacacatgatcttttggtattgactttttgcctggtctatgtttgtaggatcacagattaaatactctgctccctcataacttcccagtatttaccctgtacagcatgtttctcttgtgtcaatcctacagccagccaggtcagcacagtcttttcatgactcttcttttagatcacaaacctagaagtcatcaaaccttcaaacagaactttctaagttactaacatatccaggagggtaaatgcagccctcaacagggaagggacctttcacgagagttgcctcatgttaaataagcattgctaacagaatggttatttctgttaataagtacatattaccacatactaagtacatattacattatttaatccttatagcagacaagattacacacattctactaaacaggaagctgaaattcagataagttagtacctagtccaaattcacacagctagataaccatcaaaatcaggactaatgctaattttaaatcctttgccagccctgcatgatcctgattgagtccaagtaccctggggattcccaggtcttagcataggtggtgcaaagaaccctatgtttggggagagggtgtaggtaatggataccaaatcactccatattaaccccatcaaagaatgtgactcttgacccattcttagagaagtgaactacaacataacaaggaggaagcaagcttaatctctgaatgaatctggagttttatctgtccatggcacgataataccaaacacattcctcagggggctattgcaagggtgggtacaatatcctattgatgaaccgtagtgatcaaaggaaggcatgagttgagagcttaacagagagaaatgctcataaagctcagtatattgctactgatggaatgattaaatgccgcttgacacaaaaacatatgcagttcttgaaagtcaaaagatacaaaaactctagagtcatatggtttgtcaatctacaggcaacccctctgtacctataatttcacagtttcatttatgctttgcaaaattgatgattattaccaaaggaatttgagtttaagcctggcaactaaatcaaaaagtaatgctcttaccatctagaaaatacttaaacaactttaaaatggagtcaatgaatgtttgactgtttgacaggtaagctctgagtatataattaatctggcaattgaaatcagctaagtctttataaattctctttgtagtctagtgcatgatgatcacaacatcacttgtaaggactttgcaatattcaaaggactgaggttcatactcacatttagtgatatgaagttcacaggatatatgtgtgttaaacttgcacatcattgaagtttacgtatataattaattagactcaacaaaggaaacattcattgtctatttgaggtctggactgtgctggcatcagcatgagccccctactaggtctcagactaaagaggtgtcaaagacaagcaaatagtttcagaagagtatatataatagtaataataaggtaacattagaaatatgagcaaggaatggaggttgcagagaggagggatgttattacctagaaagggtgatttcataacgcttatgtgtaaaatgggggcaggaataaaatgggtgaattagatcatctttatagtctgcttttgctctctaattttgtcctgtctatatacttgtcagattatttccattttgttcttttttccccttagagccatattttctgattatgaccattggaaatgttatgttcaaaaatttccatgatcaaggactgacgatggagtctttaggtccccagcttctcttcttacctccttcctaagagctttgtaggatactgttgctctggcatatcttctccagagactgagtagagaaaggaggtggaattacaatcagtcagcttcacttactgaagttcttgtgaaagtttgatagaagagagcgttgatgtttaagaaaatatttttcacagaataaggcagctcttaattacctgcagtaatggagagcagtggtgtgtataatccaaaatggtggataatccaaaaactatttctatttgactttgaaatgtatttttgaacttgcatttgaatagaaatatggcaccaacaacttaaagagtcctaagctttctatctttcttatacacattggtctttagaaattgcatgtttgagttttaagaccttcctccactggactgcaggtcaactctaggttaaaaggaacagtgctactggcaatgtcaacaaaaatagctaagcaagacatttctaaaaagaaattaaaataaaatgtatcttagatgatgtagagtttggctacatattgcttgattatatacactcgtctatgaaccaagttcctacttacagtaaatcatttaagctggatgtgatgcacatcatttcaagctgatggaaagatgactagataaagtttgttctgtctgactcccccactgaatgcctgcctggcactctgaggaagccacagcagggtgtcttcagaagctatttccaaacaaatttagacttgtcttatacatgatgagagctatttataaagattgtataacaaatagcttataaaagacacctctgtcaattgcatttataatgaaaaaatctaacacaagaaggcgttgattcccagtgcaagctaacgctgcagtatctttgcttttttatcagctaaactaaccggggaaagggagcatgacaaaactcactgcacttcattgaaacttgaattgagatcttaaaaagaagtagagtttcatcaaaatatacaaaagagtaaagggcagtaggtgcattttagttggtaaagtcagaatccagcaatcatatcgaatgacaagatctactctcagaaatgataggtaatgacattattatgtgaggatctttaataacttctactgttatctgtttaattgatgtacaaaaggcaaaaagatttaaagaattgagagaaaagcagaagaaaacatcaaaaatcgaagaatttaaatcttccatccccaagacaaatggaaagcaaaaatcaatacattacaaaaaaactaaataattttagtgtgaatgttttgaaactatcagccatctgtagtaattgtacaggcaaagattttagcatcgcaacaatctaagatgggaatttacatacgaaaatgaaaacattagacctttaatcagaagaattgaaatgaaaaccaaaattacttaatattttttccccaaaaaatatgcttttggaaatgtgagactatgtttgaaagcctgtgattttcttattttataaacgtgaaatgtgttcagtgatgactatgacatgacaatttggaaccttgaatttagtctcctattttactcctaatttgtaatgttaccttgtgcataatgtttattcctttggggtaaagtgctaattaaataattcattcattttaataagcatttcttgtgtacttatgtactaggccctatgcttggcataggagctataaaattgaataggccctggttatagttttggcatatttgataaagtcagtggggatgaaggcagaaagacaaacatgtggcgtaagatggcactttgactaaaactacatacaagtggagatggcactaacagaaagtgaccatttctacatgggatgagatatatcaaggaattcattgacagactcagtcttacagaatctctatacatcaaaggtatttgccaactatccctcttctgaaaggtcaagaagtcaaaatccccatgaaaccttgaatggcggtacattaaaaaacaagaaccttcaaaatatgtaatagctcttttcagagctgtcatacacaaataaatacaaaatctactcttacttgctttccttcaatagtatcacaaaaggaggtactatgttgattcagtatatagtttgtatactcacaatgcatggaaaaatgcatggagaaccatgcatacagaacgttttacctcacgtattctcaattgattttctaacttttgtttttagcaaccatccttcatcaaaaagatccaagtgttaaataaacaagtctagaattcacagtttgtactctccttgtgcttcctcgttttctgttatttcttttcggcttgggtaagcaaactctgttactgccacattcttttttttttccactgagaatagtttcccatgttttcaaaagagcacagttgtgtgatatgtgttgtggggggaagaggtgaaagaaagaggggggaagagaatatacttgtgtaaatatgaatagtgtacataaacatatatgaagacatggtcttctagacacagaagaaaaaagatacataaatgaacacaaagtgtggaaacacatgtgtagtcagatggatcagtgtccttagggggcaaggtttcaaagctcagtctacaaaaccattctaattaaaataacattttaatatccaattctgctttactttgtaagcattttctcccttctgtttgttttctttactaaagtcacagcaagggctgtgctgagcctccagttcatctaagctactcggtgcatgcccagacagcaagaaaatggtttctctggcaacaggaattatgtgaaatctctgtgtgttctcccccaccttccatctgattcctattcacttaagctcttcacatataggcaacaacgaggcattggaaatctaatgagcaattcaaatttattgagctagttcatggaggcgggtactgtgagcatcttcatttcctgtgtaccagggagcagagtgtgtttgttgtacgttatctgtattattcaagaaccatgcactgtcagcaaatagcccaaaccagataaaatcagatgaatatctaaaataagaagcatatgaggaatttacttccatcatggtaggagggaaatgcaaaggctttcaggtgccaaacacagctttgaattttccaaagatgctgagcgatggaagtcacaatgatttaaaacagcctcatattgtgtctgaaacccaagagggaatggcaagagctttgattaaattgctttgaatgtcagcttttttatttctaaggaatcatactgttcctccatgactaaagcgctagagttttcaatttaggccttataaacattccctaataatagttcatgatgagacctcttatatatgtttttctctgtagcctttgttaaggagagagtcctgtgtttagcattggcactaaggctgatatttactaagagagtttaatcaaatgggaattgatttgcttggaggaatcaggactaaggcaaattagctttattctttagagattgggagaatgtgggagggaaggatctatttttcttcggttccagtaaggatgaaataacagcaagaaatatactcagtaacataaagtagaaaatagagtgaattggaatggactcctgaaccggtttcagaatcattgtcctggaagtttaagaagaatatttgcttcttactgtctagaatattttagtaaactctacctgcaaggaggtatatttttaaagtttccttggttttatcattgtatatcttacctgttaaaaattaaggactttgtcaccaaaaagcaataggaaatgcctctttgcataaatctttaatctcaatctacatgatatagatttaagtaataactcaatgaaagcccaatttaaataaactttaacttccagtgaaagctgtaagaaagcaatgagcagaatgattagcctaatgacacaaatatagtaaatgattaactaaaaagcatagaagggtgaagataccaaagacagatgacagtaaaataatagtagcattataacaatgacttcattcatttcatggttaatctttagataataagaacatattgttttagataataagatagtttaaaaattctcaaataactggcatttttcctgggatataaaagtgccaataagtacagccaaaatttggaaaataaatacaaaatataagtcctacacagaagagacacctactgaagccataacactcggaattttcaatccagtcacagagcttttaggaaaagaacatcttggaatcataatttcattccagttagaaaatggagattcaacactcatacctaaaaccaaattgcccttcacgtggtaagtcagataagctgagactaggggctttgtgtatgtagctagtgcttgcttctgggaacagagaaattgttcctgtgtttctaaatgtggtaccccactgcaagtagtgtgtagtagaacgcataaagatttactgaagttttcaaggaatttctaagctctggtctgcagttcttttcccacagagccacctttcaattgtgacttttgctatgttttattttaattttatttaattttaccctttcttccaggaaaagttgagatggcttactattatagtgtatgcatgtatcaatccttgaaaacagtatttcttttaaagagaaaattgcctagaatcaggaaaatatcttgataaggcacttatggtagaaagcagaagatgagaacatgtgttagtaggagagaaagcaatgaaaaatagcaaaactgttcctaagttagaaattaatggcaattagtgggtggtggggaatacaaaaaagaagaaaggaaaggcagagtggcctttagagggaaaacattaaaaattttagacatctaatattcaattttatgttgttgctgtttttacaaaatctttctcataattcagaaaagtgtggtacattcacattgctgagcacgctgatttttatggaaatgtgtttatcatgtgtgcttaagaaagatcaatttccccatttggctatataccagagcagggacacagagtaaaaaacaaaaaagttgtagagaaaagtggttcaagacagaggtgtttatgaggatgtaagacccactggaagttcagagaaaactgaagaactatattgggcttttcatggggcacggaatccaatcttatttacagcttaaaaggtaagaggacctcaggtaactgttagcccaagccacagcattttgcagactcccaccttttataaactccggtcagagtggaaaattccaccagagactgaaccgtgaagaaacatcttgtgggacaggtcccaggcctaacccctaacccagtgaattccttccttatcagcagcccagcataccattcccaccccatttcacagcaacctcagacctctcccgcctggacctacaactgccccagcctgcaagcgggaaaggaggctcctgcgctcgctggtgctccccctccgcaggtctttgtccaataaacctgtgttaccgtcgagccgccctccttgtctttttttctccatcttaacagtaacatggaagttataccacacaacacagcacacacacacacacagagtgaaaaggtaaaacgttacaatttttaaaatcagaaacaggaaaggtatataattaagcaggatgcaacatctgggagaagaaaaatgccatatatcaatgaactgtgtacacttgggcaatgtaacattagtgggccagcttcaggaccttactatggtgaaaatctgctacaaatttccactctctttgaagtcacatggatgtgaatcgtgtgtgctttcaacgtactagctgtgaatgaacttaggctagagggtgaaaatatcggagccccaatattctcctttcctgtaaaatacagatagtagtatctactttaaacataaataataatggcaaatttttatttactgcaaactatatgtcaagctccaaacttacagctattatttatttagtttactccttgcaactattctttgaagtattattattttcattgtacaaatcaggaacctaagcctaatagaaattaaataactttcctaagcacagagcttgtaggtagtggagccattagagtggttcactagtactgacaatagcagtactagtataagtattagtactagcataagtactaatataagcaaatactgtgaaagtcagtttcaacttgaaattttcaattactgacttcgttttctacaatgggcaaacccaagataactctgtaatgatggatcctttgtaaactttacttcttgtcattctgcatttttttcactatttctttatttaacaagggtggaacgccttgctcatttatcatcatagctgaattcttattagagcaccagctaattcatgcttattaagtagaaaagcaatggcaactaggcttgatgcctaagtaggattcaagcctgtatctaaagtgacaaaaaacttataacgctgtttcagatcaactatagagtggcaggaataaataccattgtatatgctcactgtaaagctagattatgtttccagtgtagtcacaccaagtaggagcacataccgtccatctcagcactttgtcctctagaccaggggtcctcaacccctgggccatggactggtaccatcctattaagaactgggccacacggcagaggtgagtggcaggtgagtgagcaaagcgtcatctgtatttatagctactccccattccttggattaccgcctgaactctgcctgtcagatcagtggcagcattagactctcatagaagcaggaaccctatcttgaacagtgaatgtgaggggtgtaggttgtccgctccttatgagaatctaatgcctgatgatgtgtcactgtcccccatcacccccagatgggaccatctagttgcaggaaaacaagctcagggctccccttgattctatggtgcattgtgtaattatttcattatatattacagtgtaataataatagaaataaagtacccaataaatgtagtgtgcttgaatcatcccgaaactatccatccccgcacccccaacccctgtccgtggaaaaattgtcttccatgaaaccagtccctggtgcccaaaaggttagggaccactgctctagatgattcactggggacatacggttgccagtgacactgtagggtcttaccaggtctggtaaacccaacctttgttatgtcactgtgcttttatacttttcacttacatcaccatttggaaaagtgtagactaacaatacaatgagggtttgtgtgtatgtattgaataacagacttggcattagaaatgttgcatccttatgtctgtggggaaaataggatgaatatctagatttacctgaagaatttctctgcctccagctttccaacattctggagagccagtttccctataccttctatgtgaaccaattaataggatgttaaagaaaaaggtaagaatttgtttgaactcaaggatctgacacatgctgttccaatcaattttacattctaataaaataaacaattgaagtcttacaaatactgcatgtccaaataaaataatacccattttttgtataataaactaaagcttatcaaatagcttcccttaaggttgaaggaaaaaaaataaagaaaaaaaatccaactgtaagtgaccttcaaataacctaagcattgtgttggcaagtttagtaagactatgttctccaaaagtttacagaagtgacattgtcatcagtatgtctactgaaaaaggagtgagtgatagaaaccactacgtttaaaaaaatcatttagttagaattatgatcgtgtattggggtttatgcaggatcttgcacgaagaaaataagcaagttgcaaccctctttcttttactttcaacgacaaaggtcatgccaagggtttggaatcctattgctgctattaagagctctttctatgcattaaacttgtctcaccaaagcaggtgtttgacatatgaggggcctggctgcagtactatcaatagtttcattacaggggacttactctccaaacatacctttcctgtggacagaatttaatttgaaccatcttttctagagggtagttgtttgtgattattttcttgaaataagtaaaaagtttaaatagaggtgatatgcaactccagtttaatgtgtgcactaatctttcactttatataatttatcatctataattttagttattataaatatttagttaaatctactcggttatctttcattaactatgaactcataatctacaaaaatatatcaaatggctgcatttccacattttccagaatcatatatcatagtactgtggctagataagattacctaaaatgcagataaattcttttgtaaatatgtcaaaatatatctaattaactatatataaaattacaaataaatcctgccttcctaagagggataaatttagaagcaacatttggagaaacacagtactgacatctgataagtatgactttgtttttcccctaagctataaatagtaatagctaacactgaatgcttcctatgtgccagtcatacaacactgagtgtgtactaactcacttaatccttataatacacctatgagattcaaactattagggatctcatcttatggatgaagaaactgaggtacagaataattaacttgctcctagacacagctagtaagtgaagctgacatttaaatctggacagtatgggtctaaaatcagtcatcttaaccattagttgtataatttatttagatatataatttataatttataaaatattattcattacatgtcagaataatctcttacatttaataatgaagaccacgagaaatggtccatttgtggtacaggacaccaccatatacaaagcagcttactaatgtacagctgtcgtgggaaaagatgtttctaaatcatttgtaccctggggacactacatgccattttattcaaagtccatggagattaatttctcaaaggataagttgagaaaaaatcatcttttccttcatcagaaaaccaaataatcaacttttatttctcaaaggtaagaaagatcaaatagacaacccttggatctaacctgtggttccacaaaggatataaaaatagcaagtgtgatgaatggatcataaaattgttccttctggggaaattctgtgatttaatgccacacagtatgtaaggagaatcgcaacataattgattgaaatctgaaatggagatacagggggcctaatcatttttctagaagaactctgaagaaagagttggacctaacgtttaaaaagctaacatctaacattaactctagtaagcaattataccagtgcttaaaccaatattacataaccaagaaaaaaataggaaatctatgtattctgtttacatttttactcacccacactgtaccagttcttcctcatggctgggtcctctctaataaatggaatttttgtataacatcttttaggtcacctaagcagtgatgtataaaatcactgtatatgtatgtatatgcccagaatgtatatgcccagaaaaataatgaagtctctcagcatatagttagctatcacagagtgactaaggtagcataagaattaatctcaaataatcctactatttgtaggttcctttaaaaaaatcaatatgcctgtaccttcaagttaccaagggcatatgtatgacatatgtgggttacctgatactttagaaagcagagaatagatatccccttatcacagaggcaggtcccgggtagatgcagaattttgaaaggaacatattgaaatcttctaatttgtgcttatcttgaaattaaattcagtcttctagtcattccaattttttccaacctattaaattgtgagaaatctgcaaagaatttattgagaaggttctcaaagaactaagatggtagctttttactaagaaactgattatatcaaggctgaagggtaagatttgttcagacaagctttcctagctagcatccaatgagtattagaatttccaagtctaatttataaacccaaacataaacagataaaaataataatttttattttcttcaagagaagagaaaaatgtaaggtagagtgaagtaacatttagactcagaaaatttaaatcaaagaactgacataaacaactagcaaacttgattgtttagattttaataaaatgtattgtataatctattattacttttagtgagagcaaaatattatagaaaaacttttttatttgtaaaatatatcttgttccaaggaaataagtatacgtaattaactaacacccataaaaggtatgactctttaatgttgtcaatgaagatttaacataatattctataacaaatatagctcattctgctcttaaaacacataattcattacctcatttgaatgtattgtttaatctaggaaattgtataataaatagcagtaataatatgggaataagcaatgtagttttactttcaaaactaatatccaccagtaaaactaaaatttgaactgtgagaaggcgatatatctaatcatgacactctcaggaggaaatagcacaacaattttaacccattatttgtcatatttctgcatgggaacatgtttcaaaataggtttcataggcctaacacataacccaggaataatcgcacaagtaattttgagggtatattcatagtcacctttccatattcaaatgttacaaaatgaatttctaccaaagacactattttcattcttattagagttatttgctcaagactatagccaaagaaatatagatcttaaatctcatcatcaaaaaagcccagaactctggcttcattttcaggcacaataccacaatggcaaaacatcagtctcagtgtgatatatcagttaataacgtaagcagtaagacacgggctaaatttaacacatactcaaaacaacctctgttaaataatttaacatgaatgatattaaggacaattaaatacatttgtttcttagacagtttgtctaagagtcttgaactcttttgtgagaatccctgggggaacttaaatgtgggtacttatgttttataggattgaccaggaatagtctaaaatcagaagtcatagccctcctaaagccatatagcttaattatagaataatataatcatagaattatagttggcttatctagttgatgcgattcatattaaaggaaaaggaagatgtaagaatgtggaaattattgccaaagagcactcagtaaagttgctaagagaaaatggttagtaaatcccaggccaccttaagatattaagttgtctgttaagcattgcagtgatcaaggaagcatccatacttagaaacgcatgattaatcttttaaataatatcctaatattgtttaaatatactttgatttttcttcaaaacaaaagaaaaatgtaaactgttattttctttggtcaatatatatgtttataagatggccttataaattctattgctcattggatgctggctaataaaatacattcatccattttctttcaatcaaccatatttatttagcacttactaaattcaagaaggcctgggccctaacacatttgtaagtgtgggcagaggcctaggaatttgcatatttaataagaaccataagtgattctgaaacaagtaagcttctgaccaaatattgcaaaacattgataagggactgcttcaagggggagaggcaatgacaacatcatgaaggatgcagtatttgaggtatttctagaaaaataggtaaaattagggtatgtagagatagtatgaagggcaattaagaagaggaaagagactaagttaggcacaagagcaagagggtgtagagtgaggaaataaccagtggcctagattggctaacaataagaaaattagagagtaacagaagagatgactataggtcagagggaaattgatttggatcaggaatgtcaaaaccagggagtactgactctattaaatacatgacagggagtttctaaaatttcttgagcaggtaaaagcttaattcaaagtatagggagatagatgttgtgaaaggtagttgaagccatgggaggaggtaaggttgctggggaggcaaaacagaacatgacgaagccacactcgggaataacattgaggagtgtctacatttgattgcctggagaaagaggaaaaaagaaggaaaactgggtgataatgttaccaaaatagcaggggtgtggtctaggtcctgctgcttgctgcacagaaagtcaatcactgagacaatgagtactgccagggaagaaggctttaattgggtgctgtagctgaggagatgagagatcacaatgaaatgattaaaaggataactaaaggaaatgtatagaagaatgaaaaggttgagtcaggggcacagcatagtaacatgtaggaagagaggatatagacattacattgcctggggacatctctttccctctctaggccactagcataggttcaaaacagagactaaattgcaatgcttatattctgtgtagactaaagactgaaaaagtaatggagctttactaaaagatgggtttcaaatgagagagtcagatgaaagtgcaagggatttccagcacctatgatggtaccatagttgtagatggcaggaaagcaaggagcagaagctttcaagtcgagtgcacagtcattttaaaaatgagaaggtgcaggaaattgatgagggagtttacagaacccaactgtctcacaatttgcattaaagtatgggcgcccttatttagtttgtggagttctctattctggcccttagttctattgctcctgttgaggaggaaggagaagaaaggttgcctgctcctgtgtgcctctttgaggtgccaggagattactctgaaatgctttcctagcatgtagcatgtcttgtacagcaattccagcactgagacatgtaccctgagatatgccaacacacttccagctggtccaaggctagaccacctaacttttgagtttcaacttctaataacaatgcataacagcacttgccagttgcaccattttacttcagaaggatgtcacatgaatcattgaaggagtgactttagaagaccttgagccaattggagagaagcgctctaagtgcccaataatttctcatttttaatattcagtgaagatttttgaaatgttaaagaaaaaaatagaggaactaggaataacaaatggctagcaggacacatttactggaatgaaggaggattgcaaagctattttctcaattatattttttacattaaaacaacgttgcatttttaagccctgcagataaaatgtcttttatgaagaaaagctaattaagtttcctgaaaaataaggcagctggttaacaatttacgtcttttttgaagcgttaacgcttatggtttttagggcccaagttactaagttaatctataagtgaatccaaaggtgaactaatagatcgaaaaatggttcatgcttaggtgtggatttctgagcactaaaaaaatttaaaaaatgaccatagaactattttgatcttcacttttgaacaaatcaggtttatatgttgtttcctttctaaaccttccattgtactttttaaaaataaatccccatcacagcactgaaaacacgcactatgcaactgtttaccaagtattaactgtgggtcaggcactatgctgaatgacagaaatgaaaagttaaactaggccaggcacggtggctcacgcctataatcccaacactttgggaggcctaggcgggcagatcacaaggtcaggagatagagaccatcctggctaacacggtgaaaccctgtctctattaaaagatagaaaaaattagccgggcgtggtggcaggcgcctgtagtcccagctacttgggaggctgaggcaggagaacggcgggaacctgggaggtggagcttgcagtgagccgagattgcgccactgcgctccagcctgggcgtcagagggaaactcggtctcaatacaacaacaaccacaacaaacaaacaaacaaacaaagttaaactagacactccctagtcttggaagctcatgacccagctcttttattagttgtaaaatgtactggatagtcgttatactccaaaccccctttacctagtattttgtcattgtctttatatgtttatatcccaggcttttaatatagttgctcaaaaaaaatgttaaattgaatgtttaatatagctgctccaaaaatgttaaattgaagttaatattatattaaattataaagataatttggatagggacatacctttgtaagatgaaaaattaatgtattctcccttattgttcaaaaataattttaagtgggggttaatattatagttagaattcacaacctatgtaatctttcagagaaataacaaaaggaaccactgataatttacagtactatgttttctgttgccatttatttgtaacttaaatgtgtgtaaaacatttgtaaaactaaatgttatcaaaggtttggaatagcttcaagacttttgagtatttatcaagtcattatatctaaatgtgctaacttgaaatgtatctttgtctccaccttgtttgagctgaataaactggaagaggttaacttcataaatctttcctatagcatctatagctgaagtaataattcaaatgaaaataagaggtatggaaaaaaacatgagccaaattagtaaacaactctctatcagtttcctttaactgaagttagataaaagatagaagggcaaggtggggacaaaattactgttggcattatcatcgttgaagtcacatttttaaaggaataaatggtttcaacattaatataacagagaatacttctcccaagtaataatctagaatgcagtttttaaaattgatgtggtataatatgctagttcagcttaaatattaatttcaactaatttacagctgtataatattgctacaaattatgaaacaaatgaaaatttaaagatctatgtaatatgtagcaaaaatagttgataagaatcacatctttttaggcatccttttaaaatctggttttcattttctattttcttagatggttactaaattctcagatgcatgggttttttttttttgaagtatttatgttaactttaaaataactccattatcttaaataaatgtctttgagcacagtccttgagacacctgatcagtgcactttgtatcagcatttgctagtgtacctatgtatcagcagctttttcttgtcagactgacattgacttaccttggctcaaatcaattaatgttctgacatctggcagcaataacagtttgataagccagtagaaacagaggagaaaaagcaatggaagtagacacaaaaagatggaaggaatagcagagacattttagagtttatcgatatataagttgaccgatattttgtgtggtatggaagagagagagagagtcatgcgctattagctctgtgatggggctgaaactgtgtcttatgttgcagcaattacctggccatacattacttgattctcagaatatgcaaatgtatgatacttgatagcagactttactacactctaagtgcccatagaaatactacaaaatgtaatatgatcctattccttagagtttgctgtgactatcagaactttcaaggcaattgtgtagttctttattaatgaagaattttcatggatgcaaatgcacaagtcatcgtctgtaaaatacaacaacaaacaagtgaactacattcttattttaagatccaactgaagtatatacatcaaatatggaagtcacaacatgaaggatattgtgaggttttcattttgactttttaaatgtgaatggtaacacttggtcaaacgctatagacaagaaacttgacagctaatcacatcaggcttgctgtgaaactaatgctcagttggttagtcgctaataaagtctagacatctgttatctttgagtctgtttatttattttacacttacttatcaagaggcatatatggaccagtcattattttacgctctggggatacagctgagaacaaaaccaagtccctgcacacaaagagcatattgtctagtgactgagagtaaaaataaacacacaatataataccaggttgtgatgcacactaagaagaaatagagaacaggtatggagattgccagtaatggtgatggagggggcaatttttagatatgatagttagggaatgcctaagaaggtaaaattgagtgaagttataactagatactatcttatttggcccaatccactcaaacttttgtgtgtatgaatatagattatttgagaataatctgcattaaggatgttcattccctgcgaggttatggtaacagtgggtgatgataactgagatattaaatacaaagtaaatcgtagaaaaataagaaggatctttattttagattatagattattatataaacagcccaattttaagaatttgtcatcaggtattcaccctttcattaaaaagctttttaaaaaatgatctatcatatgctatacccgcatgaattagcagtaaacaaaatgcacattggttcttactctatggaactcaaattctagctgggaattctattcacatagatgagatagagccatcaaacactcttgacctagtaccatcaaagtttgaattaaagatttcaaaattggtatgtccatctttctctgatctttttttttttttttttttttttttttttttttttttttttttgagacggagtctcgctctgtcgcccaggctggagtgcagtggcgggatctcggctcagtgcaagctccgcctcccgggttcacaccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccatctttctctgatctttttatatctgaaaaaatgattcatcttactcttcctttctgtggcatagctcctaatattttctcacagggtacaactagttcttaggcttctgctcactgaaaaggggtaagaaatgagggcatactatagatgcagagttttgtaatcatgtggatatcagccacttgtaatggtattaggctatatctatgataatgatcatatgacttaagtctttacaatgtgttagatattttactcactcaagatcttgtgattaaaaataggaatgtctgaatttgaaggcacattggtttagtgccaatatccaaaccactgggatacaagttaagaacaagaaaaaaagtgaggattactcccagtcattttaaagttaagataaattacaaaactggcatataatatgatacaacacattaggggttcagcaaatttcttcaaagggttagactggttcttaggtgggatcaaagacaaacagaagacattcatctatctaatgaaactaaaagtcaatcaggatggagttggcatagtactgaaagaatagcaaaaagaattccagaagcacaccttggcaatgcccactcaaacactgttaagggagaaggcatcttggccaacagactcagagaattacagtctcattcatctattcaatattttttgaacacagtatgttctagctgtcagactaggtgctaaggatacagtggtgtacaagaaccacaatggccctcatccacatggagcttgtgtctagcaggggatttatatccagagagaattctagatagatgcttcatactgttttgtcagatgccagtaagtgtttgagccataggactccttttattctgaacatacattggtttggtagtctgactataattggctttctacgtagatcttttataggagaatataatgtttttgagagaccaagagttctgatctacctcacaattacttatcagggaaaataaacagtttgatttacatcaagaaatcagtctactatgagtaagctgacaaaaataaaatttagaacttctgagtttgaggagcagatttaggcccactaaagtaatgacaccttgtgaagcctcttgggggatgcacagccaggcaagcaccccaacctctcatttgagtattcctctgttatctttgaaataaaccaaatgcaactcaaattacaagataagcatagaagttcaaagctagaaatgtttattattccaaataattaaaaattatctgattagagacatttatattttcctattcataaagtagtctgtgcagtcaaaacaatttttaagatatataccttaaatttttatccccagagttactatcttgtgtaatataaaccatgataaatacatttctctctgttatgacttcttccaatgactcaaaacaagttaataatactttgctaaccatcaggaatgaattccacgaatataaaatgctcaatgggccctaagtacctttcttccaagccactaatactaagccaaaaaaaaaaaaaaaaagaggcataactggcatcaaaatcaatcagtaggctttatagaaggatatctttattgattattcattaatgatacatctgtgactgcttctatttttagtgctatgctattgaaaaaggtgacttttaatatgcagaactttagaagtcattgaaatagtaaagatgtacagcgcaaagacatgctaagttcaataataaatggtcacatgaatgaggccacatgtattccacggtagagttgacttttaaggcaatacattaaaacaaacataaagtagtaccatatatttattatatagtggtctccgctgggaaacacagacaaacattaagatatattatatacttaaatatgcagaaatgatcagctaaggacctgaagataatataacaagattttaagtttgccaactttctctttggctttctccctgggtagcagaaagatatattcactgaatcttctgaacagccaaaactttgaggttgaaaacaaccttaaaaatctctccttacactacagctccctcagaaaatagctttctgtttaatacaattttcctcaaattttcacaaggccaacttttcttgtgagaaacaaattctttcttaaaaaaaaaagctccttacaatgttctacaatccattttctctttaaacccaacctttcaatttataacaaattacttcctttgggtgaatcagaagtgccattgaagtcttttttaggtagcatatttctgagcacttacaaataagagtgtatttatagagaatgaataataagaggaagaattagttcaggtaaacatgacattagaaacagtaaaagaattagaactgtaaaaattgcttctgaaaaccactgctatatcctacacaccatctgtgtctactttattgatcatcaaaagctttatctctacttggtttctccactctggaatacagcctgagaataattttgaataggcaagaaagcagtgaaaacaaataaaaggttacattcattaccagacatttgaaggaagaaatgaaatatttgcacaaaattgacctgtggctgagcaacattataatccccaaatccctaatatatactagctggttgaaggagtaagagaatcccattgaaataatattttcaatgaaagtgcttcctattaaagtgacatttagcagaagctctggaagtcacacatttcctagctttcttactaaagaatgtacttcagaaataatgaaatacaaaaatcttccactcttcagtatccaatttttgctgctcatgaaatgagtgggggaccatgacatacctctctaagcactggttctattttctttgagcccctgtatatctatggatttaagtaagttgttctcccagttttgggggttggataccctttaggatctgacaaaagtcatacaccttcttctgcatacgtgtactcacacagttgaatgtaaaatttcaggagattcactctctttagaagctaatccacatactccaggccaacattccaggcttgaagtgaaaaggtgaaggaagaatagatattttgtattgctgaatttaaaaataaatttaaaagcaagcaataaaacaggcaaaagaaagaatgagagagagagaaaagaaaagaaaagaacaataaaatcttgaaggtattctgtgtctgaatctgttaggaagagcacctccatcatcatctccgtcctgctgtttatgttgtcaccaactaaaggtaggtgggtcaatgataaaagagtaccttctgtttatctcccaagaattcagcttgcctgagtgagaatggcctatatttcatcacctagtttttgaagactctgagccccagatatgtcctatgaggacagatttccaaactaaaaatcaggacatatagtctgacaccttaagtatatttatggaagcattggtactatctaggaaagcctatgatatcagatagattgtgtcccttttgtgatgggtctcctcatctcatctagaacttttaactaactcgtaactgctctgtaattacacatactaaatctgcaatttactttgaaatgcaccagaaataggatggattgaaagaagaatataggagtgatgtattttggatatgtgataaagcaaatatagtaaaatgtgagtggtagaatctgagtatacaaatgtttattgtaaaattcttccaaattttcaagatgtttaaaagggtttatgataaaaattttgggaaaagtacaatgaagaaatgaaaattttgcagaagaaatactccaagtagatggcaatgattatatagctgaggtagaatcataggtgatgtttttatttgtggattttttgtattttaaaattttctatggagttttttagggtgtaaagtaacaacacctttaataaaggatttagaaatcagaccaccataaactggactgctggagcagaggattgttgttggagactgataagggaagagctttgcaaagttgatgtgggactgtttattctaggaatcagactttctctttgaaggtaaccaggtagaggaggagtaagagccttaaggggctgtgcaaggaaatggcgcaacaggattagagctttaaaaacataataataaattctcaaaatagaagattaaattggggtgaaggaaaaggtacagagtacatgtgaggttcatgaggaaactcagcaatccacatagcaaaatctttagtaacacaagcagatttcttctcacaggcaattactataaaagcctttactagttcttactaacataaataactgcaaaatatcgtagaatatatcagggagtggggccttattctacttcactagccaaatgatttcccaatactgtcttgtcctactcctaggagagaagcaggagaggagaaaattttgggggcagtttgattttataatgcatgtgaacaagagatgtatgttgttaaaaatatttacaattgtgtggacacatacacacttagccataattgcttcacctgagcctcttaaatacatattaacagcaaaaatattgtaatagaatcattctagtaaaattctctttctgagttccatgttattttccggttaaataaattcagtgaaatcaataatttattttaagaaaaatgcagagaagtattaaaagtatcctaaaataatacatacagcatttacattctagtaagggttttgtccaaataatgttgtgttatacttgtctgtaggaaatcagacagcaaaatctttatattgtgttataatgtcaagccatcagtaagacattcatgcctttaaggaataaactcagtatttgtgactataagatcaatttcttaccactaatataagtgaagtgcaggtataaaggagcattcttaaaacaagaggaaataaaatatttgtatttaatacaatgccccaactgtaatggtcacatatctgaaaacggtaattgactgataagcaacaaaatagcaaagaacaatagtatttgtagtctaaattaatatactgtctcagtaaatgtaaaatgcataatcgtaaacataacaactatatggattgaacctattttcctcatatcatctaagaacgacaatagatgatatcatatgttgcttatgaatgagaatttggacaaagcaatcagatgcaataagacaaagacaacaaattatgtttgacagattatgatttttctctatttctctcaatacaggcatcaaatatagcagcatgtgatcactgcagctgcacagaggcaaatggaagttggtaccatcatctgaatctattttcctttatttttgtaataggtagaaactagaatataaatgcagccattcaataccactcaaaagcctctgaatggaccaaattagaaggaagcactaaaacctgcctaaggaaccactgagaaagcagttgcctaaagaggcttatgttcttgacctacctcagtgagccactatttataggacccaaggcaatacagtgtggaatattaattgcatttatggcctcaataattcaccccctctgtagtcattcctttgtcaagtgaattttgagtacttcctgtaagagcaaagtacatttgaccaccctatgtgacccgcttcagacaacaggacaaatcagaagtgacagcataacagtgacaaacatagacctcaagaggtcttgtatgtttccgctttccttcttgcacttttgccattgccatgagaagaacatgcccagactagactgttggtcccaggaaaaggatgaaaaacacgtgggggcagatctgtcaaagctaagggatgccaaccaagcccagcctagcacagagcctgtggtcatcctgaggtcagtgagtgatcccaggagagatcagcgaaaccactgaactaagcccagcctagttcagtgaaccctgcacacatatgagaaacaaatgttctttgttgtatgccactgagatttttgtgattgtctgttacagagcagcaaaatctaactgatacataacttttctgtgtcgagtttcgttacgtataagtaggtggtaaattttttaaattggctttttgtaaagactatctaaatctacaatacatgaaacatcttgcacttccactgcctattttgaaaattattgacaaattcttatctttccatgtgtgtacagattgcccagtagttctgccatttttttactgatatttttaatatggtagaaaaattacattataatgtatatcagaagaccttatatttctttgttttaccttgtaagagaaagacaagtcactgcattatttgatggcctcacatacagacaaccctgaaggactttcatagaaatgggtgtctacagatcttcccagaagttttatgtcctattccaggatacaacaacagtaacagctaactggactatgagataggaaaaaataaatttactaagttgtccttttcaaatatttcatgcaatactttcattaatatactttctaaaaaccattcaaccactgagcaacttattagaacattggcattggttttccttgttccatcttagaaataatgcttccaaattatccaacagagatgactacaattttggatgactcacactcttatagaacaaatctttgcaaaacatattgtcactgatgagtgcctttgtgtgttaggtgaacttttaataaatttaaataaacctaaatgagttctgatttattttcctttaaaatgtttaatctgattatctgaaatggaggagagcagcctcaagggtttataggtcccatacctaaaccatactataaatgcacatatgtgcaccaatctaatagatttacttttaaaacaccatttcacttagcttaatattagaaattttgtctttctagtgtatacaaccaacaatttgtacaagaaagtagaccgaatgtgtgtgaggtaatagggaggaaataggttccttataaacataacaatcattattgatcaagtactgtgtactaagtgatgttctgaaaacacatttttgagtcaagatgctcaagatctaataggaagaagacgtgaaatattatacgaattcatgaataagcacaaagagagataagatcacatattgataaaccatctcacataaccaatgaatatcaaatgtaccaatacctgaaaagaatcacatattcagttaaattggtactctaaatacacttcctgaaattcttccaaagtgagaaaatacaccaattagttttccagagagtatctaataacagtttttttctataaaagaaacttagagatatattttaacagattagattcatattctaaacgtaagaataactaacattactttagcgacgctctgcctgaagaaatactggctttgttcagaggttaatatttggaaaacaaggaacagaaacttacatttttaagaaccatacttccagacttaaatgtccaaacaatatgcaatgcatatatcattattcttattttcattagtgaggcaacaatcttaaagaggtcataaccctagaatagatgttcttaacatgtagtgtgtagacccctgagggtccctaagaacctgaagagggctcattaggtcaaaatcaatttcataatagtattaatactaatactttattgtcctcccttttctatgttgatatttgcatgctggtacagaagcagtggcaagtataactgctggtaccttatcacaaatcaaggcagtggcagcatcagctgtgctaacagtacactgccagaaaactgggggtggggggagtgtcagagtgtcgaagtcttttaagaatgtccctgaccaaacagtaaaaaaaatgttaaatcataattcttgattatatatctttttaatattccatgtgacaaaatgaaaaatgcaagtaacttacttcatacctaaatatgatgtttgtgaaagcacctgtgcaattgtttgagttgcaagctgaactagacactttgtgcatgaagtactgtttttacttgaatgaatgactgacagataaactatggctattcagacttgagtatttggcagacattttcttgaagataaagtaaacctgacatttcaaagaaaacaattgacagtgattgttaccaataaaatttgagctttagagctaaattataatttggggaaacttttatctgccactgcccatttgataagcttcccaatatataaaatcttctctgaggaaaagagtggcaaaattaaagaggtaactgttataaatgtgtcaacattagaaagattggcataattcagtgaaacaatgagcaatgcatgatgttacaaactcgtgcatgcaaaaaagattcattcaaaatgcaagatacaccattggaattaaatttaactgagtacaaaaaataaaggttcattgatatggttttcgattctacattgcaactaacctttaagaaactaccactaatcaaagttttggtgtagcattaaagaatattcacaattacttaaaaaggtattaaaatactccttccttttccaactgcatatctgtgtcaggcagattttcttcatatacttcaaccaatataacatattgcaacagactgaatgtagaaagagatatgagaatccagctgtcttctatgaagccagaaattaaataagtttgcaaaaaatataaaataatacattctttttactattttttgttttggaaaatatagttatgtctcataaaaattgtttttttatggcttgttattgtaaatgaataaatatttctaaagtagttgagttttaatttcaaacatagtaagtattaacagatatgacccacatttaaaaaaatatttttggggtcctcataatttttaatagtgcacctgaaaccaaaacatttgagaatggctatcacttagtggtaaggagaaaatattaaaaccctgcttactctgacccaaaggccatgcctttcccacttaactgcaatacatttcattacaaataaatttcagagattgaaatttccaaaaaatagaggaattattctctaacagaaaaaagctttggtaccataagtttattattattgtaaattaatttcagactttcataaactatataatatatgcatatctcatattaagatactttaagtcacatttatgactattatttaagtcacagagggctgaagcaatttcctccatgtacctgcaagttttcttgaaagactggggatgtagtattagaggaaaagtgattcatgctttaagaatctgttcaattaaattaagaattgtcatagcctgaaaatctgttcttttactttttgatgtaatattttaagacttttttttctggtaatacaggcacttaattttatttctacagatataattctaatttagggtaatttatgttatttcaggtaaaaacatttgacttcctaaacaagtcacattatggtattgatgccctttattttccattgtcaagatatctttctgcttagtttgctaacaaatcattagtctttcctgccacaataaaactgcaggctaatattatatttcaaagggtgcattttatgatattggtatgattaaggatggtgtaatgaatttattagcagttgctccagcttcatacccagtgaactctaaaggaggatgttcatgatgaaaaaaggatggctcaacttcaatattgagaataaaataaatgtgtgaaatgtgttgttgaagaatgtctcatatggcttacaaacgattgtcctttagatggaagatcatgtatttcttttgggggaagaataaaaagaaagggtgaagaaatctgtagcatggcagccaaagtgagtaaataagaaagaagaaactacataagaaaaagaaaaatatagatacataactcattaaaatacttactgcatgtgcttacagctcaaagcaagaataaatttaggtagcacaaacatagagaatctaggaaacagaaaactaatttggacaatgcatgaaaagagatactcagtttagctgatctcattttcagtgtctacacctcaaagggacttcagagagcattgattgttttcaagtattaattttttaaaggcaggtgaatgcttttttccccctcagtgaatttatatatggaattataatcaacaaaacagagaaaagtcgagctgctatgtttcagttgaggggagagctttcttttagccatttctacagccccaaatccatggcaaaaaacatctctggccaaaggtcgtcaaacaccgaacttgaatataggaatgcagagcagttggggttgcgggtaggtagctggcagcgtgatagaaacttagaaacaaagataaggcaagctggccaatgttttaagtgccattctgaaggcaatggtagaattgagaatgtggtgatagaacgaggtgccactactgaaatgagagatttttctggagttttggagaagattagcactgtgaaaccagatagatcaacagagaagtcataagttgcccatgtaggaaacacgagcacatgacagaaagcaaaatcactacctctaacaaaaatagtattaatttatctttaaaattctttagttgaaaaagcttctattggcttataattattacccagaatcattcctagggcttaaacggtgttttcttcttaaagcctcgtgaaagcaatttcttagttctctacgtaggcgcacacctcctcggcaaatggtttgtttttaataggcgccgcaaatcagtaaaactgacaatgaacttgaacgggtttccctcttcacgtcggtaagcagagtgaaatgtgcagcccactcttagtaagcgtgtatgataacctggccaggcgcggtggctcacgcctgtaatcccagcactttgggaggccgaggcgggcggatcacgacgtcaggagatcaagaccatcctggctaacacggtgaaaccccgtttctactaaaaagaatacaaaaaattagctgggcgtggtggcgggcgcctgtagtcccagctactcgggaggctgaggcaggagaatggcgtgaacccgggaggtggagcttgcagtgagccgagatcgcgccactgcactccagcctgggtgacagagccagactctgtctaaaaaaaaaaaaacaaaaaacaaatattgtatgataacctgacatctatctctattactggccttattctggggtctcttttattcccttatccttgttatcacctaacctcatctttgccatttggttaaaattgatgttttcttgttacagtacataccttgatatatttataaaattgttaaaatcttttttacagcaaagtaggttatcagtaaatggacaatagtttaatcttgtttgctaaatagtaacagaaatgggatgtgagtcaagttttgagttctaggactaacattcaaaatctttaatcgcagtattatcttccttcgtatacagaagcgatggtacttgtactgtctgattgtctcattaaataacagcacagttatgtcagatgactgtccagttttaggtgtgcaatctatagtcctagaaaaaagcacaagcagctagggaattatgctcagaaattcagttcagtttttagcatcactgatactagagaccagtcaattaagtaattcagaccagactctttttgctcaattgtgtaaacaaagtatacctaattatgttctttatctgacagaatgagcatcctagagtcattaaaatgtatactgaataaggatatgtgaaagcaaacaaagaaagcacccccatgctaatagcaacattttctcaaaagtttttagtcacataattattataatattattttaaacctgagaagaatattattctcaagaacaggccttggaaatagagaatgatgccgcccaattcagacagaaattggttacaaggaagttagactacttaatcaacatcgaaaaaagtgtagatttgtggcacactgtgccaggatttgaagatagaaaaaaagcaaagaatgcagccattttttttccatccgggagtttttaacttgattggggagattctatacacataaacagcaattataacattgacaaatttctcacaagtcatacaggaagtaagagctataggaattctcatgaaatatcttcttgttgggtaatctaagaagcttcatagaagagacagctttcaaacaggtttaaatactagaaagaacgtaatgagagtgaggtgacagtgtctggtagaagaaacagcatgagaactacccatttggctagaacaaaacagagaggcctgttttggaggaatagaagaaaaaagttgaaacacacacacacacacacacacacacacacacacacacacacacacacacacgggaggggggttagatcataaaaggccttgcataccagataaaggagcatctggcctatactttaatgacattgagggattctgatttataaattccagactgcagacttatttgaaaatacagtagaaacttagaaaggaagattgagtactcatttcactgttaataataaatagtacagtaccttgttcagcagtgaggctctagagttagtggaatttgattaaatcttagctttgcctctttactttggacaagttacttaacttctgtctgccttatttatatcaactgtgaaatagggatactaactatactagagttgtttaaaatcaaatcaaataatgcaagtaaagcaaaatatttggtaccacttaacctctctatatgacgacctatacatatagataccaatgcacttataaacacaaaactatcatccatagataatctgttacttgccttgtcagtcatgccaaaaaaatgccttaaattataagttatcacgaaggataattatcctaataatcctgattactgtcctttgattaataactagaaattaatcatctagttatctagttattatcaaaggacagtaatcaggatctggaaagcccttttggtaattgcattgggtagaaccgtacatgtagaaaattggaacttttttttatgaaacatagtgctcaaaataaagaatgaatgataaagaaataaatacataatataaaaacaagccttttaattgaccaaaagacctttccaaggttacccagacaatctctctataccttgtgaattcagaagaataggcctaaaaaggttaccaatctctctctttcctccagctgggactacactgacaacaagtgagattcacagaattcctctaccatcagtttttaacctccagagaaactgattcttctgtttcctgtggtaacctcttctaagggtcaatggctaagcatgtcagaaaatccttcctccttgccaaattaatttcttcttatctatcctatcgtgtttttatctgttttgttagaaagtggcaggtactgaaattttaaaactcagtttaaaaacaggtaaaatttagtaatttccctctggcttggataattttctgataagatcccatgccatctttgttaaaagaagaataatttatttactcaaagcttgaatgaagatgtaaagatgtattttccaaagatgcccacaagaaaatcccctatctcaaatgttcttctagaaccttgcctctcatccatcaagaagttaaatctagttcccttcctcttaaatttgtagcttgcttgtgaccaatagatagtgactcaactgatgcagtgtgacttccaaaataaggctagaaaaatcgattcagcttccaccttgctggtaagggaccctgacccaggatgcaagtagtctgattgggcttccccacagcatggtggcctctgaccaaactaacccatgtggtcagaccacatggagaagccctaacacaacatgcagacaaagagattctcagccagcccatgctgctccagccctctcttgtcctagctccagtcagtgggaccacaactgtgtgagtgatcatgagtctgaattatccagccaagtgcttctcaaaatcttgacccacagaaattatgagaaataatgaaatgattatcgctgttttaaatcattatgttttgaagtgatttgttatgcaggaatagtaactagaacatcccctcctctactagaaccctatagagatataggtctagtgcctataaagacaaaatcaataagctgcaatcaaaatgcctaaaaaggaactactgtttaataaaatgtactttatgtttaatgtgtctgaaggcactttgtaatctgtgaagcactacacaagtgctaaatggtttagctaatgagacaatgaatcgtacaataaaaatgcaaagcatttcaccaaaaaaagaaccttccttgttcaagacacaccttttaatatcttccctggtacagccagaaagggttaagtgttctttcttttgtgcctgcagtacattttgcacttctagtactccaattatgagatctaattctttatttttgcatgcccatttcttctactggactgtaacctccttgatgacaggtattatttttctttgtgtctttagactgtaatataatatctgtcacatactaagcataaatccatatttgttaaatgaaaaaatggagaggtgtctacaggcatggtcatgcaccaaaaggctttataagcataggtgaacaattctgtttttcaaagactcatcagcctctgaaagacaatgtgaaggaaatctgtttttccatttttaatctccatactgaacagttctctattccaatgaaccatttctgggaaggccttcttaccattccattttttttccttctgtctgaaaagtctaaccttctatctgaaactttgaagcccctaacttcctctttgatcacacattctttttaatctactttttgtgtatgagtatttatttttgtcaatctaaagagcatgagccttctttaacttgaaatgttagaaaattactttacataaagagaagaaatgctaaaatttaattttctttttgtcttttaaatcaccatacatttatgtatgtatttttttaacatgagtaggtaaaaacaataaagatatattttcaagaggtcaaaaaacccattgatatcctctttcgtcatagaatttctttatgaatgagtcaaattttttccacgctaattttataaagaaaaaatagtcaccattaaactttatcttatttgaatagcaatatcatccttgtttagtatcattagttttcatcccatttgaatttttttgtttatctcatttttaacttcttacctcactggctaatttctgtttttactggcattttccaggaattccacatttagtttcatttgcaaattttcttattaatctggttgattcatcttatggaatatgaatttaattgtttaaatattaaaacatagtattggtttcttcattccctgctagtcccactaacaaaaaaacgtatctcatttaatttggtaccttgtttctcgttgtggtttgtatgaagttgtgactgctgggaactttgcatgagtctaattctatgaagtgaaggaaaaaaaatctcttctacttatagatttgtgcttaataggtaaatttttattttaagtactgttttggattaatatcacagtatgcaaggaggacaatactcctgccttcacttttaaactttagcagtgatttggttttaaaacttacagacaatttagtcatataggctaaatagaaaaaatagacatgcaaaaatcaagaacatagtgcttccggataggaactaatagcagaaacaaaccacagtaatcacaacagcttccttttattgagaatttacaatatgttaagtattttcccaggtcctgtttgtaataatagttagagctgactatgtaccaggatggctctggtgcctaacaaacattaacacgattattcaacgctacagcacaggaccaagagaacttctgcattttacccaagaaaacaaaggcaccaagtcaaccaacttataaacatttgagccaagattacaacccagactatctgactccagaactttaatcctgtgcttttttcttctcatgcatacttcataacaatcctattggtttgttatttcagcctcattttacatataaaataagtctcaactggaatgaaaaatgtaccacaatgcccacagctgctaagcggtagagctcagatttgaacctctgcagtttgattgcaaggcctgtgcatttcccacagtaccagtgaaaagattcaatgagaggtgagagcagaggcccaactcctgctggtccttcaatatgaggcaagctttctgttcccaactctactatcctgatttgcatcatagctactccaaatctgtgtgttgttctctccacatgtcaaggtggtcaaggtgtgtgctttctaataattgaaatatagttgatcttgatttaaaaaaaaaaacaacaacaacgttatttccagaggatttggtaagttgtgtctcatgcaatattctgctcctaagtcctgtacactgaagaattaatgagtcaagtctcagaattggcagttaatcataatcagtcagaacagctgtaataagaacaagttgcccatttaattaaagatatcacttcttatcttattttattaatgaccacttactatttcccttatttcaagaagtgaatacaacattactgggatactcagaaaatcatttgcttggtattctaggcatcttttctttgagtattgtcttactctccctatcctgctttatgagttgatagtggtatcagttaatgtaatttttcaatggatctcttctgcagtcacctgttgaacagaaagaaaatactgtcttgtcaggagtaattccgtatagctcctaagttctcattcattatcttggcaatatttcctctatataccatctgagctcagctaggctgtagaaaccagccaccatccaaaacttgtcacataacaatcagatctgtcgaaacaattctgaagactatgagcttcactttgtcataattaaatgatcccttttacccattgctaaaaatattgcatgcctcctgactttgtttaattgttctcaaagagcaattttgtagactgtcatttcacttaaagtttttgaagagccagctctcaggcagaaactgaaatgatgaagctcaaaagattagcatacaaaccaaaagagcagtaatactaacgaagtcaaatacactgctcttggcttgatttccagctgtgagatttgaactctaagctccctctcaagctccaccctttctgagaatcttattccgggacagaacatcaacttcttagctgctcagttacaggagcttataggccctgaggttaatttctgcctggatcatgctctatggctttactcagtctaaaatctgatgccaaagaatgtttaatgagttccaaagaggcaatcaccagcacagaagtgaatttaaatttcatactaatgccagctagtgcttcatgggcagaactgcagccaaccaacctacatttcatagctgtctcctcatcatttgcatttggactttcttccatgccactagcacctcaatttgtttttaaagcacattgttccaaagtacaggttttaatgttttatacaggtatcaggttttgatttagtctgagagttttctagttttttttacaaagcatattaattatgtgcttcccacccccaattctctccactttcactaaggaaaaataagaacacttaaatgcataaactataatctggcatggaaatatctaatttttcctgattacaataaaagatgaaataactattattgtgttttattttgccactgttgatcactgtggtttaaagaccactaatcaatttctaagaccttcaaattgtcaaaaagggagtccaaatgatagatcagaggaaatataccaagtgcacatacgcatcacagccagccaggtcagcgccaggttgatgataatattcactatgcttaaattgggcagttttcctaattttcagaattctcgtggcttgtgcaattggcaaggtggtagcaatgcaaataagctatctttataatactgacctggtactattgatttctctcaaaagggattaaataatgcggttttatatagtgatcccataaggcatgagctgaacctaaaaatagtataattctactaccaaagatctttggtttttatctaaaccagtggaaagagtcatataagaaatgcattatttgaatcatttattcatgtttgttcatagacacaataaatatttattgaatgtcattgtgctccagacattttaggtatcagatgaggtgataaaacccttagaaacagaatccattaacaagaggttaccaattgcaagcatagtcgactaaaccagaaaaaaaaaatcaaataaaggaagttaagggatatctaattttgtgctggtaaaatatcctaatactgctcctcagtaagtttaagaatcaagggagagtagtccactctcctaggagctgctcaactaacgcagaatctctccctgtcataccagccctgatctcactagaaggtttggtctgttttactcaaagctgcatccgtggtgactgagtgaggttgggcacagaactgaagaaaacaagcatgaatatgtgtccctgggagttagcacagggcctgttttcctgccaaaggctttcatgggacaggtggaaagggagggggctcctggtgtgagccaagactgtaagtttctacgtgaagagtttggaaactacattttattacataccaccatatggctactccactgacataacttcagaattctgtggtactatatgcactcaatatcaatgattctctgagacacattcacttaacactttgagcataattctatcagagttataatttcttttaacatcagcttttaaccagcttcacaaaagagaccatactaattaccacttttccactgagtaagcccaggtttgattactttgaaaatacttttaccttgaggatttaaaaaaaaaaaaaactttcttaaaacaagtattcaaatcttccctcgttgaggacttagtgatgaatattgaactttggaattatgaaactttcatatagaacagagggagccatttttagtttggtaattggccatggatataaggaaaatgactgtaaaagaaacttttgaaatcaactataatccagtgatagaggttttttctggaattccataaaaaggaaagaaggataagatcctcatcaaattgctttcagtcttctgtcttatgagcgcagtcctattatcgctcccaattctgtttaatataaggtgattcattaatgccaagacatacactatgaaaaagtgtaaaacccaagtgacagcaaatctacatttactgcttgatataaatcctatgttatttgtgtctttaattatattttccttaattaaattacaaaccatttcgggtagctggacatgacattagtttgtgaataaacaatttgtatggcacaaatgctttgaaagaaggaaattactctgatgtaaaaaagatatcgataggacatagtctgggttctgaatataaaatgaaagatttcaaatacattttttttcttattggatattttcactccattaagtttaagacataattggattttccccgaaaataatcaagctcaaaaatcaaaataccttttcacatgggttttgcataattcaagaatcttgttcatatatttctttagaaagttctgtgtaagcatattcatgctgctattattcaacacatatttgtcaagcatttactacatacatggagtactaagtactactaaaattgtaaagatgagctagtggtgaaacctatttttaaggcatggttgtgggagagataagaaatgcacataaatagccaaatacaagcaagaaaacagtttttcaacaatataaaagcagtttctggttaaatgatgccaatgttcagagaagaagaaatgatcttcacccaagttcagaggagtgggggagtttttcagctgagatagcactgaagctaagccttggcaaacaggtaggatttacatacatggagttcagggaagggaaatctaagtagagggaaaaggtgtccaagctatagaggcaaggcactattctaaacagtggtgatattaaagagaccataacaggcacaaagtcgtgttttcatggagcttatgttttcgggaggaagcaagataaatgtaattagtaggtaaatcatatggtatattagaaggtaataagcacgtggagaaaaggaaatctaggaaagggagatggggaatgtggtttccattagaaataaggtaatcagcataggccacaaaacaaagacgacatttaaacatgtcaatgagaaagaaagcccaaagatcacactggaaagagctgaagcataaggggagcgttggttgatgaaattgttggcagaataaggatagattgcagagggcctcaaatgccaagctagggagtttggattttattttataggcactggggagatgttaaagatttttgaggaaagattaaaaaagacctggactgtgctttatatagatgatgctggcagatagtttaaagggaagagagagaggaaggaggcagggagaactcctgctacttcctccaaagaaaaatttgatttatataaacaatttttcttcattcatttaagaaatacatattgagaattttttttcatacttcaagttctgggatacatgtgcagaacacggaggcttgttatataggtatacacgtgccatggtggtttgctgcacccatcaacctgtcatctacattaggtatttctcctaatgctatccctcctctagcccccaaccccgacaggccctggtatgtgatgttcccctccccatctccatgtgttttcactgttcatctcccacttatgaatgagaatatgcagtgtttggttttctgttcttgtgttagtttgctgagaatgatggtttccagcttcatatatgtcctggcagaagatatgaactcacccttttttacggctggatagtattccatggtgtatatgtgccatattttctttaaccagtctatcattgatgggtatttgggttggttccaagtctttgctattgtgaacagtgctgcaataaacatatgtgtgtacgtgtgcatgtgtctttatggtagaatgatttatactcctttgggtatatacccagtaatgggattgctgggtcaaatggtatttctggttctagatccttgaggaatcaccacactgtcttccacaatggttgaactaacgaattgacagcaatttttatatgccaagactgctcctgtcttacaagataacttctggaaacaaaacaggcacttctctttccagatcctgcattctagtagggggagtcagacaatacacataacaaaaaacacaagcaaatacattaggaagataaactgtggagggcagcagtgtttcctctggagaacagatatggtgggctagagaaatcataggaatgttgggagaattgtgaggctggagggcaggtttagtattaaattttcgctcttgcaaagcaatattcacacttctaaagaagtgttataaaggtttctataatatgctgatatacgacagatataatgaaaaacaagaaagcacttaaattttacatcaatataatccaatggctaaagaaacacaaaagtatttccaaatctcacatcttgtctatatgaataatgatgtatgttactcataagttagagagaaatcctaagagtaaataatgttaaagatttgtctctctagacagaacacagacaaatctaacccatgggagaaatacactggactttaaatgatagagaaaaagaatatgcttctagaggtcttgattcccataagaaatgagataaccacttgttccctgatatataatggctaagtacaaaactttgtaaaaagtttcagaaaattaatgattacgtcaactttaatttcaaggcatcattgttgttctaatgacaaagtatttccccaaaagcactggttagaaatttttcaatattttccagcaaaataattacaggccagatcaatacacatattgtaatgattttcatccatgaaactttcacattattcctaaaattagacttggaaatggacaaacacgttcttgtaattgtattgtttagagaagtcttttgactcacgctcagcaaaaggacgacagaagtccagcaaacctcacacgaatgacctaattggccctctcaagcttccaaatttagattactttattcatttagcaattacaatttaatgcttccctactgcaatgaaatatgatggctactactcaattgtggtatcacagaaagattgcccaccttaggaacagactgcatgataccaagtaatatattttaacagcaacaaagggaatttctgcttttgataatggtgaagtaattcacaacagaacaatttcctggagataacaactatcaactcaggacaaactataatatatgattatctggaagcactgggaaacaaccaaaagtacacagaaactagaaaaaaggtaatggcaccaggtaagtatcccagtgttctaattttttgccacagggcagacacacgtgtggcaccatgcagaatggcttgaagttgcatagaagttctattgttttatggcttgaacaatgagagatcagacttatagtctactacagacagtagaaagtagaggaggaaatcctgtgtcataacccttcaatcaaagatcaccagaaaacaaggaagaacatataccacagggaaacaaggtgagtctgatatatgctagaatttgggcttgtgttatgttcttttggggactcttcaaggaagcagtgttttgctctgaattcaatggtaagaagtggaagtaattctgtggttgggtatcttactatttcttatctaaagactgctaaagaagtagcagttgcttatatcagcagcagaggggaagtttagtcattcttgtggattggataatgttcttgattttgtctgtttttgaacatgatgatagaatgatctttttgtcttgattcatcatggtcacagaggctgggcttggtggctcatgcctgtaatcccagcactttgggaggccgaggtaggtggatcacctgaggtcaggagttcgagaccaccctgaccaacaaggtgaaaccccgtcactactaaatatacaaaaatcagctgggcatggtggtgtgcacctgtaatcccagctacttgggaggctgaggcaggagaactgcttgaacccgggaggcagaggttgcagtgagccaaggtggcactgctgcactccagcctgggcaacagagcaggactccatctcaaaaaaataaaatctcatcatagtcacagaaagaccctgtctaacaaatgtattctgataatttttttagtgtgtaatggaataccacagcctattgtgactgcctggctaacttctaacaacatcaaggcccacctgttaatgccaggctagctcccagctgccaaggtctccttttctctttcttgtctggaaaggaaagagccacagagggcagcctcaaattctgcatttaaattctgtccaaatatctggctaagtcctgaactacctctgtctatgcagagtccaggcagcctggttaaagttaaaaaggctcaaatattttagctgctgcctactatagataagacagaatttagacatgcctgcttttaaacatgtcactcatttagaaatttcagggattaaccacctgctaaaacaaaaaataaacatttttcagaagacacaacagaaagcaaaataatatccaggacagaatgagacatatgaagaaacaagaaaatatcactcatactcaagaataaaagaaatcaatgagaatgaccacaagatgaccagtatgatggaattagttaacagttattttaaggcagctattataattatgatcaaggacataaaggaaaatagtaatcaataaacagacaggaaatctctgaagaaaaatacaaatgaaaatataatagaaattctaagagtaaaaaatttagtatctgaaaaaaaaatttgctagctgggctttgtagcagataatagaccagataatcagtaaattcgaaataagattaataaaaaccatccaactttaagtcttaaaaaaatcaaagaaataaacagcacctctgtgacctgtgagacaatattaaagatatgacatatggatcactggattcataagaggggaagagagaaagaatgtggcagaaaaaatatttaaatacataatagccaaaaatttcctgaatttgttaagagacatacatttacaggttccagtatctcaggaaactgcaggaagagtttctaaaaattcaaatcaaactaactgattacaactagttacggatttctttgttctttcttcactcccactgcttcacttaactagcaaaaaaaaaaaaaatcaaatcataaccaattcaatctcaactttttgaaaacgataaataagagaaaacttcaacacagagaaaaagacatattatacagagggaagtatggtacaaatgatggctaaattctcctcagagacaatggaggccagaaaagtcgggtgatagaaaaaactctatactgagaattttatacctagtaaaagtatccttcaagactgaaggtgaaataaagactaagtaaaaatcatcacttgtggtatacagacccacactttaaaatatggtaaaggaatttcttcagccagagaaaactgatatctgatggaaacttgcatatttaggaagaaatgagcacaagaaatggtacatatatatataaatattaaaactggcctgtaatcccagcactttgggaggctgaggcaggtggatcgcttgagcccaggagttcgggaccagcctgggcaacatagcaaaaccctgctatctacaaaaaaattagctgggcatggtggttcatgcctgtggtcccagctactagggaggctgaggtgggaggatcacttgcacccaggagattgaggctgcagtgagccatgatcgtaccactgcactccagcctgggcagcagagccagaccctgtctcaaataaataaataaataaataaataaataaataaataaatgctgaaagttagtaacaaaacagttattaataagcccaagtaaaacaaattacgctttaaatgtccattatgataaacatggactcactgacatttccacattaagttaaaatgattttgcagagtatagcctgtacacatcaaaattcttagaggctctaaaactgtatcaagttgagcagcaagtattagctttaaggacattgcttgttagcatcagccaattagatattctggacacaaatagggaacacacttgggcaatcaatataaaaagcatctcttttgtgaaattaattggaaaattagattttgtgcctaagtataaattctaaacgattcactaaaatggatcaaaacagctttcaaactaaccacttctgttgactaagtcagcttccttcaccacttgcatcttaattttaaaacaaattaaaagacaccagagaatgaaggcaaatatcctgatatttcaggtctgcttcctgaggaagtccttttatattttagttaccaagttatctgctttaatgtccctcattgctttagcatgccttttttcaccttgacggatggtctctattatgaaaaatgtattataaagctcggaatttgctttcatatgcactgaaattcaacctttgcaggccaaagtaatatcatttacactatgttccacatattattacttaagttagcagagcgtttgaagatgggaagtttaaaaatatgcttttctgaaagggtaagaatttatcagaacgggagagacactaaatgatcctgagctcaagaataactttttgtaagtatgtacggtggaaaaaaacactagacagaaattaggagtcttggattctagtttggcctcagtggtaactatggcagcttaggaaaatcatttggtttcatttgtttttggaaacatacgtactcgagtattttgaatattcattcatataacgcagtggtttaatgtatatttgcaatgggaaagctgaattctatgaaaatttttttgatttcacttttaagcatgtttcaaagagtctatgggcttaaatacgtgtttcatttaatgtaataaaagcacccagaatatgtgaaaacaaaaatcatgattttggggccaggtgtgtcttcaaggaaaaaggcttgtgtatctacacagcagacaaatacctctgaaagtctgatccacaaacagcatgaagaaattcaactggtgatttgacaaaataatttcaggcaccagttgatggtatggttggtggaacttgtaactcctgattctgccaaaaatgtaagttcatatgccaaaggcatatagtttgatgtaaaatttggaagtatagctgcttttgtttgatcacccaaataagtatgttcccctatagaacaccccagctcaataaacaaatttgccattagcaaaaattcaagcactgtcaaaattgtgttgcttcctcctattgccaaagcttttgcactgtgggtgcaagagggttgtagctttttattttattaaataaatatttcctttttatttattaccccaaacaccattattagtctgcatcataattttaagagtgtcagaaacaaccagaatccatgtgagaattctccgggatactataggaagaatgtaacttcgaggtcacttacactcagtgtcaggcacaattcacatttctcaaacaagatatatatcaggtggtgcttgccagataatggaggatgtgagaagcagagctcaactacccctgaaggagagcactggcatgagtcaggcaggagatcagagctctagccagccaagtggggatccaagtctgggatccattcatgtaagcataaattattccccactgtaattactgcaaagactgaagtggttctatcattgcaaaagtaaactcaagcatcagtctggtaatattaatgatgtggattaataacaacacactgtaaataactgtttattctgtcatttattaatataatatatttagttatttttttttctctctggaggcaattgggactataggagcagctgcaacagcagcatttgccattttgccagttgttcagagaatgaaccgattagtgggaatgggcagcaatacacgcatttggcagctatgtttgcacaaaatgagggtactttttaaaataagacactttgatgcgacatcatggtacctaagagtattgtggaagaatctgacatcaaatactttctaacagacaaccatgggattcctgtcctctacaatcccaactcagcccttcaatcctgctgagatcttcaatatgctgatctctcatcacactcttgtcacctcatttcttacccacccagcttgaattctcccatttatcagtgcagtcactttaacgtattcacctttatttttttgctcctcttgcttcatcattcacacaaccttgattaaatccagctctgtcgtcttatcttaccaacattgctcaaagtggctagagaaaaatgaccactgatttcaagtgagcccttaaagctacctgccaattattctgtagaccactccctttcccactttcctagacttgagaacttcccatttctccttaaagtctctaatacatctcccaccataatcttgcttccttcttcacagagaaattgctgcaatcagaagagaacttttagaagttcccaccaccaaatctctccacctaactccttgtttgcccataagtgcaaccttgttcctgttaatatgaatgaatagaccacattcctggaagaggacagcctctctgtttgtgctctgcatcttatgctctaagacctacttaaagacattgaaatctcccctcctccctccctccctccttctccctccttctctctctctctctctctctccataatcatcaatttcctcttctctcttaaatcattctctttaacacacaagcatgctaaaatttttcatttagcttaaaaaaattccacctcttggccctctttcctctctggctcctgccttatttctcaaatatttcttctttttatggtaaaaaacaaaaaaataaagcaaaataaaacttaaaagaattatctgaattctctatctccatttccgttttattatcttgaactctcaatgtcactaaagccaatggacattagtgagtcctcatcttatatgacttaacagctgcacctgatacagttgatcattctctctttgaagcacttcttcattggctttgaggacaccactctctctcttcttcctcctctcattctggtgtgacttcttggtctcttttgcatattccttcttatctcctcaactattaaatacaccctggagtttagtacagaaagtgttcttttctctccacactcagtccttagatgatgccattcatctcagggctttaaacactataataagcagttgactcccaaacgtgcattttaccatagagtttgctcctgaattccagaacgatacacccagctgcctacttgaccagtactcttggatgacaaataagcatggcaaacagagcatattctatcaaaggtttctgtacctttccaccccacagatagctctctcacttctcttaacacttgacttagtcatcttagtattgcctgctctggcctcccttctaaaaatctctttcccccttcctctgatttgggacatttaacggtcctttttcctacttattttattttcctcttagtagtgatcaccacctaacattataaatattacataaatatgtatatatttttactgagttatcttgtatcctattggtctccctcatacaagacagggtttttttttctgttttattatatatcccaagcacctggaacagtgcctaaactatagcaggcattcaatacgtacttgtagtacgaatgaagtatgctagaaatagaatgcatggtttccatttaaaaatcaaacaaacttcaaagcctcaaattcacagaattgagtgcacttatgattattctgatttccatttttcaggacttctctttgattagtctccacacttcaatgtgtttgcatgtgtttagatgtacttcagaaaaatgatatatgtatcaaagttctttccatattgtgaactaggtacatatcacatgcacatctgtgtgagaagaaacaaacagcttcatgaccacagagcttgccacatgaagcctctccatcacaaaagggtctcattctttttgctctacacattgcctcatatctgtgttgactaggccaccatttttttgggcaaacaatgctccttatgcatctcagacaatacaaattcttctccttgaagtatcctattctcttctacaattgaaagagtaatattcattcttcaaaatcttatgtaggttcctccacaccttaagttacacccaggtagagtgatttattctttcccatatattcgcattactctggtagttaatctgtcacattcaaataatttgtttacacgtctatctcccacactaaattatgagcttcttatgggcctaaatatatctttatcttcagcatcgaaccaaaatctggcacatagtagatattgaatctttgcttaaggcactcatccacaaagtgatgacttcgtggaatgcaaatacaactctacctatataaacatatttttgggaaaatcactgtcagaaatacatttttaaagcgattaatgtcaataaaataacaaaatagtctccatattaagtaatcaagtctaccagagtcagaaataataaaaaaaaactataattattttaatattacactagaacttcaaatttgaacatctggcctacctaaaattatttgtatagaaatataaatgaattgctttatttttaaattataaatttgtttctagattaagacacatggcactaagatgcttacataatcctcatttaaacccaagaaaacagctaaaagtaatgaaatcacaaataattttttttcacagcatggttgggatatgccttgtattaaatctttaaaatttgtgtaaccaaaaggagaatttttaaaagttaattagaatctcttattttctctagatgtgaatgttaaaatggcaaatttaatgtgacaatgttcatttcaatgtaagaatttgaatgtcatgttgttaaaaccattagttgtattaaagaatgatgctaatataaagttgtgagcaaaaattgttaattagaaaaaaatacctattattttatttcatattgctataatgaaataacatgcagattaatagttgagtatcttaatgtgtaagttttatgtgattcttttatcacacattttccctattttctaaggcaggtttctcaattttattttcaagttagttctttaagaaaataaaggaggctggggatggtggctcacacctgtaatcccagcactttgggaggccaagtgggcggatcatgaggtcagcacttcgagaccagcccggccaatatgtctctactaaaaatacaaaaattagccgagcgtggtggcatgtgcctgtaatcccagctactcaggaggctgaggcagaagaattgcttgaaccctgaaaggtggaggttgcagcgagccaagatcatgccactgcactccagcctgggcaacagagcgagactccgtctcaaaaaaaaaataaaataaacaaataaggaaagaaaataaaggagattgctttcaacagtttctctgagagcacctgccttttataacctgtatttttttcattatataatatttttaaggctacattgtcagctggagtgtaacaatggtgtaacagttcctgtattaaaatttccaccctgataaaacaaaaaccaccaggtaatgacagttcttagagtcctacaactggactttaattctctcttttttttttttttttttgagatgaagttttgctcttgttgcccaggctggagtgcaatggtgtgatcccagctcacttgaacctccacctcctgggttcgagcgattctcctgcctcagcctcccgagtagctggggttacagatatgcaccaccgtacctggctaatttttgtatttttagtagagatggggttccttctctatcttagctaacgaagtaaccccctttcctagcaaattctgacattaaccttccttgacaatcttatggagaagtggcctaaatttgttttattagaagaagaaagagattatgtgggacacaagtttcctcttttgctttgtatgtccccaggaatattttatcccgatatgtaagtgtgtgtgcaagaaacataaggtattcattagcttgtcctcttgaactcagctggcaggaagtcaaacaaactgaaatcctcagtgtctacttccaagaggtacctgaggcaaacacctaaaagattatattggaaaaacgagattacctctctactctcaccaaggagccaggaggaactccagtagccacagcgtctgtttatttgttgaatgcctacaatgtgccaagctataggagataatttctcatccccacctctaatgtcaaaacattcttaccaagaattattataattttcatcttacagaagaggaaaatgagatggaaaaacctaaggaagctgtccaacttttatatggttaatgtgggccagaggccagactcaattctggtctatcctgttacacctcattagcagtcagtgtatataatagaagttggtctgggaagaggtaagatattaacttgtagtaagcgtcatttccctctctttcccaggacatgcaaggcatgggtgacttgaagagagaaatgattccattccatagcttgacaaaagaaataaccttccatagtcataatttgtctctgagttattagccaggctgaagtctacaaaattgaccataacttcataaaaaggttctctgtaatagtgtttcccaaacatcaatgaagaattgaaccatctgggggtcttgttaaaatatgtagattctgatttttttttttttttttgagacagagtcttgctctgtcccccaggctggagtgttgtggtgtgatttcagctcactgcaacctctgcctcctgtgttcaaacaattctcctgcctcagcctcctgagtagctgagattacaggagcccatcatcatacctggctaatttttagtaaagatggggtttcaccatgttagccatgctggtctcgaactcctgaccttagatgatccacttaccttggcctcccaaagagctgggattacaggtgtgagccatcatgcctcacctagattcagattctgtaaggtaggttgaggcccgaaattctgcttgtaacaacctcttaggcaatgctgatgctggtctataggccacatgcacagaacagtgaagctccaggcaaagataagacatctctcctcacctcctcattgcaatagtggctggagtgtgaaggggcaccaatgaggagctctccacatgaatttgggcaaaaaatactgacatgaggcatggactctatccggaattaatttttcctgtatcaaattatttagcccaattttctttcattgctcacatttgatacttcatagtctcttagagaaaaatatttctgatttctagtaaaattaacttttgttttcagcttcagtaaaatggagactgccaagaacaagtagagatttttggccgggcatggtggctggcacctgtaatcccagcactttgggaggatgaggcaggcagatcacctggggtcaggagttcaagaccatcctggctaacatggtaaaaccccatccctactaaaaatacaaaattagccgggcgtggtggtgcacacctgtaatcccagttactcaggaggctgaggcaagagaattgctttaacctgggaggcggaggttgcagtgagctgacattgcaccactgcactccagcctgggcaacagagtgagactccaccaaaacaaaacaaaccaaacaaacaaaaaacaaagaaaagaaaaaaaaacaaaaaacaactaaatagaaattttgaatcatttaatttcaaaaactcacattacattcttcctttcgctatgtgaacaagaagaggatcatctcaaatcataactaaaatatacaggaactatgtcctacaacctctattaggtaatggacataggaagatagtcaagaaaatgactccgttttgggaaagtatagctagtgagagaaacagaattgtaactagaaaagcataataaattatgtggtatgaatatgtgtgaacagttttggggaaccacctatttttcctaggattactatccaggcagtgaccttcaaagatacagaacacctgtgtctataactagcattctcttagaagaaaacattccagacagtgaaaaaaatgggtaaatacccatgggcataaaagaacacagtttagtttggtacactggctagaatggttgttgagacaagtatgaaaaaacttctagccttcttcaatagaacttaattcaggcaatctcagacatagagcattctatagcttggggagagagaaacacgagaaatgaacaactgataactttatcaaaggcctgccagtcactggtcatggttaaatgtgttctttcaggttcaggggatatgtactactaatagatatagtaatagtttaataccaatttctttgctcctgacttagataaatggaattagcaaatacttttcctaaactctaatgaatcaatcataaaagaaagacttatgattcccagagtagcaactatatattaggaaataaaagttaccatctgcagcaccatacaaaggcttgcatgcacaatgagactgagttattgtaacctggggatccgcacagaacagattttcatatactactagccaatcccagcttcttttcacgttttcacttttgaaataaaataggggtagaaatattttattttctgaagcgtttctttaccttagcacacactgagagagtaattcacacaggtgtgtggaaggggttgtctatgatatttcgaagggatgacttatatactctggcttttcttttacaacagtgagaacacctaaaggactgtgtgtgcaaaatcttcctcccaaagcatgattatagtaacatagctggcaagaaggcctaagcgaaaccccgctctttagacagacatatgctgaattaccctaaagagtccaattatctccacctaaacaaggaaagtacaaaaaaataagacatataacttttcataggctttaacaattcttgcacctaacctaaaacccaaccacttaaatggaaactgtatcaataatttatctagaaacctagttataggttacctgccctacttacaaaatcaattaatttcaattctctcattgcttccttacatgtatgcagcttgatattttccagcttctgagttttgtttattcttttcagggttctcaacagagaaccttcaagccagacacagggctgaaacaggaggtttagtactactaaggacatactttaaaatgattcttacatagtgctgtggtttaaggacaactggaagaccagaggaaaagaatgtttcttcctcctcatgctctggtgtgaacttaaggtttctaaaaagtgttaggctgactgtaatgaaatggaaattctactatctatcaataagatgatgctatatttatagaacatgagccacaagagagctatactgggcactttcaataaacctcaattaaagtgatcaatattgctaaaacaatctttaaaagcacctctgacagaaaacttctttgagattacttttaaatgctgagatagactaagtacttcaagatataatgggaagtgaattccagtgtccaggaatatgattgctaactgtcctaacttctagggtctcaaggttatgatttaaatgaataaaatctcgatgaatttgtgaataaaaggtatttttgccttttatacttaggaaaggaaatgtgagtagtatcttaacacagcttgtgctaagtcccattgaccatttaatgattttttccccccatcccaaatgttaaacagttcttcttcctctctgacaattcagatgccacttattggtcatagtttgcttgagatcccacctctttacaaatcctttcctttgtgctctagttttattaaaatctgtacagccaaatacagttcttgatcataggctcttagagtagttgccaattgttttttataagtcttagctccacaaccgaaaatagcttcctacaggcaagcttcgtgctatgttatgcctcacagcctccatattaataagcagagtgctaaccactacatgataattttgctcaaaatgcaaataaagctcacaccttagatgggttttcaggcctcacaacttattaccagcttagttagcaaagcatagccatcttcggatgagacctagaagggcctggatgcaaagaactaaaggatgatcagagtgggagattcaggaaaagaggtaccttaggaggaacggagagggaaagacagactatgattttgccagactgattctaaatacttgttgatatgggtagtaaatttcttttttgaaatattgtaatagcaagcactcaagtgtgatttcttacatggaaaatcctgacagaagggagatcctgggactgtcctagtgtatccacctattaggtttccaaactagccaacccagtgaagagaattgctctttgttgagccaggctagttacactatcttttcccactatattgctgccttagtattcatttattcattcagtcagtcatttaacaaatgtttagtgcacatcttttttttttttttttttttttgagacagagtctcgctcttgtcaacaaggctggagtacagtggtgcaatcttggctcactgcaacctctgcctcccgggttcaagcaattctgctgcctcagcctcctgagtagctggagttacaggtgtccactaccacacccggctaatttttgtacttttagtagaaacggggtttctctatgttggccaggctggtctcgaactcctgaccttgtgatctgcccacctcggcctctcaaagtgctgagattacgggtgtgagccataacgcccggccctagtgcatatcttatatctgagttgacatgatttgaagtcctacagatagatacggttgtgagcaaaatgaatttggaccctcactttagaaggtcctgcctcctggcagagaaagacattaatcaagtaataacactaacataaaactaaatattgaaaaaaacccaaaacacccgagaagtgtaatgaagaaaaagcatgagaagcctggagcacattttatagagagagccaattaaatggctgagcaagcaaagtgggtagaaatgtgttccagcagaggcaccagcatgtgctaaggtcctgagagggaaggaaatatgatgctttctaagatctgaaagaaaggctcttcataaacagctgtacgaatccaagatcaagaatcctcccacacttggccagcagttccttagctcggcatttgagcttttgtggccctttgagtgaaataacccagagggtttggttctctgctacagaccagagaaagctctcatccctgtgcctttatttggccggggttgtgcttttgtggaaagtgcttggcaagatcaatccaaagttttagaacaaatctttgagtggcttccagagtcagttgagatttgttgcttcgtggagaaagatagaaacttcagactgagaggatcttaaagatgcctgaactgcttgcaggactggtgtattagagagattgtcttataacaaaagtgatctcttatttaatatattatttcctcccccagccccagatggcaaaaaggtgaataagttgagtagctggctctggaatttgagctgaggtcctattaatatgggaacttcctgagctacaatgcttcaactggagtcatcagttaagcttgtgtcttctcctccattggctaactggctggcaatgagcctcttacttgacagtacacagtattgttagtttccttaaacactctgaagtttgacttactttactgatttaaagagaaaaacaactattctaactgttcctccacatggtgaatatcacctaaattttcaaacaccaattaaggacactttttatatcatcacacttattgaatttgatgtattcttagtgtgcctagggagaatgagtaaagaatctgtaggagaaaacagaataatgcacttcttctggaaagcaggcttgtgtgacagaaagccatccttgtgatgagaactagggaaaaaaactaaccgtcctactgttgactttgtgtattttataggtcttgacatgcttgaaatgtacagtacatgtatactttaacctctgatatctgtgaaacgcttacgttgagaattcacattataataaagttcttttttttttttttgagatggagtcttgctctccttgcccaggctggagtgcaatggcacgatctcagctcactgccacctctgcctcccaggttcaagcaattctcctgcctcggcctcccgagtagctgggattacaggtgcgtgccaccacacctggctaattgttttgtattttcaatagagacgggtttcaccatgttggccaggctggtttcgaattcctaaccttgtgatccgcctgcctcggccttccaaagtgccaggattacaggcgtgagccaccacacccagcctataacaaagttctaacctttgttaaggtacacctaatgcagtcaaaaaggcaacacacttttttttttttttacaattaaaattctgttatcttcagagtaagcagctgagatcttagaaagagtgccacaagctgtgtgactaagagcaaaagctgattgcagacagtagaagaaaaatgttcctgaaattgaacataaaattaaagtgttttaagctcagtcttttatcatatctgcttatttaatgtcatgttgtcacctaataaggcttttaaaaattgaaaagagagtttaaggtagtagggttctaaagtgatagagaaaatggatgtcagaaagcaggccattactacttaagatattctcagaaagttagtagctttgtgattaaaaatgtttcaagaagaattcagttagagtaaaatatgtttgcctgaaacttaattgttttatcaagttttcctttacgtgccacaggcatcttacgaataactaatttattcttgggaaattttgtgttttccaagctcaaagctataggaatacaggaatacagacacttatttccaaatgtgaatttttcttttttagctctcattaagaactcatcggcatcttaaatgttgttcaggtagcacataaatctcactgcgaaaattttgttatttctggatgttctcatttctcccttgatggtttctgagctgtgaactattttctacagtttagttattttgcaacttttaaaacaaaattccattggtgggaagtttctaagattgtgattcttttatatgtacacattatctggtttaaatatgagtgccatccatcttctccaagatccagcaagctctgctcttagctttacaaacatggtcctctaattctgaacatctgaaatttctctgggtaaaaccacctcacctgtagtcattaacaatatttaagggtgacttggtaatcctcttaggaactttgagatccatgttttcattatatcacctcacctattgttttgtttgctgttctactataattgcatcaatttccccaaagcacaccatgtaccatagtcagattgtctacatgtataaaagcagcaatcggatctacatgctgtattaaagttccatttccattgttctactaaagaggcaaatcttattgcctctgtaaggtcttagctttatcaaaattattctaaacagacaccatgaaaatctgtgctctaattctcagcctatgggaaggtgctcacgatgaaaacccttggagggttacccttcagtggagcaaatattattacacttaaaacacttacgaaactgtttccatcttgttaaaagtattgtactcaagtctttcttgtcctagtgtggagatgactccatgtcattttgcagaaagcatctgaagtgtttccaaatttctataatttggaaactagcataaaatttaaagaattattatttttttctgcacaatgcacatactattgcactattttgcatcctcatgctcccctctctagtggatagtgcctcaacactgtacctcttgcctaagatttaaacctgctctgtagtcacacaatcatcctaaaatgctatacaatagagaaccgatttcgcacacccccaaacaacacatgctcttaatcagtccctcaaaccagagctctctgctaaagcgcatcctgcctctgctggctggagctttcacaaaccaaagcccaaataaaggaacagtgtggctgctgtagcacctccactccctgctcagtacaggaattctttaataagcacatgtgtagtacaggacagtagtacattccctccctgcattctagcgcggggacacatctttttccttgcacaatggatcacaatgctaaaaagggaaaacatgataagatacaaaaacacagctttttactttcagagatggacgatacaggcaaatatctatttttttttttaacctgtcagccctcccgaaagtccaaatgtaagctgccacacatgcatgggtctttccttaaagaaattgtttgatgagcccacttaacaacaaagtgctttagatcacgtccgaaaatatatgtaatctacccttttaaaaatggaaacctatgattgccagaaagatatcttctgcaagctttgctctgggtagtttgtactgaagtaaaaccgtcaccacccactccccattcaagcgagatttaaaaaggcaggcgaactgaaaggaaccacaagtcagtccgtccccatcagaaaacagagatcagagcaaatcacaatgctgaggaacggctcgactactcaaagaccatctccctcaggacgagacagagatatggagccatttttcactaggttcacaagaaaatgtcagctcacagctgctagtgcactgccagagcgcatcttaatttggtccaaagggactcagccagtcaccctcacagaacattttcttaaagagtccccattacaaatgtgattccctcagctccgagcatcttcttgttatagtctgtggcaactgcatggcaccgaactgcatcctattcagaactaaatgcttccccccatttcctcttaacatcatgtgaattagacacttctgagtcaaaggggaaaaaaaagaggaagagaaaaaagcatctcttcctactccccacccttctccacgttcttgactaatacctctgggcagtttacttcagaatagagcagattcttgaccagggcacaatggcaaattggcatacaagccccttgctatcacggaaagcacaagcaatgctttctttgtaaaaacacaggaaaatacacatgctggaacaaaagacactctatctgcacagcaagaaacaagagaaattatgtgtttgttttacacacatctgtacccactggttgtaaaaaaggctttaaacctattttaattataacacattgtatttttttccccaaaccaggtccccataaaattaattttttaagcttcggctccaataggaggtaaaacacactctgctggaagaatacctggtgtgtgtctttgttgatggggtgccatttcaaacttattatatttgaagtcaattacgtgggaaataaagataaggcaaatgcacttggttctctgaactattctgacattagaagaaatgccaagtcagcagatatctgctgtttacatttcacaataacctaatcatgcatttgcagctttctggagcaaaacactaactgttctccaaacagccacctgacaatctaaggctgaaacacacattctgactcagaaggagacatcatgatggctctccactggctgtattaaacaaaagctccgcaaacaaacgagaggcatttggcaaatgaagtgagagtcgaatcaagtttaggttcacatctggtggaatatggcactgctttccccaggggttgaggagcagaagggtttggaggctataaatagaacacacacacatatgcacatacagatatttaagccagacccgggtcagtttcagcttactaacctagagctctgttcaaaggaagcagagaagccgcacgtcctctcccacctttccatggtcctcagtcagtgtcttctcaaaccacctgtactgatccaacccattcgcagataaaaataattttcttgatagaagtagtctcagctgagctttgatttttcaacatggatgtctagaattttcctctttaagccagacacagcaacacaaaactgccgctgagctcttttgttttccctcctctcaaagatgaagcatgcagcacttctctctctctctctctgtctccctctgcctctccctctctccctctccctctctctccttctcccctctctcgcttatgctctctccctccgtttccctttccccaacccccaccagcaacctcgctcgcttcccggtcagtcaggggcatttacatctctcagcacaagaacctgtgttatctacgcgcctgtctctcacttttgggtttcctctgggaaagggaggggggcggctctaggtgaagtcaggtgacccctccattaaaagccagtgagatggatggagtgtgtgaattttaatatacacacaggcacatttacattacaaagcagcgaggaaaatctagctcctagagattaagcatttttgtttttgctttcatagtccccttttaccaattaagagaagctagtatagtataatgaaatgtaattaaacttttcagtgttaataacaaggctgtatcctttcagaatcatccagctgaacaattcttttaaacttgtaagcatgactgtttcttttcctttcaagggtcaaagaatcagtcattttactacttacacactttttcaaattggtcttttctttgacatccatttaaacttatcttgaagttaaggaccattgtaaaagacaataaaaataataatgtgaaaggaaaaaaaaataagtgacaaaaacaccaaagcacatagcataggtagaaatcaatagtttgctgttgtggaactagattcaataatgagtaatgctttgctctgagacaaataatttttcccttctctgtttcagtgtctctgtcttaaatagaaaataaatgtaataaatatagcaagtatcctcttcttgcaacccaatcaagcaagcctagtagagaagggtgtccagatgctaagaccacacagcaccccagagacagaaacaactggaaaaacttgtgctaacctagtatagtattgaagatacatttatagtctatggacctaggccctaaagagtaaatttgacaccatcttctcctctgctgcaaagtttttaatatccagtggagaccatctcttctatctctaccactgaatagaaaagatacgtaatctgctgttaggaatactgtaaagaaaaatgagataatatccactttctttcaagggtcaaagaatcagtcatttttttgaacactcagataaaaagtactttgtaaggctaggtgataaattattagaatgaagaccaacaagcatcagaagaaaactcttatttggcatttggtgttctgtccacggattcttaattcaggagcatgatgatactggtgcctcagcaaaagaggaaaatagaggaagagctgacatagaatcacattatccttgccacaaaagataacatttcaaactcttacacaaacagcctctccctccttccagaatgatgttggaagagtgttgcatttgctgctgggactgaggactgcagccgaaatacacccagtcccctccatcaacacctaaaatgaataagaactattcactgttcttgctggctttgtatttgcaaagctttaccttgcatggaaaagatcccatttaagcttttaaaataaattatatgctaactggctgcaaatttagcttcagtttgtgctacaaaaattggcaccaaaacattggacaataaaaaaatcttccctcgaaaagtaagtcggcttaggcaaatttagaaagacctaaaatgttataggaaaaaaacataaaagatttcactttatagcttctaataaccaaatctgctgttctttcaccttttcttttttccctctagcattggctgttttcattttgcatttattcagagttttgttttgtttgttttccctacttcacccactggcttttgttcttttggccatggagtcactttccttgaatgtgcaaaatgtaggcaaggacagacagtgagaaagacatattaccttagatcagataatttgtgagctttaaccctaacactagtgtattttctgagaagaccacaggcaggacagacacacctaagcatatccaatacagacacaactttcaggctccaagctattctaacagagacttgatgaacatggaatatggactgcatgtattttctattaaaaacagaaagatcatgacttaaagaagcctattaaaacttaccaaagacaggccagtcccaaaaaaaaaaagattgatataaattggcaaaaacagtatagcaactaaccctagccaacttttcaaaatgccttccattactcaaggaacaaactgaagtgctgacagagggtagaataaatgtttactaatgcactcatttattcaactaatgttcactgagcacttcttttgtgctaggcaccatactaagcactgaggggtacaagaaaaagaaaacagagtgtttttcagaaactcaaaacaggtacccattaacatgtaatagatgttggtacaaagtgctatggagtgtcagaaaaagaagaaaaattctccttaaggcgaggcaggacagtcacatagaataggtaaccctcgaactgagcctttaagtatgtgtcagttttctaggtaagtaaaggcagggggttttcaggcagagacacaaagaacacgaacaaacctaaagggctgcgagtgatcttaaatgttctgccaaggaatttgtgcttcatctgagatgtaatggcaagttatttaaagttctttggctagacaattacatgttttacaaagattattttagcagcaaggtgaagggcagatgacagcagtgttttccaaactttcctaattataagaattacctgcaagttatagtaaatatatatatcactgggttccactccaaatctagagaagtccaagaatatctatttttaagcagtatcccaggcaattattattatcataaaatttctggaaacactggttttgtagtgtttgctgagtaccagaatcacctgtagagattttaaccaatcaaatgcaggccacctctaaattacttgaatcagaacatctggggatagaaaccggaaacattgttgattttaatcttctaaggtggttccaatgcatccgaggttggtaatcattggtttggagagaggcaagacagaaaaaagactatttagaagctgttgtagaggatatttgggtgaaacaacagaattcaactagctcaagtaaaggagtactcgtgctacaaaaggcaatatcataaacataggaaacacagtaacgctgtacgaagcctcacaggaactggggctaagaagccactaaaaaccaagaatcctcttctctctctcagtggctgtataattcacttctttgattcttcctgtctcttatcctgaaccagctttcttttcttgcatgctgtcatctccagggccatgttgccttgtcagttctcatgtcagcaggcaaagactggattggttgggctgatttccttagtttgccactgatctcatcagttatagccagagtgtctcacattcactttgcaggagctctgggcaaagattttctgagaagaccacaggcaggatagacacacctaagcatatccaatacagacacaacagttcaagcaaaaaatgcttaagaagacttgagtaggctagtggtagaagagactaaaggtcccagatgcttttcagaggtggaactcacagaacatggtgactaattgaatatgagggtgtggaagagaaaaagtcaccgcagaagaataaatatattttcatttactgcagatgctacattataatacaaacaccactaagtgactatccattttactagtcagtagaggatatatatttggttttgaactccacacttacatatatatagaagcctaaaggtcagggccgggcgcagtggctcacacctgtaatcccagcactttgggaggccgaggtgggcggatcacgagatcaggagatcgagaccatcctgactatcacagtgaaaccccatctctaccaaaaatacaaaaaatgagccaggcgtggtggcaggcgcctgtagtcccagctactcgggaggctgaggcaggcgaatggtgtgaacccgggaggcagagcttgcagtgagcccagattgtgccattgcactccagcctgggcgacagagcgagactctgtcgtctcaaattaaaaaaaaaaaaaaaaaaaaaaaaaaaaaaaaaaaaggaagcctaaaggtcaaaggcaggccaaaaattaatcgggaaatttagacaaatggagatatttacatagagagttctatacatacccaagattgttatgaaaccaactgagagacctattatctcttgctgacaccagggactttttcacatctgtgcctttgattccccttcctgaaatgacctctcccttctttctctatctatactttatctattttatctgtaactgataacattatgcatatgaatctaccccatctctaatacagtttaaatctaaggcatatagctattacaacagcagcagcagaaataaaggtactaatataaggttcttatattagtgttaaaggatttagcttttttaattctcacaataacttagaaagtgaagtctggaaaatctaaagaattcactaaaggtcagaaaactaataagtgcagtttctggatgaagacccaacgcaactggtgctacacaattaacactgtattgtatcttattctctaatcagctggaaaccaaaatttagttattgattatattagtagagagcattgttactgttttgctttctactctcgtgtgaacctgcaaaaggctcagtcttaggaactggactctgtctctgggtttaaagcctttctctgtcatttgtgggctgtgtgaccaaaggcaagtcatccaaactctctgtacctcagtttccacacctatcttgtagattcaccatgaggatcaaatgaaattttatgtttagcatttagtacaatgcctagaactattatgttctcattaagtgttaattattattttattaccactattgttgtcattagcaagtaagaagcaaaatttctatgtatccctcaatgacactttccttgtccagataaaggagtgtttacatagctttcaggtagtttatgtagctttcattcattctagttttacagagctcctgttgatttgatcaaattaggaagctacacttactactatttaactaatcataaactacatgtatttctttataattgatccatagtagatggtctcttgagacatttatgatctccttttggcaggcagaaagtagaaattgcataatttctaacagcacttgcattttagcaataagctaattattcatttttcttaaaaaacaattatatctgctttacctataaacaagtcttttttccaattaattattttcaatatttccatggaacatttctgcacattctgagataattctactggcaaacaaaacttcttttaaatatgcatcacacttgtcagttaagtgcatgtttagtgtagatagggtattgtgctcatgtaaaatcaaaaccaaataaatactacatcttatctgacagtgggaaaaattccgcatgggaattatgatggtcgcatttttgcaaactataggcaagcataaccttgagaaaattatcttcttttttcaatgaaataagttgttgatcctaacaggtaaagattctactcttgatggttttgtgagcataaactaaatgattgatatatgattgaatattgagtgtgtgtatagattacttttgggctggcagctatggtgtttgcagagcctggatctatgggaactttctcaccctgtctcataggctactcacctctttttgactgtttaggtcaaattaatacattttcagtcactgtcaaaagtgtactgctctacttgaagatagttatatgtgggtgcatgtataaatatgataggaaatagttaaagtttgattaccccattctaagagaagaaaagcaaaaaggagaaaaattatgctttgggtttttctctagtcttaactaaccagccaaagtatatgttttaagaaaagcttttaaatacagcacagtgtcaaagaggcagagcttcagcgaccttgacttcactatttcctagctgtgtggtaccacataaattactcatttgtaaaacagtcctcatatcagttgtatagttatcaggcattaaataacataatgcatgtaaggagcttagcacagtgcctggtacaccatcaccatcatcaccactaccaccaccattatcactgtcaccatcaatatcatcatcaccaccatcgtcatcataactactaccatcaccaccactatcattatcttcactactatcactatcaccatcatcatctttctcctactcatcatcatagccaaagcttgtcatgtaccagacactgttctaaataagtacaaagtaagtgctagctttcaccattattattacaatattttcttttactggcttcaagttatgaaattgcatattttgagccaattaccttgatataaaacacactatcatattataatgggccgagtgaaagtaaaggcatccacttaaataccttccagtacataaagtaaaatggaacataaaatgctttctccttaattagtctttcttcaccataaacaagtctcaggatcagttgttgcacacagaaggaccgctctagatgatttctaagtcctctgaaggtaattcatcatatattaacaatccacatgagaatatgcttcatatgactgaaaggaccaaagcacaagtagaagggctgtctgtacccagcgatcatgaataaattcctttcttgagctgctctttatggatttgcatttctgatctcataatgaatcatcccagttttgatttctgcaagccaggctgaattgtgatcttttattttcaccagaggatcatgcttttccataatccttcatctacattaccttgtgaacccaagcacatgggcataatggggcaaatagagagtctcctgcttaatgagacaacgtttgccagagctgaacctggacaaaattttgaagtgaatgcagtttattgtccataccttccaccttcttttctccacactttaatccactcagtgtcactttccccattcccttagagtccttcctgcttttgattctcaccttataacatgatcaaaattcagtagaataaactgtgcaaattagtatgtgttatctaaagtagggctactttttgtcttggtgactggatggtttgtataatcttaaaagttaaaaacattccttagaagtagaaactaaaaataatttatagaacatctaaactatggcctaaaatgtctatttaaagggactgaattaaccaagcatattccccataaagtccaatttcaaattagagtaaaggaaaatgaagagcatggaagctatatactctgacttcagtaacctagcactggaaaaagaaacactggacagacaccttagttttgaatcaaattctaccacaaactgtgtgactttgggcaagataacttaatggccttaaatcttaatttcctcacctgtaaaatagaaaatacaatatctaatctctcaggtatattgtgaaaaatacatataattataaaataactagcacagaatctagcatataataatttctcaggaaacagggctttccttttcagccttttttttttttttttttttgagatggagtcttgctctgttgcccaggctggagtgcagtggtgtgatctcagctcactgcaacctatgcctccccggttcaagcgattctccttcctcagcctcccgagtagtggggactgcaggcacatgtgccaccttgcctggctaatgttttgtatttttagtagaggcggagtttcaatgttggccagggtggtctcaaactcctgacctcgttatctgcctgcttcggcatcccaaagtgctgggattacaggcgtaagccaccacactgagccttcagcctttcaaagtagtcattcacccaccaaacagcaactttttttttcccccaggcttgatcattgtccatgtgtcacctgatctgcccacatctccttagttcacctgacatttgcctgaatggctttcactatttaagtaagatgtgctcttgcagaagatctaaattttagtcaagtgaattactttcctgaaggcacctgagcaacttaatagaaccaaaatcaaattcaactggattaagaagaagggaaagatgaagagagaatagaaaagacggaagaaagagaagaaatagttacctggtctacctagagaccagaagttggtaccacagaatagttgagaaagttttgactgaatcactctgttaggattaaggagacttaccctggataacttatttaatgtcaatgaccttctcttcgaaacacagatattgaactttttcaggaactcatcaggctcatagattttggttgtaggagattaagaagttaaacatttcttgagctttcaacatcaaaccgtattagtccatgatactgggaagtgagctcccattacctcaacctgactctatgacagactctgctatgtgcaacatccctttcaatccccatggtgatggtgctatacccattttagagaggaagaatttttgggtcagaaagcttaggtgactttctcaaggtcaaagagccaaagggacagaacagggattaacacctttcaatacaaagcccccaggtactttttactgcactatgctgccaccctctgggacagaaattagaaagaaagatattaagaaatcaaacccttaattaaatgactctgcaaaaccattgcagataaatgtgaacagtccgcaacagtcatggaaacttgagaaaagaatgcgtgttatgacaatgtgtactgcttaatgtttaaaaactggctctatgaaaaacaagcaaacacattgatttgtatcccttgctcatttttgtagagtaaatatgcccattacggcaaatttcaagctatcaagttaaagccactgaactggatttgggaaaagatatgcacaaatgtctctttcaagacagtgctagccacctccagcaccccactctatgtgtagatttgtgtgtgttcatgtgtgtttgtacctgaatttataatgccactttctgtaaatatattaaaaagcaaaatatcagttgaaacattttcctcattagtaacagtaactatgagtatcaggagtttcaattatgccctaatcagtactcccacttgttttcaaattaggcagattactagtatttctctttcagttccgtaatataactctcaataatcccagcaaataaaagaaaacaaaaccccatgctcccgatcttcacctcattttctaccacatactggatggttcttatgtaacttttgaatgaatacttttcaagatttcctatgagatgtgtgaggctttcaaagaacccaaggcggggctcctccagtaaaaccaacaggtgttaattgtagtatttgtcagttctgtttcagtaccgggccattagggaaacctgaacagaaagggaaagtaaactttcctatggcccggcctttcttattcctcaccttctaaaagtgacataactgctggaattcctctagaataaaagtaagatgactgaaaagttgtaggaaaattgcatgcataatttacattacttgcaccttgagcaagcaatggagttgtcatttgtgtagatggcctcacaaatgatattcagatagattgtttggggaatgacttctgattactgaaacaatttacttcatcttattcatttcttctgattgtgagatactgtggtaagaatacagcagagggatggccgggcagggtggctcacgcctgtaatcccagcactctgggaggctgaggcgggcagatcacgaggtcaggagatcgagaccatcttgactaacacggtgaaaccccgtctttactaaaaaatacaaaaaattagccggacatggtggcgggcgcctgtagtcccagctactcgggaggctgaggcaggagaatggcatgaacccaggacatggagcttgcagtgagccgagatgtcaccactgcattccagcctgggcgacacagtgagactccgtctcacaaaaaaaaaaaaaaaaaaagaatatagcagagggttaaatgtgaagagcctactatgtaaaaaaaatttgcataaaggcttgaattattgcccacataaatgtgcagaaatttctccccatctactaaataaacaaaaaaggaaaagatgcttaaagcatctatgctattgagggagaaaatgggaactaaattgaggaacaacttccctcttcaagatttatgataaaggggagaaaaagaaataacctacatattcaattgtcacctataggacaatatatttctatgggaaagaaatagcttacatagtaaaaaattatattagaaattttaaatgagaaataatgcttttataatagaagaaataatgctttaggacaaaattaaagtaaagaatgttaacatcagaaaaaacatcctaactattagcgaggtaggcactggaagaggtcactgtaagaaattgggtattaaagacattgctgaatttttgctttgaaatctttaagaacaaaatgtaaatatcttccttcaattgttatatttcttaaccccttggaagttcctacgtaattctttaaaattctacatgttttaggcaacttcataaatgatgaaatagtgaaagtaaaattaaaatcagtgtagttcagatttttcaaaattcaaaacaatttctaaatattagaagttaccttaagaaaaaaggttcatttctaatgaggtgaaaaagtagcacaaaatggagtcagaggtgagcttcctccaactcaggagaacgtcggcaattaagcgataacttgaaacacgtcagctggagttggaggagtgaagaggaaagattcaccataaatccattaggtagaacaaacaggtcttagtaaacaagtggatgcaaagtcatgggcaagggcgatttgaggcggactggcttctagcctcgtctttccattcttcgctgttctaacttctttttgcctacccacagtaggccgagagtcagtgcggggcaggtgagtcctttgataaaggagtggggaagaaatgagttggatgttaaacattttgagtgtggaatccttgacagaaactgagttggagaggttcagagctgggaatgcagatttagggatcccctagggcataactgaaccctctagctgaagtgggtttaatgggtgataacagccaggaagggcctaggtgcaaagaaagaagagagggaacatcaatagttgagaagtgagaaaagatttgaagccattaaatgacactgagaaagactgtcagaaataaagaaaaataggggatggtgactgtgtcacatacagactgcctgtgggccaagcagatatggcctgggcaaagctgacaaacgtggtgccgaacagcttttttgtaaactttgacagtactaagcagatccctctgatgagagactgtaaggaaaaaaggcaaaaacacatatacttcagtgcttctaaaccttgtgcatctctcagacttcttttgggaactttaagaatacatattattagactccatctctggagattttgatttggtaaatgagattccttatctcatgtcatttcttcaattttgacaatacttgaaaatgattcttaccttttttttttttttttttttttttacattttgtattatcttccaactagtctgcaaacatcttgatggcaaagactgattcctctccatttatattccccacagcacgtagcagagtgcccaagaaaaatattaggtgctcagtaatattcactaatatgtgggagttaactgatcatgctatcgctcttcaagataaaatcctcaaggttgatcagtaagaattttgaatgtagagatttagacacatacttgaataaagatttcagtatcttttactaacaaaacaaacaacttttaatgctaaaataaaatctgaaatgaccagtcggagaaaaaggactgttttcctgacataaagccatgtcagcgttatttttggaggatgttgatttaacctggagatggttaaatgtgtcagtctgaaggtgtatgtgtgttcgtatgatgagaaaaaagaaacataattatagatgtctcttgatagcctattcatttactatgctattttggaaacagtatgtttttaaattggtttctagtgtttttggatgggagttccgctgtacaggaacctggagctttgccccctgtagattttctccattggaaatcaataaagtgtaattgaattacagtgggtgaatccacaaggtgtcaatttctggctctcaggttgaggaactctccttcctcaagcaaccacatccaccagtgctgagttcctgaccccagtttgtagacagcagtgctgtactgacgaacacctgtgtacattgttaaatagcaaaataactactgtagtgaaatcacgtttaattttaggaattgaagaaaaactcaccatatttctattttagcacacaggatgtggcctacttctttaaaatgtcaagcttagagacacacatattttatttaaagaatacggaaacacccgttttcttctttgactgagtctgggatatagcccttttttaatcaggaaaaaaagaagttgacatgtttttggaatggtcatactaattgcgttgacatagtgtatcagggagctttcaaagatgttatctcatctgatcattataaccatccaattaggtagatcaagcaagtctgatcattccagtatttcagataaaactgaagctcagaaaagttcagatcaagtgtaaaccatgtcaaatgttttaggtttttttttttttcttactaatgttggggctcaggaaacaatatcccaaagtatggcatgttggcatgctgagtactttggaataaaggatctcagaagacctcagaagcagcctcagaaccagggcctctctgaccttctcttcccctcctgtctcttgctcctcattctctccagaagtaagtcatagaaatcagaatttctcttcctccaagcaggtcatagaaaccagaacccctattagccaaagctagtcataaaaactagttatcactctaactttccccacctttctgtctaggggttggccataaagacatttctctgacttaacctcttccgatagtaggtcataagaccctgattccgaagggtgctgccctatacccaggaggaagaaatgctataacagaggccaaaaaaaatctggacaggctttgctgggtttctccactcagtctattagcgttagatcatactctttttgtccaatcacatttctacatggatgtctattcttcatgaagactaagcataaaaatggatagttttctctgtatatttgggtctttctgatggctgctgtgtcaagtaaagctttgaataaataaatctgttatgcttttctcttgttaacctgtcttttgttacaggagtgttggctgtgaccctaagaaggttgaggaaaggtataatctttccatctctacacccttaaataatgcaatagcttagaactatttttttgcatcattctaaaggttcttgttaggcgtgcatggtgcctggctaagattaacaggcctttcttcatgcgtatatgtgaagttattaggggataaatgtttatattaccctgtccttataactatatgttcactaaacaaaatgaacaaaattcaaacgaaacaataaagttatcaccctagagctttgttataacataatttgaagctatcatttaacttcaaaaacccaaacaaaatgaaactaattaaatattttaaaatgggagaaaaatctacatccaaggaatgcttttaattttgttctgcttcaagtcagtttgtttaaaagtcaattagatttatgcaagccaggatttgcaaacaaaatggagattggatcattttattttagaaaccatttttattggtttttacagcccaatagtacaaaactgtgtaagtattctattttaatttttacaaatttaggaaagtattgaattgaaaagctgttaaaagctttgtaaaatgaattgtcaattttgccatcatgtcagaggtgctgcctttgatgccactcacttttctgctctggggatatgtgtaacattttttttattttggaactctgttatttgtttccttttttgggatttaaaactatgtcatttactcacataattgcttctctcacggttatatctttactccttgcttttgagaaagccatactatttatttctcctctttcctgtcttctaggtgtatcatctaacttatttgagctaagtgtccttatctataaagtgaaaagttggacaagatattctttatgatctcttttgattttaaaatgttatgcaattttagagaaaagctgaagggtcacccaatatggtgtgacaccaaaagacaaatatgaggacagtcactttttcactctccgcaaactctgcctggacacttccttggtgagacttcatacactagacaagaacacactatgaatgtgagacagagggagacagaggaatgaaggagagagatagtgaagcaggctgggagagaaacagagaggaggtgtctactggacatttatggattgcatgtgtattagaggtggtaatcaaccaggattatcaccccccacaacccctgatagattcttccctctctgttaaaaggagctccatgtttctagtgctcagaaaaaaaaaacaaaaaaaccttagtatcatccttgcctcctctctgtctctcactcctcgcagcaaatcctgccagctgtaccttcaaaatagatcagcatctaaccccttttcactactcccacacccagcaggcgggtccaagctactctcatgtgtaatatggattatagcagtaccctaactgttctccttgcttctgcccttcttagctagactagtgaatctgttaaaacctaagtccaatcctatgggtcctttttaatcccaaagagttcctatttcattcaaaatataagccaatgtcataaaagtgacatatgaggcctttcaacatttgctggccacttctaagcccccacctctctgaactagtaccttttctcttgttcactggactctggccacaagggcttcctgacagcccttctaaaacagcaagcagagcccactatagggcctttgtgtttgacggccctctgcctagaacggtcttctcttaggtatctctatggctaccttccttgttctttaccttctccctcctctcctgacacacatacactttctagttctcaggaagctgctttatttttctttagtgcttatcagtatctgacatactgcttactactacgtatttcaattattcatcttttttgttgtgtgccaccccactagaatggaagcctaatgaggcagagatttgagttgcttccgctcacttctgtatctttggtgcctaaaacagtgcctggtacataatctgcccccaataagtattggttgaaatgaattgaattgtttctttctttcctttttttgtttttagacagagtctctctctattgccaagctggagtgtagtggcgcgatctcggctcactgcaacctccgactctggtttaagcgattttcctgcctcagcctcccgagtagctgggattacaggtgtgcaccaccaggcccagctaatttttatatttttagtagagagggggtttcaccatgttggccaggctggtctcgatctcctgacctcatgatctgcccgccttggcctcccaaagtgctgggattacaggcgtgagccattgcgcctggcctcgaactgtttctaactacaagatggaaaggaaaccttgaactgtgtcttggggagaaggtaggactgtggatggggatgagaagtatggaggccattttttggaacagggaataagccacttgggaataaagatctgctttgggagtatctcattaagttatctcagggtacacatgagaaaatagagtcacaagagcagttaaagtcacaaagacagcaagagcacagggttagaaccctgttctttaaactctcctatttcaggattcttgtaaatgacacaaaatatttaaatttcgagtttagccaggatgaaatacaagccagataaaaaaagtatttttctgttctacccccgttactgccaaaaccatcaagttaatattagccagcaaaaagctaatgctgaataatatcacttatatagttatactcccttagtaagaattagctttgtgtaagcataaaaacagattttaaactctcacattacaaataaatcatcagaaagtgcctagaagtatagaagatgaaagaatggcggagttttaacatttgatggagccaggtgatggttatatagagttcatcatatgattttgttaatttttcattttgacattttctagcatagaagtttaattattaaaaataaactgagaacaaatcccatagtttgatttagtcttattttgttcctcaagaaatgattataacatagtcagctacccttctcttcattctctgcttcttaatttcctcttcactccagaatcctgttctactgtgtgtgatgccaaggcacagacatgccctgacagatcctggatgagcttgtgcaaagcagtgatcaattttagaatggttctaggtgacaccaaatggacttctgcttcttggggtccaatcacgtgctttgggaaaggaaagacctgcatattcccttcccttctccaagttagtggcaaaatagtaataaaaaaatgtatgtatgtgggacaatcttttttatatactgaaaaagaatttctactctgtgaattgtctgtaactgatgtatttttgtagccttacctattccagattcccagctttccatcttttatgagaacaatcaaaatgcattttcatctttcccatagctttcaggttactccatccaacatttccattttatttggtctttttatccttcatatcctaactttagggttttccagatgtagataatttcacaaattctcttcattttgcctttgactgccctttttctctaattctggatctcttcatttttttttaaaatttgaattatgggcacctatctttgcttatcaaaaaaaaaaagcactgagtataatttagtttaacgtatatgactcacagatgtgcaatccagtttagatttctgtagtttagaactgaactaggaaagtactacacctcacccttttttattcagggattctcttttcccttagggaatacctcccactaataactccgtttaagtcctatttcctcttactgtctgaatatcattgagatgttccttgaaacatctttatatgatgttactccaatgatttaagttttaaagaccttcccattacagctgacataaagtacaactccttcctccctggagaccatgtaaggtgtggctcgtctgcctctgtacccctacgagaggcccgctccttctcctgggtcgctgtccagatctcattggtctcctctcactttctcctggcatcctgtctagggtagatttccctgcacattcttcttctcaaccctttgtgggtttccttactaatactaataacagttcactttacatattttattcattttatgtgcttccatttttaaaaaatatattcattgcattgtaagctactgaaggacaaaaatctcctctttgttcctgttctctcctctccctaagatttagaattaaaaaaaccaagataaaatggttatgaggatcatttatttgagctacccaatctcacaaacatatatttgattaatcctttgctcatcttagggaaacaagaaatctttcaagtttggttaatagcagaatccattaaattcaacttcaattatctaagtagccaataatttcctcttactggtgcatgctttctcagcaaagatgtaaaatccacagacgatgaatgatattgcctgccatgatgatttcttacccttcaaacattttgcatattcttttaggactaaagagtaattctttccagctcttctcatttttatttttttctttatttttcaaaattcatttttatttgtaagtttgatggatacataataggtatatatatttatgagatattttgataaagcatacaatgtgtaataatgacatcaaggtaaatgtggtatctattgcctcaagtatttatcatttcctagtgttacaaatattccaattatactcttagtaattgttaaatggacaataaattattattgactgtagtcaccttgttgtgctatcacgtactacatcttattcattctatctctagctctttttagttagcatataaaatccacctgtggtcttttacaaatatcaaaacatgggtactgaggtcatatgcaggatccattttgaaataaaatgaaaatagttataagtaggttccatttgagaggcagaaatggacacccaaattgcttgtcaattgcaaacaaaatatacttaagcatataagttctgtttacacctagataaagcaatagagtgatcaactgatagatcaatatacagatcaattgattgttagataatttaggataaattatatatttttcatgaaataatattttcacttgtccaataaaataaaacaaatgtatattatcactttaggaaattagaaactctttgctaggtggtataatataaaatattatagttatacataattatatgtatgagtctatcatacacataggcatgaaagtggctgtcttacttggcaatatctgagatatgatatgatgccttgctcttttaaaaaataccaggtccattatttatttattttattagaattttattagaatccatcctttaacaaagcaaaaggggttcataaaagtgaaagaagatttctgttgaaatttagatcactttgccttcctggagttcagattttttggtttttggagacagagtctccctttgttgcccaggctggagtgcagtgttgggatcttggctcactgcaaactctgcctcccaggttcaagtgattctcatgcctcagcctctcaaatagcttggattacaggcgcccaccaccatgcccagctaatttttgtatttttagtagacacagggtttcaccatgtttagcaggctggtttagaactcctgacctcaggtgatccacctgcctgggtctcccaaagtgctgggattagaggtgtgagccaccgtgcccggccctgtcatcatatttaatattaagattaataacaatacaagcaataacaaagcttactctgagtactcactatacacttactatgccaggtactatgtacgtaagtgtcataggtaaaaattatgatgcatactcacagaaaaagaaattaatctttgaggaataaagtgacttgcccaaggtcccacagctagcacagtatctgagcttggatttaattcctagatgtctgactccaaataatacagtcaaacagtctataaaacaagaagattaaatgaaataaactcagaaaaacacagctgtggttttctaaatgttaatcaactattatactggaaagcaaaaatggtatgttgagaaaaacaacaggtttgagtagaatgctatagtaaaggcctctggagaggagtcctccgtaatagaaaaatgggcaaagaacaggaaactggtaactcacattgaagaaatactcataaccacaaaaagaaaaagagagagagaaaagtttaacttaactaataaagaaatgcaaatcaaaacaagatgacattttctgctttgaaattggaaaagttttttgaggaggtataatttttttcccttatattggagaaatagttgagaaacaggcattattattaatggtataatttagcaaacttttctgtaagataagttagaattacgaatgaaaagattatcttctcttctggaagtttattttaagaaaacagagttgggcaaaactgtttatttgaggatatcactacagcattacttttaatggctaaccctgagaaacaatcttttttttttttttttttgagatgaactcttgctctgttgcccaggctagagtgcagtggcatgatctcggctcactgcagcctcggcctcccgggatcaagggttcaagtgattctcctgcctcagcctcccgagtagctgggattacaggcacacgccaccacgcctggctaatttttgtgtttttagtagagacagggtttcaccatattggacaggctggtctcgaactcctgacctcaagtgatccaccagtgtcaggctcccaaaatgctgggattacagacatgagccattgtgccgggtcaagaaacaatcttgatgtgcaaacacagtagggggtaggtcaaattattatggagaaccctcaaagtagaaaattacatagttataaaattatgttttagaatttagaaaatgatctttatttttaaaaatatgcataggatgctatacactaaattttcacagtgcttatcacttcacggacagattttggctgaatttctttatatatggtaaaattagtcattaggaataagcctagattcactatattacctagtaagagacattagagaagaaacatgggggagttgaacaagtttggcctaagttcaaacgcagactttatccctgctggctgtgtaactttcagtgatttatttataaaactgtcatagtgttacagcacggaggaagacacgtaaagcctttacacaataaacacttaggaaatgtttgttgtccacgtcatatttccagtttacagttttaaaataatgtgaaaatgcaattttattttgtaccactcatatgaacaacaccttatataattatttaaagccgcactttttattagcaagtgagctatactacaatagcaccgctatagagatttatcaaaagatgataaaagaggcaaggaacctcaggctggaaataagtgtgagaagccgatcatggttacagagtgttgagaggagcatatcctacacacccagcctgtcaatttgaactccctataatcaagtataaaatcattccaataagtacagattgagagttccttcttctattattttatggtttatttgctttttatatttctcacacacattatttaaataacccaaaccacaaatattgatattctactgtggattgcacaagtgtaagtggttaactgaaaaaaagaagtaattcatatagtgaaagagcaataaaaaatacatcaacccaatacaaccaccctgtaggtctgtaggcatgaataacaaagcagactaaatgagaacattctcggcatgcagtgtgctgtttacattcttactaagaaaatgtgcctgagttagaatttatacttcaaaacagattctcaaataatattttgatgttaatacgtcagcacaccgatatgactggctccatgtctttcaggcacatgctacatttcccaatttcctttgaatttaggggtacccatgttatttgttttggctaaatgtataagcgtggaagtaaaacatcacttctgggaggcagttttaagagttggtgtgcaatttgcacatcctttctttttccctttgccactgtatccaggaaagctctagatggtggcagctctatcatcctgaatcccagagagaggggtgtagaggagagactccaactgatgtttgagagatatgcactgtgaaggaaaacaaaacctcactgatttaaagcaatggcccttgactggaggcaattttccttcccaaaagaatatttggcaatatctagaaacattttttggtttttacaacttccgcaggggttgcacctatggcatctagtgggtaattgccagaaatgctgctaaacatctgacaatacaccagacagcctcccacaacagagttatccaatccaaaatgttagcgcaaagtctgagaaattctgtcaatcatggagatagaataatttttgttggtacagcatcatctaggatactctgactgatagatggttcaatatttggaaatctgttaatataatcttaccataatgatggggcaaaggagaaaaaatgtgatcttctcaatagatttagaaaactcatgtgagaaaaatacaatatctatttgttagtaaaaaggaaataatatctattttcttaatatcatatttgaataccataaaacatatttctcagaacaaaagtaaaaatatctgattagtatttggtcagttcaaagagtctgtaaagccaaaaactggaaacagtacagttgcttagttggtgatcgtatatctcatgtacttcttgcttcagaaaatatgtgctcatatccattgatagaatccatgaagatctcttggggactcctgtctcatgtaggtatttaaacaaaatatgctgtatcttctgtgcagttttaaattagggttttttgaaagatgaatttattacaacaattgtgacctataaagtgactagatggtacttgcatctgaaaaatcactaagtactggataataaagtagtctaaattatggtggcctccagtttataactagtgagttacacacttatatcctttttatccctttggtaataataataacttaaaattacaactgactaagaactgggaccagtgagaactcacacactttgctgttccagtgacagcactgcctggttaatcctgagatgcgggctcagctgagtttgttggtagttgcattctaagaatcccatgaattcccaggagctgagcaatgaaactctaactgaaatgggggagcaagagatgcttaagaaagaggaattacgatggcaactgcccttctccacataatttaccattcacagacttgtgtggttataaaattgtcaatggaaatttttgagacagataacataaattttggaagcagttcaaatgtctttggtaaatgaaaaatgcctgtttgccataggaagatttaccaggtaaagagatggtttcttcagcttagattttactgattttattttgagaagcctttacttgtcctgttcatgcaaaagaaaaaaaaaaaaacaatccaaattctaaaggaatatttaaatgttgtttttcacgaaaatttgattttatacacttgaaaattataaacatcatatatttgtatcttattttctctactgatcaattggagtgttttatggaataaaataagttttctggaaatgaaattccaattatgaacactgaaactattggaaatgaggagttaacttatgttggctacacgcataaccaagatcaggggcaaattgaaggaaagatgcatcctattttcactatttattcctaatgaaaaaaaaattgattttacagacgaggtctcactatgtttgccaggctgaccttgaactcttgggctcaagcgattcttctatcacagagcagctgagattacaggcatgtgccaccatgccaggccactatctccacttttattcaacatagtactagaagtcctactcagagcaattgaaaagagaaagaaataaagagcattcaaattggaaagggagatttcaaattattattgtttgcaatgatcttatattgcaaatataaatataagattattataatgatcttatatatgagattatttgatcatatgattatttgattattataatgatcttatatatgtttatttgatcttatatttaagataatacaatgtaacaatcttatattcagatcttatgcaaaattttttatttagaaaaaattaaaaacatcacccaaagataagtttagtaaagttacaggatataaaatcaacatacgagaaccagtggcatttctatacactaacaatgatcaatctgcagaagaaatcaagaaagtaattccatttatagtaactacaaaaaactaggaataaacttgagaagtgacacatctctacaaggaaaattattaaaacattgataaaagaagtcgagaggacacacaaaaaagtggaaagatattccatgctcatggattgaaataatattattaaaatttctatcaaaataccaatgacattcttcacagaaatataaaaaaaatcctaaaattcgtacggaatcacaaaaggctccaaataggcaaaggaattctgagcatctggaggcatcacattacctgatttcaaattatgtaataaagctataataaccaaagcggcatggtaccggcataaaaacagacatatagaccaatggaacagaatagagaacacagaaacaaatccacacacagccaactcatctttgacaaaggtgccaagaacatacaataggaaaaggacagactgtttaaataaatggtgccaggtaaactggataaccatatacagaatgaaactagatcccatctttcaccacgtacaaaaatcaactgcaaatgaaatacacacttaaatgtgagacctgaaactatgaaattactagaagaaaacactgtggaaatgctacaggtcattggtctggggaaaaatttttggggtgagacctcaaaagcatggacaacagaagcaaaaagagacaaatgggaatacttcaggctaaaaagcttttacacagcaaaggaaataattaacaaagtgaagagataacctacagaatgggagaaaatatttgcaaagtatgcatctaacaagggattagtaacatgaatatataaggaactcaaacaactcagtagtaaaaaagcaaataatctgattaaaaaatgatcaaaagacctgaatagacatttctcaaaagagacatacaaatggccaacaggtatatgaataaaagttcaacatcactaatcatcaggtaaacacaaatcaaaaccacaatgggatatcatctcactccagttaaaatggctattaccaaaaaagacaaaaaatagccaatgttggtgaggatgtagagaaaggaggatgctcatacactgttggtgggaatgtaatgtagtgcagtcattatcgaaaacggtatggaggttcctcaaaactttaaaatagcatatgatccagcaattgcactgctgtgtatatatattcaaaagaaaggtaatcagtatatcaaaaaggaatctgcactcccatgtttattgcagcactgttcacaatagccaagatatggagtcaatctaagtgtctatcaacaaatgaatggataaaatgtggtatatatacataatggaatattactcagccataaaaaagaatgaaatcctgtcatttgaagcaacatggatataactggaagtcactgtgtttaagtaaaattagccaggcacagaaagacaaatattgcatgttctcactcttatgtgggagctacaaaagtggatttcacagaggtagagagtagaatggttattatcacaggctaaaaagggaaggtgtgagtgaagaatgaagagaagttggttcatgggtacaaaaatacagttagatagaaggaataagttctagtattcgatactacagcaggaaaattataattaacaatgatttactgaatatttcaaaatagctagaagagaagaattgtaatgttcccaacacaaagaaaagatacatgtttgagatgatggatatgccaattaccctgatttgatcattcaatatcgtagacatgtatcaaaatatcatatgtacccccacaatatataaaactatatcaataaaaatataaaattaaaaaagatttatgtatatcatacagcaataaaaagcaacctatcctagacaatgatcaacttaattattcttttttcttttaatatattatgtgtgagctctagaaaccctaaattccataagtagatcaataggaaactggggaattcagcttcaaaaactgtgatgtattaatctcaggtgtagaagcagagaatggagctttttatttctgcaacatccagtgtttctttattatgtgaatgaattttaagaagagtaattggaacattatgtcagtaatgtttgcttttcataatagaaatagaaaacttcagatatgttaatcacatacaaatgtaaatcagtgagtatttagtaccaaaacacaggaaaaggtttttaatgttcaaaagttttatggttatatctttgctatacatcaggtataggttttattcaaacaatttcaaagttctaaggagacaactgccaagcccaatggattatatattcacgctaggggtaaggggagagtggtcaggcaaaactagaacccttagagagctggtctagtcttgcccaaagggaaagagtgcccaagagcagttcaaataatagggtgcatgggtgcatggcaatgaaacctgtcacattaataatgtccattctaattccagagggatctagaaacatactttgcaaaggaacagggtcacacaatggcacaaaatacaaagtgcttgttttattatttctgttcagttttctctaggtaagtggaaaggagatacaaatgaacaaaaatatgtaacaggttgtttttgaaatacagaacaaaggaccaggagaaaaacttcattctttacctttgagaattgcttagatgtagtatttacgcaggctgcattctggattggcaataaaccaattaatagttgtgaaaactatgtatttctatgatcattagttcatcttacaggagaaattgctctgaagaggggttcaattatccaattttgtatcaagcctgcattacaaatgactagtcaattcagtcaatgaattatctcagatgaaaaaaattcagtgatataagttattcttatcatgttggcaaccacaaaattaagccaaacagaaaatgaaatgggttggtttgtcagatattcatttcttggtaaataaattcattggtcatgcctgcacccatggtctctccttaggaaggtgtgggctggaatgggcctgatgggctacatggtcctgctgctccttgttcttttatttattttgtttcttttcctcattcttctctttgagattggtctttgggaaccgggcttcaatctttaggcttcaggatgaatactgaatgagaggccacagtcctgtggtcatttcccaatggagaacggcccattcctttctttgacatttatggaccacagctattaaacaataattttctctctgagctatacccagtaaaatgtgcaagtagagagctctgcaaacttccatgctgagctcaagttgctcatttgtattctaactaaggcaaatctaatatacagtttgtacaaaatcctcaggctggaaatgtatatcatggcctagcaggtgaattccaaaggcctttgccaaacatccgatgtctcctcatggttactaccttgcaagaagatcaagaaagaaaagacataaatgatgctattacaacaggaatttctatgtttcattgatgactgccatattgctcagttttggggctatgagattgttgagggttaataactgcagtgacttttaaaatttattctttctttggtcaggacaggtcatcatctgtctttgctggtgtcccttttatgtcttgctaacgatttgctgaacatgtgcctgatatactacagttttcatgaaataggcagcggacaactattgagatatgcttggtgttgatagcatacaaggggctgtatatgactattctgtacactggcagaagtaagcattgcaaacacaaaattctgtaagcattacctggtttggcctttatgagcaccaaatgtaaactctaataatagaagcaggggagagtcctgaattcaggagataacatgaatgtcaaaatgatttactgaaaataactgaagccgtacttattaatgagaatattttctacaccattgtgtacacatgtaaggaaatccaatgggtttcgttatcaacctctatttcctcctttctaaggaagtggtgaaaacctttaatccatgtggccaaggatatagatttgttccacttgggaccctcttctgtgtgagctgcattactctttttctatgaggtataatttgaggaaataagtttgcttcttatgtcaaggcaccaatatttgcttttgttcttccttcaaattcagttttaaagtagtaagtcttaattcctcagaagtgctttacttctgtatttttcaagttcttggttgaagctgtgcagtgctgtagctctctgcctttcttacctgagtattttgagatttttctgccaattaccagctccctgtgggatcaccttttttccatagaacatttttaaagtattaccatctttgtggaatatgtgctacaaaacgtcagctatagtgatggaaagcagcatttcttttgggcagaaagattttattttaccatttagaacaccttaaaatagatcttccattacacaaaatggatattttaacactttataggcaatttgattaaacttgcccctagcagctctgtggtatgattcatctttctatagtaaataatttggaagttttaccactatttagtttccaaaaacccacggaccagaagctttaatatccatagattccaattaaactcagtaataccagggttatataatcagttattgaattggtccaggtagactaacttttataacaaacaaccctaaaatatctgtggtattgggcaaacaaagcttatttttactgacaattcaatgtgggtaggcatgaggggtgatgtaggagtggggaggatgaattgtgatccacatagtcattcagggatccaggccttccatattgtggctcccttctcctctaagcctttgttatcctctgtattcagatggaggcttaatggaagaggcctaaaaatgactatttcagctcacaatcaattattcagaactgactgctatgtgcctaagaagaaaaggagaacatgaatattccttataactagcaatgtctcatagatatgagatgatttaacatcactgccccaaggacaaaaatagaacaatttttggtctattatacatttacattttttcttatttttaacattaaactttcattttatatttacatgtgaaagtgatgttataatgacaccactctgtggctaatacttgaaaatgattctattgtgtcttgctcagtaggactttatgtcattttcttaataagagtaatgaattcacacttagtcatccatatttccttgctcagtttttgtgatcaatggcaggaatttgtaagatgcttgaatggggtttcaggttccaagtgaaacaatagaggaaattgaacttacctgaccatgaatggcaacctctagttgaagggatgaaattaacagccatatttaaagaaataagaatataaaaatgacctatgagaacgtaatttcatagaaaccagggaatatatttttattttagctacagagtttaatgttttattgtttaataatttaagtgattgacaaagtttgaggatgtttgatcatatttgggcaatgcattgtattgctggttaagaaaaatgaatatgtgtttctgagtagtttgcttaacatttggcaagagatttaaagacaggataattcaaaagaaattttttcctcagcaacaggaaacttcataggtttatttagaaacaaggaaactgcaaattgcctgatttgaatacagacccttacttcaataatcagaaagcaagtacttcatgtctgcatatcagcactgttagatttggtcttccagagcacagccaagatgaatgatctgggagagcttcagaattgtgcttaaaactaggtttataactggggctttgacatgttttgatatacagaaatgaggcacaaggtttgagtccattgtctatcccaaaaccattattgataatgtactgtctaccaaccatccaaaagtatgtgtgtctgtatatgaaaggaaaggagtgttacctctgcaaaccatgtaggaaccacagaggaaaatacattaatagcatgaaacccaaataataaaaagggttttttttggtagtgcacagggattatttcacttaaaaattgtaaaattagtttgccttccaacatttcatgtaagtcatttagaataattcaagtgtaaagcagggacttcaatttttttaagttaccatatatcaagcactttctgtgtgtcaggctctgagatcagcagctattatgagtgatctcatttattactcaccatcttataagatagatgctactattatcccttctcctcctttatctattgttaccattaaacttgttcattcattaaatgtttaatggtcatctaacatacaccaaatactatgaaatgcaccgaggaaacactgaggtgagcagagaatatctgcaactaatataatgtcattttactacattatgtcattcattctgaataatccattatcaagagttttctgttcttccagatcaagggctttcctttctcaggctcttacacaaatgcttcctcctctggaacgctcttttctgtactcttctccaggcctccgtacctacgatcttaacctaaatatcacttcttcaaatagattttccttgatccaccagtctaacttaaattccttaagttaacctttttcatagtccttcttcattctcctttatcccactgaacacaatttataactgtacattcatgagtgtttttttaatgcctgtattctaaatttaactgtaatctccttgagggcaagagccatgccatttaggttttttatgtgcaaagtttaagggtttgtattttgttctaagtgcaaatagaagccatgtatctggctttttaacagttcagtgaaatgtcccaatttacattttaaaaagaccttttaagccccaagacctctcatcacgcactttactggataaaactgtgtggattcatgtgggaaagtcccagctaaactaagggaaacacaggagtggagcacggaggacttttagggcagtgaaactactcagtatagtactactatataatggtagattcatgacattaaaatatgaatttacctgaccatgaatgacatcctgtagaatgtacaacaccaagaatgaacgctaatatgaactacagaattgaatgtacagtattaaaagtgcaatctcatgtaaagtatggacctgggtgtcttgtaggttcatcaattgtaacaaatgtgttgtgggatgttgatagtgaggaaggctatgcatatgtggagataggaggcatatgagatatctccataccttctgctcaattttgcagtgaacctaaaactgctctaaaaacaataaaatctattaaaaaaaaaaaagagacctctgacagctgtgatactagatgccttggagtttttttcaatttagctttcttgtaaatcaatattttggttttgacttttaatattaatgaccatgaagtgtccatttttatacacatgcacgtatttgcatatcataatatatatagttacacaggacagataatcttcaatttacatgtgcgatttgaaaatatgttctccttttgtcctaaattaaacactagtatattatcagtcaaaacaaggttgcaataacagatgtcaggaattctacatatgttctacataaagtgttaactgctaataagagcaagtcaggaaaagagtattaaatgcaatatatcttgggctggcataattacggaagaaaaaaatatcaaagccataaaaatactttgatgttgtatgaaactcaggtgctagcaaatataatattgatggattatatggcttttcaaagtttttcattcacagttaaatccaaaccgaaacatcagtgcattaaggtcagaaaaatctggaagcttacatttatttattttttttttttgcaatgagcagagtattttaaggtatcctctaagtgagcagttcttttgtcattctgatccctgctccttgaactgatttcctgtttggagtctgaaccaaggattatttaaatttgatttgaaaaatgtcactaatgaaacatcagaaaagggggaaaaaggaaatgctgacgcgtgtgttgaataatatttatggcttatatttatgtatatgactcatatacttaaaagtaaattcaacccaagtgaaaaagaaaattgctactttatgtgtgactaaaaatttacataatatttgcagatacttataaaactctagactattcttcaagtttgtcatcgagaaagaaagtctacttaatacaaaatgacaaaccatttagtattaaaattgtgatagctgggacacggaataagaaagccatgcttaaatcaagcttcagttatgtcatgtcctgttaccaatttcacattacagattgaactgaaattgtataaattatgctcttgcatatgctaaacttgggaactactatttcatatttatattgcatttctcactgcattcagaaccctttctaataataactaattgatttttaccacagcaaagtattaaatccattatttagatgaacagatacacacagacaagtactacgttttccaatattttcagtgcagtctgagtcagtgactggaaatggcttctgattggaaaaaaggcttcggctttcttgttccctttggcatagtagtataagtggggacaagctaccgtcttgcaatatagaaacacattaacggtgtcaagaataagggggaaaagtacaaatatcttacttttcattggtactataaaaatacggagaattatttctaactgtatttatagaagacacaggtaaactggaatattaataaacaaaataaaactaaactaaactaaaaaaaaaaaaaactttgggccaggcacggtggctcacgcctgtaatcccagcactttgggaggccgaggcaggcggatcatgacgtcaggaaatcgagaccctcctggctaacacggtgaaaccccgtctctactaaaaatacaaaaaaattagccgggcatggtggcgggcgcctgtagtcccagctactcgggaggctgaggcaggagaatggtgtgaacccaggaggcggagcttgcagtgagccgagatggcgccactgcactctagcctgggcaacagagcgagactctgtctcaaaaaaaaaaaaaaaaaaaaaaaacctttggccctttggctgggcacggtggctcctgcctgtaatcccagcactttgggaagccgaggcgggtggatcacctaagaccaggagttcgaaaccagtctggccaacatggcaaaaccccgtctctactaaaaatacaaaaattagctgggtgcgggtgtgggcacctataatcccagcaacttgggaggctgaggcaggagaatcacttgaacccaggaggtggaggttgcagcgagccaagatcacatcattgcactccagcctgggcgacagcaagactctgtctcaaaaaaaaataaaaaaataaaaaaaaataaaaataacctctaaaaaattgacatatcacctcattccatggagctacgactctaaatatctaggcagggggatagagatgctgtcaaagttttgacaatagatattttgtattaaatgcatttactaattagtttcaccttgtactttttgaaggaagagtaaaaaaaaaaaaaacccacaaaacaattgacagattatttaatggaacataggactaatatttcttattatcacttatgggtgctcatttaatcatgttctttcctctttgttctctacccttcctgatttttaaatatacctcaataaaagatatgaggtaggagagaagggaaagtgctgaagaggaagaaagtgggtagaatgataagaaatacagtagaagaggcagaactgtctataagttaaagtttagctaaaacttatgtttaaaaaaatcacaatagatgcactagacagcctccaaatggccccaatgatccctacctgctagtattcacgcccttgtatagttcatttgcacactgcatatagctgacctgtaaaccaaaaggataccgtggaaatgatagtatctgtaactttcaccttgctttctctcagatcattcactctgggaaagccaatcaccatgtcataaagacactcaagcagccctatggaaaggtccatgaggtaagaaactcttgtgaataatagggaacagcagggaatggaggtctccagccaacagccatgatgatgagtgagccaccttggaagcggatcttgcaacaccagtccagccctcacatcacagcagtcctggcaaacatcttccctacaacctcatgagaggccccaagctagaatcactgtggaatttgtagcaaagccattcctgaatttctgaactaaattgtcagaaaaaaaaggtttatttttgttgtaaactgtttgtgttatataacaatcacgaattcttaaataggaacacacaagtaactgacagctgacttgttggataaagtcaatagtacactttgactttatataagcagtataagtgatactgcttatagaggaagagctttgagtcttaatgcagaaaagacatgagttctaaagcaggttatatgaatttctacctgtgtgacctcagttaattttcttaatttattggactgtagcttcttcatagataaaatgtgaataggaacttaatctacactgaaagatgtttgtgcaaatgaagtagaataatatatttaaatttcttagagaaatggctgatatattaaaagtgttcaattaatatcagccataacatcattatcatcattattattattcaaggctcagtggaatcctgccaagagttagagcattagacccaaagatcttttaacttttatcaatgagagaatcacatgatattatacaatgtttatatttgtttgaaaaatgttttatttatgacacaattttacttcataaaatttatgatggggccatcaaggtgactcacacttgtaatcccagcactttgggaggctgagtggagagaattgcgtgagcccccaggagtttgagactagtctgggcaacagaaagatcctgtctctacaaaaaaataaaaaattagccaagcatggtgttgcatgcacctgtagtcctagctacttgggaggctgaggcagaaaaatcacttgaactcaggagtttgaagctgcagtgagccataatcatgccactgaaatccagcctgggccacggagcaacaccctgtctcaaaataaaataaaataaaataaaataaaataaaataaaataaaataaaataaaataaattcgtaatggttccttattagaagataagggaactagaaaatataatagtaaagtatcattaagaaggaaaggacaaacttaggacaaactatggagaaataaaatgtcaactacacttcatatttggtataacacatatttggtacagatgtttattgcaatcctctgattaaatgtataagcccattacaatccagagacagtcagctataccagcagttctcaaacattttgttctcatgatccctttgcactcttgtaaattattaaagactctactccaaagagcttttgtttatgcagattatagctattgatatttatagtattagacattaaaactaaaaaactaaaagtatttatgaatgcattaaaacagttattattctattgtgctaatataaataatatattttatgaaaatttaaaaagctatttttcaaaacatatttgaaaagagtgacactgttttctgaatctctttaatgtctgggttaataggagtcacctgtattctcacatctatttttttcattcagtctgttgcaatatcacatgtcatatagcccctggaaaagtccactgtctactcatgacagaatgacagtgaaaagggcaaacaactttttatttgtattattattagtattactggctagttacctgcactattctgggagttgagtagtaaaaagcctcaatggctcttcctcattagtcttatttttgcccttaaggcactgagggtactcctggagcctgaaaattttccaaatgagtattgcatatgcttctatagaaaataaaatataaattacttcatcaataagtgaatcctaactataaacatccattgaaaaataatggtaataatagctaaccttattggataccgtgcttcaggtatcacactaaggcctttgaacatttcatctcatcttatctttacaacagatgaagaaacttaggcttagaagtaacttattggagcttacgcagatagtagatgctagtgccttgccccagacttaggtctggctgacttcgatactccttaagctactgactattgtggtttatactctaaggaataaaaaaagaggcacatagtttcgggtcttgagctgttaatgatcgactaaaaagttatgaaaaacacccacaaaataatagaaaactgatttaagtgatgtggttaggtagaatttatggtttaaacaagtgtttaaaggtttctgggaatagttcagtaggtagtaagctggagccctggtggatattttcaaggagaaggaccagccttcagctgtatttttatttatttactttttaatttattattttttttgagacagagtctcgctctgtcacccaggctggagtgcagtggcatgatctcggctcactgcaacttccacctcccaagttcaagcaattctcctgcctcagcctcccaagtagctgggactacaggtgcccgccaccacgcctggctaattttttgtatttttagtagagacggggttttaccatgttagccaggatggtctcgatctcttgacctcgtgatccgcccgcctcggcctcccagcatgctgggattacaggcgtgagccactgcgcccagcctcagctgtattttcatggcctagaataattaaaaataatgacggaaagataagcaaaaacaaaggaacagaatgtgaaaattcagtgaagtagaaaaaagcacagcacaagggatacactgaggaaacgcacttcacggaaatgaagggttcatgtggtgagttaaggaggattaattcaaatagggtgaaccacacagtcctttgctattggtgggggagatatgggagcaccccacttccacatcagcagaggcagccctgccactgtggaggtagctcacccaggtaggggtgcaggagccatgatgtgataaagctacatgaccctaacttttaattagcaacacgctggcatctttttctcagtccacaaacttaatttctgtcaggaacacagtcactgcctacagtcaattaaacatggcccagattctttcatgttctaaggagtaatatttctccattgtgaatacctgccttaaatagattaagtataacttaacattgatggtgaaaatacaacaatttgtcttcgtttgcaagtggtgtggatggtgtggaagggatttcagactatggacttgcaatataacactggatctggtcacatcactgactccagttagtcgtgaactctttaggatgatacagttcatacaaactatacactccacaaatgaagtgccactggatagacatctcagtactttatagatgatcggtttcaagattacagttgattaacacagagaatacaatggtggatggaatgcttcatctctactgtcaagtgtgcttccatgtggagggccacccaggagcctagcattatttcctcgggagaaaagtgactaatgggacagaggatctggaaagagattatgtgtatgtgcaatgaaagcccttccttgtgtgtcttggaactacccacaggaaactggttctgctgttggtgagtctatttaattctggtactcagtataaggaagcccacttacctacagatgtgagccatattttccagtgtcagctttatctgtaatgaaggtgatattttggtttcccagttgccttactgttttttttttcctattactaaattttttcagattgtgggcacagaaaatcgatgttatttattgaggtctctaaaggcttcaaaaatatattgatggtttttttaaaagaaggaaacagcgtgtgaataaagtaacaacaatttccagaataatcatgtacatttggctctaggatacttgacttaaacagattgtttggcataatgtcagaaatatgattttcaatctaaaaagtaagtaattgcctgagattttggaaatggaactatgaaaacaattggtaaagcaattcctaaatccttttaattacttcaagtttcttgtgaaattcacagttttatttgaaatctctcagctcaagtacattactaaaaaaatataattatgtaggttttcctacagttttccaagaaccatagaaatgttgaaagatatgtaagaaacatctttaggtcacatggaaggtaactgtgtttttcttttttaggaaaggctggttaatgaaattggtatattgttttcctgataagttatagattttttttttatataactattccaagtattggtgtttagaggtttcaagttcttttaaactgttggcagcatttctgagggaggtcaattaaaaagtatccaggaagggatattattttgctgatcatattcactcttggagaagaaacaccaccaaacttctctactcgaaagaatctagaatcaatacctatgtattaggttaaaaattacaattacaacaaattcacttgccaaagtataatcttataaagacttgctcagttattatcaggccagattttatcaggtgagttgtttcattaatataaacagagtcctcagattatgagaatacaatttaatatattagtgcattggtaggaaatattaacagtgatagctgaactcttttttgttttcccaagaaatatttaactctgaattatgagttttgcaaacatcaaaatggtactagaatgggaaaattggactagaggttcttttttctctttatgcctctagataatgacaacatgactcccaatacaattttagtcctggctttttcttattaaaaaacaaactcacttatttctctaccaaaatgtgaagaattgtctgtttctttctatgaactaaactcatagtaatgtcatgtaaaaataagggagtgaaaaataaataattatttcttaataaattatagacatgctggtaataataactgacatgagctttaggaataatgagtcattatttcttctaaaacttatttcaaattataagatataaacatatatggcaacttttaaacaaactttttatttttgatggatgtaggcaataaattgaaatcttgtagtactttgttttataggatttatccttgctatcaattaatgagctgaaaatccataattccatagcatttagagtctggttgttttaaaaattaatataaagtattagtaatctggaagaattttccaataagaaaagcaaactgattatgtcttcaggttttatagaaaattgagtaaattttatctgattttaaattaccaatacactgaatttattctgctatacaaataaatatgctgtttgctgttaatgatttggagaaaaagtaacttttgtattttaatttataacacttagaggacctaagaagatgctgatagagctagaaagtgacaaaaagtttgtaacataaatgaataaactcttaaattatgtgattgatgtgtatattaatatatataataattaaatgatttttgaattttatccggaatctagcaattcaagcaaattttaataatgaatatgaatatacatttttcttagaatttgggaaaaaatcatatattcttattctttataaaggtcatttattttccacattactaagattaaaaacaaattttcgccttcattttccgcacataaggtgttttcattatctagcttcaattattaacatgcaaacacaaaaggaagtgggcttaaagatttccctccacattaactagctgcaaagtttagagaaggccaaatttggcccatggcctgtgtttgtgtatcctctgagctggaagatatatctttaaagagtggtgtggtaggctgaataatgtcccctcctcaaagatatccatgtcctaaacctcagaacctgtgtatctattgcctcacatggcaaaagagactgtgcagatatgattaaactaaagatgctgggatgagggaagtattctggattacctggttgggttgaatctggtgacatgaattcttaaaagtggagaacctgagaacctgtcctggctatggtcagagggagatgggagaatggaggcagggatgaggaaatgtaaccttgctgggtttgacaatagtggggacaccataagccagggaacatgggcagcctcaagaatccgggaaaggcgaggaaatagattttctcccagatcccctagaaaggaatgctgtcctgatgacaacttgattttagtccaatgaaacccatgtcacacctctaaactacagacctgtaagataaaaaaattatgtttttaagctaattaatttgtgattatttgttacagcagcagtaaaaaactaatacaggttgtaaaaaatttaaaaaaagaatatgtggtagaaactacatgtagcctgcaaaatctaaaatatttattatctacacttttacaaatcctagttcagaggttgaagcttcttagcctggagttttcagacacagaatcacaatgcacacgtcttctggcatatttagcaggtatctcttgaaataatccaaacataacttaaaaccagcccaatatggtagcatgtgattattagatccatgcggtgtgctgggacaacattttacagttatctacctacatatatgtatgtatgtgtgtgtgtgtgtgtgtgtgtgtgtgtacatatatatatatttgccgatagattggaatttattgcagaataatactggaatacttgatgctttcaatatagtgattgttctagctctattctactaggcattgttggtaaagaatcatatgatgacaatgaagtaaaactctagtaataaatccagtatgaatatcatatcttttaactaggttgaaatgggactgatgagcccattgcttggatgtggttttaggaacaaatcatgctagagaaaatgtgtaacagttatccaacctgaccatttcatgacttccagcagaatacttccatcatcaagaattgaaacacatatgagagctcaccataaaaatacaggctagaggttctggttctggataagacacagtaggcacgtccaccctgtctttgaatgcagctatacaacttagacagaatacatgaaacaactctttgagaactctcaaaagtaaacagtggcagtcccagatggtttcacgggcaaattctctcaaatattttagaaaaaataacacaaatttacccaaactattccagaaagtacaataggaaggaacactttcattcttattttatgaggcccaaattaacattataacaaagtcatagttcaagaaaaccacagaccagtatccctcattaatatagatgtgaaaatcttttgtataatattatcaaataaatcagtaataaagaaaaagaatattctactgcaatcaagtgagggttaagctgggaatgtaagactagttcaatatttgagaatctattaatgttaccacaacattaacagtctaatatatgagataactgatgcagtagaaaatattcaactgtactcaatttcaatttatgagcaaaactatcagcaggggccgggcgcgatggctcacgcctgtaatcccaacactttgggaggccgagacgggcggatcacgaggtcaggagatcgagaccatcctggctagcacagtgaaacaccgtctctactagaaatgcaaaaaaattggccaggcgtggtggcgggcgcctgtggtcccagccactcgggaggctgaggcaggagaatggcgtgaacccgggaggcagagcttgcagtgagctgagatcgcgccactgaactccagcctgggtgacagagtgagattctgtctcaaaaaaaaaaaaaaaaaaacacaaaaagcaacaaaaaactatcagcaggaactgaaggaatagaaggaatagaaagtcactacctcaactaataaaaacatgcgtacaacacctacagctaacaagatactttatagtgaaaaactgtttccttcctaaggcttgaaatgagacaagaatgtttgtgctaaccccttctattccacattacaccagaagacatggctggtgcaataaatcaagaaaatgaaatcaataagttttctccatttttggatgttattgtctttataaaaatattaagagagagatatataaaaatcaataaaaaagccaacttgtagatctaataagtgagtttggtaatgtcataggatacgaggctgtggtggaaaggcactcccatgatcccacctcctggagtttatgcctttgtgttttatctgtgtcatatttgggggtgctgtcactatgacttgtgattcatcaacattgtaaattatagcactacagcactatatgttcacattgtaggaactagaaaaaaataaatataatagcggtataatctgtatgttcactgacattctgacacttggtttagaagatagtctacacccgtatctaccacttgctaactgagtaatttaggataagccttctgagcttcagttcttttaaccagtaaaataaaaatactaatgcctcaacttgtctacctcagaaagtgacttaaaggtgaactgagtaaatttacgtgaattacattaaattgtagaatattattcttattttttgatacaaaatgaaatatacaattttatgtctttgtgtgtgtgtgtgtgcacaaaccctggtgaaacttaaggatgcttttaaccaaatctcttgaataacacatagcttatcttacctctcatggaattttccatttaattttctattattattatttgagtcagggtctcactctgtctcccaggatgaagtgcagtgctgcaatcatggctcactgcagcctcaacctcctgggctcaaatgatcttcctgcttcagcctcctgattagctgtgataacaggtgcatgccatcacaccaggctctttttgtttgtttgtttttagtagagatggagtctcactttgttgcacaggctggtcgtgaagtcctggcttcaagcaatcttcctacttcagcatcctaaactactaagattacaggtgagagccaccacacccagcctgattttctatcattattgaacatggtttggttgcttatttctatatatatatgtcccaatgatcagatattcagtctcccacatttccaaaatatctatggctaaatggcatgaaaaaagctgtaagtagagatttagatggtcaatatttttgcacttcaaggagctgctcatctgcatatatatcactcaggggtagttttaatgcagcaagggtagtcagccaggtggaactactggaaagtgattatctaatgtgaaaggattttaaaatcattttctgctcatcctagggaggtgtgtttgatgataccatggcaaataagctggatttaaagagtaactttactgagcagaaactgagagttaatggaaagaactgagaactcagagactaacattaggattaaagatttatttctaattggcttttcaccaccatataggctatctcatttcattgcactttgcttattgtacttttttttttacccaaattgaaggtttgtggcaacttttcatgaagcaagtctattggtaccattttcccaacagcatgtgctttcttcatttctctgtgtcacgtttggtaattcttgcaatatttcaaactttttcattatgattatatttgtcacggtgatctgtgatcagtgagttttgatgttactattgtaattgttttggggcatcacgaatcttgcttaagacagcaaaattaatcaagaaatgtatatattcttactgctccaccaaatagctgttctgtctctctccctctctttgtgtgtctttattctctaagacttaacaatattgaagtcaggccaattaataaccttacaatggctgcaaagtattcaagttaaagggagagttgcatgtccttcagtttaaatcagaagctagaaatgattaagcttagtgaggaaggcatgttgaaagacaagataagctgaactgcaggcttcttgcaccacatagttagccaagttgtgaatgcaaaggaaaaattcttgaaggaaattaaaagtgctactcgagtgaacacagaagtgataagaaagcaaaacaccttaagtgccaatatggtaaaagtttgagttgtctggatagaagattccaccagctacatttgctgaaatcaaagcctaatccagagcaaaactctaactctcttcaattctatgaaggttaaaagaggtgaggaagttgcagaaaagtgtgaagctagcaggggtttgttaatgagatttaagaaaagaagccaactttataacatacaaattcaaggtaaagcaccaagtgccgatgtaaagctgtagcaagttactcaagtgatctagctaaaataattgatgaaagtggctacactaaacaacagatttataaagtagatgaaacagccttctatttgaagaagatgccatgtaatactttcatagctagaaaggataagtctatgcctagcttcaaagcttaaagacagaatgactctcttattaagggctaatccagctggtgactttaagttgaagtcaattttcacttaccattctgaaaatcctaggacccttaaaaattacatgacatttactctgcctatactctaaaaatgagacaacaaagcctggatgacagcacatctttttacaacatgggttactgaatattttaagcccactgttgagaactactgcttagaaaaaaaaaagattcctttcaaaatgttactgctcattgacaatgcacttggtcacccaagaactctgttggagatgtacaaggagattaaagttgttttcatgcctgccaagacaatatccattctgtagcccatggatcaaggaataattttgactgtcacattttattatttaagaaatacatttcataaggctataggtgccatagatagggattcctctgatggacctgggcaaagtaaaattgaaaatattctggaaaggattcaccattaagaacattcatgattcatgggaggaggtgaaaacagtgacattaataggaatttggataaattgaatccaaccgtcatggatgacttttaggggttcaagatttcagtggaggaggtcactgcagatatggtggaaatatcaagcaaggtacaattagaagcagagcctgatgatgtgagtgaattgctacaaactcatgacaaaacttgaggatgagtagttgcaagcaaagaaagtagtttctttcagagatggaatctacttctggtgaagatgctgtcaacattatttatatgacaacaaaggatctagaatattacatcaacttaatcgacaaagcaatggcagggtttgaaaggattgacttcagtttcgaaagaagttccactgtgggtaaaatgcaatcaaacagcatcacatgctagagagaaatctgttgtgaaagaaagagttaatccatgtggcaaacttcgtcattttcttgttttaaaaaattgtcactcccatcccaaacttcagcaacaccactctgatcagttagcagccatccacactgaggcaagaacccccattggcaaccagattatgactctgaaagctcagatgatgtttagcattttttagcaataaagtatgtttaacatatgtacattttttagacataatgcaatttcacacttaagagactacagtatagtgtaaacttttttttttttttagctggagttgtattctgtagcccaggttggagtgctgtggtgcgatcttggcttactgcaacctctgcctcctgggttcaagcgattctcctgcctcagcctcccaagtagctaggattacaggcatgcaccaccatgcccggctatttctttgtatttttagtagagacggggtctcaccacgttggtcagcctggaaacataacttttatacatattgggaaaccaaaaaaattgtgtgactcattttattgacatattcattttactgcagtggtctggaactgaactcatattatctctgagttgtgcctgtatggtaaaattcagcaatgtgccagatccagttctattctaggactaaataaatctgcatagtttttatttttctgaaccatcattaatattggtgatgaaattaggaagaaacctgtggccaactctttgtgaagctttgtatttgaagtttattaatgagtcttggcatgtgttttaagtaccttatatataacaaagaacagaagcttctgtttgaaattttgttttagagactgaattccattaaacgtattccacagagggaggaaaggctgtctcattcttgagcctctatattctgttttttatttgagagctcagtaagggctacaactttaaatattcttatttctgagtatgaactgccaaacatggctgcctaagacatggctgaaataatttctacttatgctatttatgtgagtggatgagttaattgttgatgagtttaataaagtaattataaaattcattaatttatttcattttaatcctaatatattaccaaccttaatgctattttcctcatattacacaaattattcttgaagtaaggaaaaaagaagagaaactactttggtatgtgtgtacatccacattgttggtttagttgactgtcttagaatatggatgttccctcgttgggcaagataagatgacttcacctcatgtcttactacagagtgtgactttttaaaactctttgcttacctttctttcaatcaatcttatccttttgtagttatcatccccaaatgcaccttcttggaagttctgttactaaaaacttgagactgagaaattatgttttcatgacatatgaggggtactattacacagcttacatcaattctcagaacactacaaaacttaacttagtgtcaaatggttcagaatacatagaaaaataggtaaggcagctatggtaaaatgttcataatttttcaaatgagatatggttattcactttactgttctttcagtttttctatatatttgaaatattcataataaaagtgtggtgaaaaattcagctttagatctagccaagccaccagagacccacatacccagatcacattgctttgaactttttcaaaattgattttgtattttataaactgttggctgcatttattgtaggattatataaaatgatctcctacatcacaaagtgttcctttcataaggactcatgggagagatttcttacaggttgaaggatcaggaagcatctcttgtttttatgttttggacattgtgactcttgtatgtaaatttgtctccttcatggcttttgtggttcagaagtttaaagtcaaatttacaacctatccccagtacttggtgatgtcctaagggcatggaatttatatcttaacctttttctaggtttatcgggaaatatctcccattcccccatttctctcatgtatttatttttaaactattgggatttatgcatttttgttagacgtctcacatttttaaaaattgaaacagactaaaaataatttttaaagatttgtatgtgtacgtgtgtgtctgtattagagagagacagaggggaaaagagaagacaatgtgtatgtgtgtgtgtgcaaattggtttaagttatatgaacaatttctctacttcattttcatacataaatgatctaggacatacgtctctatcataaagatcttaaaatgttcctatactatttagttccattaacccatacatgaaagttttataatcatctaaaagagcacatactgaagatattatacaaaaaaatttaataggctttccagtaatgagaactgttagagtatttctaataaataaattaattaaatagctattgacatgaagcctggtggtctacaatctaataaagaagaatctgtgccatttcagtggccttatcatgagacacaatacatctatttagtagttttcagctaagtccatgtatgtgggcaggaagagtgaatcagataaatacagaggagaaagtttgatgtgacttggtcatcgattgttagtggggagtcaaaaacatcataagcttgaaaaaatggtgacattggaagaacagtaacatcactgaatatttagatttgctataaaaaagtcactttcagaaggggaaatgatgcatttatctttcaattctcattgggtataatggagctttaaaataggagattcattcaaggaactgaacttttaggtggcagaagtaattaggggagatacataaatatataattataatcataagaatgatgagttcttcaaggataacagcaggaaagcaaaggttgaatctcggaacaacagttacaaacctgaaagaacatttaaaatgaacaaacctgaaggaacggagagacatagtcataaattaaaaaagagaggagtgattttaaaatgaagttatgaaagtctctatgttattgtactagtaatttttattttccatttttcctgattttaaaaaagtggaataatacagtatgctctatcagagcattttaaaagaaaatgttaaaaactaatggaaatgtaaaattgaagtttgactcaaatgaataaaacaaagaataaagatgatatgctacttgaccaaagttttcccaaaattggtttctagaggcaattaaagtcaaagtatttcttctgttttcaatgatgaataggtcaaagtcaaagaaatattgatgacttgtttcagacaatgtgattaatttattttagaaattagcttatgtttaaaggatcaacacttcaatctatttattttatacttaggctacagaaataagaataatatagtaacttattgtgtttcttcaaaatttttttctaagaataaattaatataatttgataaatttttaattgggatacaacatgtcatttatttcataatagagagataatgtgccatttttcaattaagttttacacaaatgtgaacataatactaatcagacatggagaagtagtgctgaatgctgcaagcaaagatagtattagaaacagcatttgattagtaataagcagattttatgtgtggtatgtagctcctagctggacattttattcgagttgggtaactactccaaacctctgttttctctgttctaaaacagggagagtactatgagatatgttacgaagagtatccattcaatcatttaacaaatattcatacatgcctactatgtgccaggcactgttttaggcaattaagatagagtactaaaggaaacagccattgctttcaggggttgtctatttctctctctattgggagaaatagacaacaaataacaaaatgaacatgtaagtcaataacaggttgataagtatgggaacaaataaagcatagtaaggaatggagaatgaggggctattttagaaatggagtaaatgaaaacacacgttttaaatgcataacaaaactacagactatagaagcaagtatattgtatttactgaccattatagtcaaatttgaaatacctgacaacttttaatatttttaaaacaaatatttaaacatgtcatgtgaaaatagtatgtatatgattaaatttataaaactatttaaagtgtagtttaatataaataactctttttctatttttatttcatttcctctctctaatgtcaaacagttattctgcctattgggaatttgacttctattcatttagaataaaactaatcaaatatatcccaggtgtgttattctcattttaaaatatttaaccttttaaagtgttcatctgacaatgatagatttgggttagatttttttcataaaagaaaggcaaagaaaattctgtaggcaatgtcattacctttatctgaatttggagtattgaacagttcagatggaggatgaaagagaatcatctagtttgacaatcaaaatatacattttaagttggctgtatccacagatattcaattttacactgatgaatatgcaacatgggcagatattttcttaacagaactgaccatatattgaacagttggtttactattttattctatcctgactgtataacaaaagatttaaaaagatcgattcccatggttttgctttaatggaaatagactgagttataatcagaacaaagtttccatccatgatagtaaataaatggtctcagtgaaatgaagattcagaagcacttattttaataattttcataacgctagtcaaaggtatatacaaatatacagcagtaggatagtagtatcttctattggtatctttcaattttgttaacttttatgggaaattttggttgtactatggagagaataataatttaactcatctttggttcttttaagaattgtataaggtgcagcaattttactattaaattgtatattttcaatttgttttttgttattgctcttctaaactggattttgctcatgtgggtgttgtttgcttttttcttgccttccttcttttcttctctatcttcaatagttttgtttaacagttttaaaagacattttccaaagtttcacagacatatgctcaacatatataattaacttctttccagtagaaaaatacaatgacaatataagggtaggtatatactactaaaaagtttttccccacctactgcctgtttttttttaacaagacagcatgcctgaagtattcagtgaacaagaacaaaagctattaaaatcagagatcttatgtggaggaatgcaaatgctaagttttcttgtaactttgtaagtcaaataagttatgagtatacaatgcaagccactagaaagttagaagttcttggatagtatctgaattattttccaaatggagttattttcaactacaataaactatgggcattactcaagtcagtataaaatatttttactgtttgaataacttactgaagagccatgaacaacatatataatattagagcaaccaccattcctattttgaggacagtggagagcacggtcatttcacaaaatgtggctcattagttagaatttttagttcattttaagacttaaattgtaaggtaattttaaaaggttgtctgtcaacttaaaggatcttattttaaatagataagttcgtagtaggtagatccctaccttgtcattgcagagtggaactggtgtcccatgtgaaggatgatttgactgagatcaaaagctgtgggttgatagtctaaaaaaatcagtttgaaatacgacactgtcggccgggcgcggtggctcacgcctgtaatcccagcactttgggaggccgaggcgggtggatcacgaggtcaggagatcgagactatcctggctaacatggtgaaaccccacctctactaaaaatacaaaaaattagctgggcgtggtggcgggcgcctgtagtcccagctactggggaggctgaggcaggagaatggcgtgaacccgggaggcggagcttgcagtgagcccggatcgcgccactgcactccagcctgggtgacagcgagactccgtctcaaaaaaaaaaaaaaaaaaaaaagaaatacgacactgtctatttcagcagccagttaaacaaatcatttttaggtgataaagaagtagcatggtagatgaaaaggttaggtagaagaataagagctgtcaggtatcaagagaaaaagaaatatttgttgcttctaaaaggtaaaatttcagcatatgctaagaaaatgtgaaaaattttctagtggcaaataagcaatcaagtccaattggtgctttttccaaatattcattgatgttatctaataattacctagagttactggtattatcttctcattatcttctcttggatttcacatcacacacacacacacacacacacacaaaatgcattgtcaatactgctttaatacataaagactaagttcctattgaaatttctcagattagtctttttgttttccagtgattatgttagctaaaaggaataaatttaaaaatgtaatgtccaataaggtttaggcatttggttattgataaacacatttaaatgaaaacaaatgtaaagtgcctgctggatgttacatatctctcttaatgatgattgtgtaaataaatataaaacaacacaacaaattaactgaattcaacacacaaggtataatcaaagagaagataaaagtgatggagattcatgtgtgtttatagtagaatgatttataatcctctgggtatatactcagtaatgagattgctgggtcaaatggtatttctggttctagatccttgaggaatcgccacactgtcttccacagtggttgaactaatttatactcccaccaacagtgtaaaaggattcccatttctccatagcctcaccaacatctgttctttcctgactttttaatattcgccattctgactagcatgagatggtatctcactgtggttttgatttgcatttctctgatgatcagagatgatgagctttttttcatgtttgttggctgcataaatatcttcttttgagaagtttcagttcatatccttcacgcactttttgatggggttgttttttttctagtaaatttatttaagttccttgtagattctggatattagacctttgtcagatgagtagattgcaaacattttctcccattctgtaggttgcctgttcacactgctgttagtttcttttgctgagcagaagctctttagtttatttgcagcactatttacaacaacaaagacttggaaccaacccaagtgcccatcgatgatagactggataaagaaaatgtcgcatgtatacaccatagaatactatgcagccataaaaagaatgagatcatgtcctttgaagagacacggatgaaggtgaaagccatcattctcagcaaactaacacaggaacagaaaaccaaacaccgtatgttctcactcataagtgggagttgaataatgagaacacatggacacagggaggggaacaacatacaccagggcctgttggagggtggggggcaaagggagggagagcatttggacaaacacctaatgcatgctgaaacctagcatgcatctagggcttaaaacctagatgacaggtttataggtgcagcaaaccatcatggcacatgtatacctacgtaacaaacttgcacattctgcatatgtatcccagaacttaaagtaaaattaaaaagaaataaataaatacaagaaagaaggttagaggtcaaaaaacattcctccctttgggaagaaacttagttttagctcccaaattacaaaatgaactaccaaagtttatgcatttattttagcattataaatatatgttactagtttgacctcctttgcaattctagggtaagctaacagtgttttaattacaatagtgattttgtagtacgttttaataaaactgcagtgtttcatacatttctcatttgtgacatcattttaaggcactatttaatgggcactttattaaattgaaggattacaaaattagagctcatttttaagaataaaaaactagtttttttaaaaaaagtgatggatagtcaacctaaacccattttcttctttcactctttagctaagattcaatcttatgtgggaaagtgaaagtctcctcttctaactggctagatcctcatttaccttttctgaaaataatgcatgtaagcctgtcagtcaatatttactgaaggcctactatctgtaagcaatggtattggccactggtcaccttgtttcttctctaaccaactgaaaaattgagatgtctccaaccgatttgaaaatttatatccacacaataaactctgtgtggatgtttatagaagttttatttataataatccaaagctagaagtaatcaagatgcctctcaataggtaaatggataaacagaggtacaaccatacaatagaatattattcagtgataaaaagaaataagctttcttgctatgaaaacatatggatgagttttaagagcatattaataggccaggcacggtggctcacacctgtaatcccagcactttgggaggccgaggcgggcagatcacgaggtcaggaggtcgagaccatcctgcctaacacggtgaaaccctgtctccactaaaaatacaaaaaaaattagccaggtgtggtggcaggcgcctgtagtcccagctattcaggaggctgaggcaggagaacggcatgaacccgggaggcggagcttgcagtaagccgagatcgcgccactgcactcagcctaggcgacagagtgagactccgtctaaaaaaaaaaaaaaaaaaaaagagtatattaataagtaaaaaagaaaacagtgtaacaaagctacatactgtaggatcctaattttttgacattctggaaaaggcaaactataaatagtaaagcaatcattggtttccagagtttggtggtagtgggggcagtgatgaattggtgaagcacagacaaattttgtagtggtgaaactattacgcgtgatggtgtaatgttggatacatgacaatatgcatttgtcaaatatcatggaattctacagcacatagcatgaatcttaatttatgcaaattaaaaaattgtttaggaggtcaggagagttctaggatgaaatgtagaatgtgacaaaacatttaactgcattacaaaaaatatgaaacagcctcactgacggaggtgtgggaaaaggtgatgacctaagtgactgaaattgagtggagtctaggactaaaggcaatatagactaccgtgatactatctagttcgcgaaagtgtgcaggttacacacatacacacaactcctggaattgaacaattaaataaatgaattgcaaatagtaaaagccagatttctcactgttgaaatgagaggctacagacatgcaaggagaggaggctagagtaattgatgtggtgataggattagagacatcggtataaattcatgttagcttcatatagatacagatacatatagatacagatacatatagatacagcttcatatagatacattaaaatatttatagatgtttatatacacctaagtcagtgtacacacatctattttcttgctgtcacctagaaacaatactctattagcaagaagcctacctagggcacaaatattgggttctaataccattcttaataaaaggaaccaggactccttagggaaatgtattttttttcttgattatttttatttttttgagacagggtcttgctctgtcactaaggctgcagtgcagtagcatgatgatagctcactgcagcctcaaactcctggactcaagtaatcctcctgcctcagcctcctgaatagctaggactacaggtgcacaccaccattccatgttaattttgaattttttgtagaaacagggtcttgtatgttgcctaggctagtattgaactcctggacttaagcaatcctcccgccttgggttcctaatgtgctgggaatacatggcggctcaccatggtgcacccagcctctttaggaaactgtttaattctagaactctagaaacatataagatgagcacatttcatattgtcagaaaataaggaagtgctaaacatataaattcacacttacaatttgagcaacataaatataataatattgaaacacaaccaaaagtataaaataaatatccatgtgtttatgttgatataaataaatgattacattagaaataaataggggagaaaagaacaactatatacagaagaattcaaaataaattatgttggtatatcacccttgaggaggtgaagcacagctccccacctcttattttattttattttttgagacagagtctcactctttcacccaggctggagtgaagtggcatgatcttagctcactgcaacctccgcctcccaggttcaagtgattctcctgcctcagcctcccaagtagcttggactacaggcatgtgccaccatgcccggctaatttttgtatttttagtagagacagggtttcaccatgttggccaggctggtctggaacttctgacctcaagtgatccacccgccttggcctcccaaagtgctgggattacaggcataagccatcgtgcccagccttccccgcctcttaaatgagttgcatacagtagcctctttttaaaaggtacagtatggcaaaaggggtaatgagagtaacttaacagtggagaaaactaacaaacattacctcagttgtgtgatcaagtcagcatcaatactgataagccatgttgatagcatgtcttttggatctgatgtgatgaaaatgatgttttacttctatggacctttcttccccaacacacaattctaccctaaccatgaaacaaaacaaaaccaatcaaaacatcaaagaaatatcatctgagagacattctataaaatgcctaaccagtactcctccaaagtgcaagtcagcaaaaatctaaatatacatgatgactaaatgtaatatggtatcttggacaggatcctggaacagaaaaagaacattaagtaaaaactaaggaaatatgaataaagtgtggactttagttaatgttattgtatcaatattcgtccattaattatgattgatgtaccatatacttgtgatgtatgatgtaaataataaaagaaagtaggtgagtggtgtgtagaaactctctgtactatcttcgtaaattttctgtaaaactaaaattattctaaaataaaagatttattttttaaaaagtaatttcacacagccaagttgttataaacattctaaagtaatttctagtaacaatataaaattggttctttttaaaataagaattgatctgaccctttgaaacaaaagtatatcaggttcaaaaactgtctgtgcaactggagtaaattcactaactcttatgtcaactcagtaacattgaattcaaagggcaactgcataaatttaaaactttaaatttattaatctcaacaaagcttccttcatatttttgtgtattttgtgcagttacaagactgacatgatgtttttgatagcaattaaacctgcatattcaccttataaaaatgtacattatttgtatacattcatattatcaaaagcttcaatttgaatataaatttttattagtgtccatctaggttacaagatttttcttttctgtgaacttcaaatttatgttgtttatgtactttctgatactggtgagacaaggcaaaacatatgccttttttgtttttgtttatgaatatctggcaactatttctttttttcttgaaatttttgaattgaagttcatgatacagtaaatctttgtgaacctttttcatggctcaatcaaagattttttcatggctcaattaaagagcactggtaggatgcaaaatcagtatgtttattgtattctgtttctttgaacaattccataaactattgattattcatcaatttatatatgtatactaaatgattttaacaagtatatccctgacacttatcaaaaagcctgctatagataactcagtacaaatatttctggcatcatacagtgaaataaagccataagaaagacatcggtctcttgttttaaaattccaatctagagcatcaaccatcatgattgaaactactaaatttttcacatagagctgacattcttttttgacatttgaagattcaaaaatatatatccaaaagttcaattttttagttcacaaaattgatatttcttcataaattctgaagttctttttgagaagaatgtatccaaagtgttaactgggctatgtctctaatgttgtacgactcaactaaagctaaaaaataagcacttgtgatttttcaaattttggatttattgatatttggtgtttgttagaaagttcctatagactataggaaattgtttggtagcttgaattaaaatctttactttttgtaaaatatttcaaaatttgtttcttcataattttctattaacatttccataatcaaaataatttttcttttataactttcatcaaaatgggtttttgcttttggtgcaagattccaagcaattttatagcagttcaaagttacaagctcagaacttaaaaattatctaaaaatttttattggacatttaattcttacattgggcaactaacttcattgatcttttgctactgttgaaagaaaactatttatgaaaattcctatgtattttctgacaatgtctcttactcatgaccacttttttatctttaagaattgtttatacaacaaacagcttttccattttgctttgcttcaggaagtggtaattgccagtcatgattcattatgtaatatatcttatccaatctctttttttctttagtgttccccttgtagtactatcatctacatttccactccattctgcatccattctataattttgttttaaattttaaaatttgctcatattcacttttaaactagaaacacaatttaattgtattctggttaaaataatatgtattttagttttcctgtgattttcagttatctctaaaatcagggctgtctgcataaaatattcaaataaacacattacaatgaaaaaaaatgggagtgaggggtagcttggaacttagagtgtgattcaagaatgctaagtgaagaaaggattgccttctatgaggcagaaaagctcagaaaagggataaagagttaagggaatccctggattcctaagcaaaaaggggccaattggcaatctagctagccttgggctatggaaataagattcacacttcctcctgagacttgaatattacgtacacagcaaagtctcttgatatatgggatgaaggattcacccacatttcattgattttggggaagagtatggcagtctttagataaagggggactaagataggacatataaacttttcttctttttattagcataatgtacaatataacatttggttggaagtagaaacttgcatttcttatcaacattttttccccaaattcagagcaaggacataagtttggaagatatctcatcaatacaagcaaaactgtgatatgaagcccatacattatcagccacaccatagtttcattagtagattcatgccctattaggccccatccaatggctcatgtttttccactcttcaaaactcctccttccaagaataggttagatttccacatactattggtccctctgaatatgaaatgccttacatttttacaattttcatcctaaagattttcttctttgagtaagaatccaagtaattttacagcagttcagttataagctcagaactttaaaattatctttttttttttttgagacaaattctctctctgtcacccaggctggggtgcagtggcacaatctcagttcactgcagctcaagcaatctgcccaccttgtcctcccaaagtgcttggattacaggtgtaagcacccagccaaaaattattttaaaatgtttattagaggtttaattcttacatcaggcaactaacttcattgatcttgatttttcagaacaatgtaacagttactgatttgccccatttaacttctgtactttctacttctcccagcctccattgtttcaattagtatgttttaaaacattcacttcttttataaataaagttacatatcttttttcttctgaaaagttatatagtgaatttacatttcataccttcattgtacagcaagataaattgttctaattgatagaatgaggtcaagagagtaaaacactttaaacactctctgaaaagagagttataattttcatgtgaaatttatttatactggtggttattttcacaactgaactttaaaaggaagggtccatttggctgcatttgaattggtgacatttttaggctgtcattacctgcagaaagagcgaatcagtgtgtcaatatgaatgagtggtaagtgaccttttaaaatgtttttcagaataagggtttctttctttctcttgctattttttttaaataaaatatatctgaattagaaacatgatgaaccctaactaaagctgctcaaagtattctctgaagaaaaaaaaaagccaattattttctcttaaatattccttacagatagaaattctaagaattggtagttaaaatgtaaattatatttctgttttttgactactaagaaaggaaaataatactaatttttttttcattttgtattcaactaatattcattgaatacatgacatgtctaccatgcagtttttaaagtagggttggaaatacatgaatacataaaatccaatcctcctttataaggaaattttattttattggcggtgacaaaatgcatgaaaataattcagtacatagtaattgtaagggcgggtggaaataaaatagtttagggggccatctttcatttgtcccagcagatacactatgccattcttcacgctactctgttttcctgaaaatctggcccatatgaatgccagttataagcttcggcttctgttgagtttgaccgtcagggaggacctgcataatctcatgatacaagggggaactagaagagtaaaatgtaaggagacccctgaaactattgctacggaataaaagatgaaatgctcctgattattgtaaatacaaagtggcatgcaggattgtgtaaagacaatgccaggttggactgccagaacgagccaacagcatgtgatgtgcttccccctgcagagagcctatgaatggacgtgcagtcaggggggtttcacatcaccaagattcctatcccagaaaggcagatgttcatagctctgggaatggaatgtgacccttgtggagagcctataaaccgacgcatgaggggcacctgttcatatgtataagatagggctataaatgccctcatcttgccacggctcttctaggcctctttagggttaaggcatactgccttctgagaatttctggtctaaccggttgtctagcttcacatcatgtttctatggattgtttgtaaccagcttttgctacaactgttactgctgattaatatcttactaatcataggttatggaaagactgtgtttctgttttaaggctctgttagaaattactgatgcacacactatattgtaaattcttatctctgtatactgtacttctgcatacagatgttacattaaagaattacttcatccccatgtgaccatctcacctcataatcaaatgaccctaaatccctcactaaactatccctgccctcactaaacttaataataaatgctggtatatccagtgcattggaggcatcaagggaccagaaggcagtgacccccctggactcagctttcactatcttgtgtgtgtctattatttctcgacctgccaatctgcctgggaacaaagaaagagccccgctgtattgcgggctgttggccggatcctgcaacagtaaagttggagtacttaggggtatttagtctcctagctccctgcctttgacggcaaagtgggcttgggtgtgtccctgaaccaaaaggctcaatgcctgaccaggtgtctcctcacacagccctctctgttcatatcctcctaacttaactcttccattgttctctaaagcctaggggcttcagaagcagcgctgaagcaccccagggttctgtaatatcctttgttgttgtactataccctgcctaatatacaaatgggagagtgctacctgcttcctatccagtctgaaatggaagtttttgagaacaaagtgatcacttctagctgttaggaacaattttgttatctttgattatgtagtatataatggttagaatagaaaactgaaagttttttctatactccatagccagaaatcattttactaacgtgaaagtcattattatgtcccctatactttaaaattcagtttttggagatggagtctcactcttttgcccaagctagagtgcagtggtgtaatcatagctcattgcagccttgaactcttgtatatcccttattttaaacaaaaatttgaatattaaatttacagttctctggacaatatgggcatggcttcaactctatttttatcagagctttaaaaaacttgagatgtatttcatgtactgcaaaatttacccttttaaagtgtacaggtcagtgatttttaatatatttcacaagtttgggttaccataaccactatccaatttcagaacatcttcaccccgcaaaaagaaaccccacatttcttagccttctctctccaatcccgcatcctccttagttctatgcaactactaagccactttctgcctctatagagctacctttcctataaattttctataactgaaatcatatgatatgtggcttctttcacttagtgaaatgttttcaagttcatccatgtcatagcatgtatcagtttttcattcctttttattgccaaataatatttcattgtataaatataccatattgtatttattatcagttgatgcatttaggttgcttccactgtttgtccattttgagtaattctgcaaatgaacacatgcataaaagctttatgtataatgcttttgtttgtcttagatattgatatagtttgggtatttgtccccacccaaattgcatattgaaatgtaatccgcaatgttggaagtaggtcctggtgggaggtgttttggtcatggggtggatcccttatggcttggtgctgtacttgcaataatgaatgagtactcacgagatctgattgtgtaaaactgtgtagcacctcccctccccttgctcctgctttcaccgtgtgagatgcctgctccacttcaccttctggcatgcctgaaagctccctgaggcctcctcagaagctgagcagatgccagcaccatgcttgtacagcctgcagactgtgagccaattaaacctcttttattagaaatcacccagtcacaggtatttctttacagcagtgcaggagcagtctaatacaggtatatacccagaagtgaaattgctaggtcatatagtaactctatgtttaactttttgaaggactgccagattgttttccaaaatggctgtgccatttaccttcccaccagcaacgtacaaagtttccaatttctccaaatcctcacgaacatttattattgtctgtcttttttattatagccatcctagtgggtgttaagtggtgtcttgtggtttcttccattctttgaaatttatgaatataaagtaattacataattctataagagcagttaatcagcaacagatgtagcatgtaatatgtgaatatgatttggtttaggcagcctgcaagaacagaagatagaaataaatttgatcttatatatccaagaccttgaatcaaaaggaaaatattattctcccatagtcagagaaggtgggaatgcttccctgaggaagtgaatctcctatctgtgagaagcagatgaggttgcttagggtgctccaaaaccataaatgtgtaacaatgtgatcacaaacaaaactgacagggtttgccatatcattcctcactcccaggaaggagaaaatggacagggtttgctgtatcattcctcactcccaggaaggagacgttagcataagccagaaaggatggagggataaatgtggcaggaggaaaaagtgaagccatcttcttaatacatttatggttccattttatttatggaaataatttcctatgaccagaagacaaacgttggtctgagccatacagaggaaagcatagttatgttttctctctttcttagagacagttatgttggccgtgggtcagcttgcttatcctctattctactgtataatagacttccttctgcaatccgacagcacccacagatctttattttctcattgccttggctttgttgttttctaataaatgatcacaacatggcaaaaggaacagtaatgggtattcccgtagaattttctttctttgtgcagccaccatattagcagacgtcagcatatttttaatagatgtgttggtaactaactcctataacgtcacaatgatacaatactcagaagcaggataaatttccaacatgatgcaaatgaattccattttctcacctccacctttcttacaaaactgaagcacatggaagtcaataaatatatctaaagtcaggagacaaggtagttcaaaaagttggacttgaactgggtttttaaactcttagtccaatgtttttcttgtacaacagactgcatatgcattatggcacagtatcagatcttttcaaatattaatatcaatattatttttcacctctatagcatagctagcttaatattggtttcttaaaatgtgagtttttatttttaatttttaccttgagttactgtcaatgcttattgatagagagtactgagtagcgaagttcagattcataaaaattaaaagaataatttacataatcataaagctattttaatatacatctttccatttattagtgatagcttaacttcttttggagaaatcaccatttgttttacaacttacttatttcaatttaaataaataaatgaagagatttctactaataaatgtatcaaagtgatgattttggcattttctagactcctagtgccaaagcacaggtacagacctgacagtgtccacattaccagtcccctgaatcatttaccttcagatatttaaggtgctgaaccctgtatgccgatgcccataaactcagcttttctagcttatcacaagcactgtaagtacaagtgattttttcttagaaattatactcagcctcagctgttcgtactttgtgtttacataggtgtctaggtagttatttattcatgcaggtaataataactagaattcttgctgtggtgaattataatttatcatagaccttcacataaacaaattcatttcgtttttcaaaatgcctgtctaaggtggacattattgttacttctgttttttatagttgaaggccaaattaattatgtgatcagcctaaacagcagagtcaagatgtgggcctcagccttgttaactcaaaattctctggaaaaatctctctgctgtaccctcagccgcccaagtgccaatgaaacacatcttactaattctgtacttcatgtttttgtacattgattctagttcaaaaatagttttttcaaagaagtcgtctttaagcctatcctactctagcttcttgccatgatatatgcactcaatatttatgcttggtttgattaaatcatttttcatgtgttgacatgctctttataaattttcttatgttaattagatgtattgctttacagacataaagaaattttccatttttattatggaagatagaacgaaaatagttggtcattttggtgactacaatagcaagcttatttggagacaagttctccatggtattcatcaggtaattaatttcttttaaaaaggaactaaccagtatatagcatatgtaatattctaacaaaaagcaacactgaaagattttattgtaaaaattaaatatttcttaaaagctttggcagctggttgggtaatattttaaatgtaaaacgcacacttaaattttatcaatggatttaagttacaaaggaaattccaactacagttttaatggaactgaattttatgattttaggaatgcttaattttgtgttactacctctttttattcgtactagaagcattaccaaactatgttatttgaaacctgcagtatgttccatttgaggtttttcactagcaaagtggcttttggaaacatcacctagatgagaattcaacatctcaataacagccattgaaaaacaactgcttcagagtcctagccttttagctgggtactgtagattgtttgaaacctgcacaatcactcaggtctctttgacattgtagattgactctcctcatgcatctttaatgcatccacttttttctgaaaactgctcggaaagcttgacctttgagatataaatgagtaacattcttataggaacttgttccaaataatggtctatgctgggtctagtcaattagactaacacgtcaacctttatcttaaatatctgcttagtcgctgtctttgtagatgtttttttcatgaatgtaaatcctaaaagacagatataaatcttgaaaacttgaacacggcatgtatttgaaggttgccactggccttcatcacagaatcatctaatcaggttcaggttaacttggaggaagaatgctggtgaaatagagcaattgatcatacatatcactgttacaccaactggcttgtcaaatctaccaattcatttatcctattccatttttttctctccaaaatagtatacctaaaaattaattaaataaaagcattatgtgtgtgagtgtgtgtgtgtgtgtgtgtgtgtgtgtcagatttctaaattatggaaactatattagtgatgtgtactgtcagaataataggaaattcttatggccaaacgtttcactgtctatatttgtatgtacaaatatatttttgatactgttcatgaacacctcaaatatacattgaatatggaatatttttcttttttggatattaatccagaaaggctacaattaaaataataacagaaagacatacagagtcacaaaactaatagaatcaattaaatagttacagaatacacagactatcaaagtaaaatgtaattgtttccctgttaagcaaataaaacaataactaagcaagagtgatttatataggagaatcagattccaagtgttataacacttaatgtaaacaccatgagatactctagtatttaatgattccaactatattgttagcacctctcaacttatgtgcatatgtttgaaagtcatccagctttctttttgtacaaagttgtgaatgaaagtaagggatgaaagggaataagacagcatagggaagaagaaagggatttagtgagggtggaatgggaggaaagaatgggaaggagtgatggaaagagaagcataaaaagaaagagagtaaaggtagagacttacaaatttataggcatatgaggcataggatatgattttctgatacccatgatttctctaaacttcagaatttaaatgcaaatgattaacataaaaatgtagaatagctggaggtacatttctaacatggacttagtgaaaacatgctgggtgggcccagctattttagtgcattcaacttaagtcaaattgtgttttctttaaaatctttgcgatgctaaaaataataaccatgtttactaatgtgtaaatttatcaaaatggtcaaataattaaggacttaatgctacatattaatcccttttcacactgctataaagaactttctggcactgggtaatttataaaagaaagaggtctaattgactcagttcttcatggctggggaggcctcaggaaacttaaatcatgacaaaaggggaagcaggcaccctcttcacaagatggcaggagagagaagaacaaaggaggaacttccaaatacttccaaaaccatcagatctcgtgagaactcacacactatcaggagaacagcctgggggaaattgcctcccatggggattacaattcaagatgagatttgggtagggacacagagccaaaccatatcatgttatactacagtttatagtcaactaaaatctatgaaccaattaactgttcactcataatgaaaatggaagaatcaaaaataccctaaaaagtctggtcttttcttagaaactctgtagtgctctagtttatgccataagttagtttatgccataattgtcaaagatgtcattaactctacacacagggacacttttcttttattgctgccataattttataggtcagctaccgtcttttatttccaaaataaactgatacattttcaaaagtgtaattagtaatttcaagtagtaattttgtttagttcacttaatttttttttaaatttaggtgcttatagcataaagtatacattatcaattcaacatttggctccccaatgtttaccaagtgggaattaccaaacataaattagtctaagatacctttcaacatacagcattctgatagaactaaatggtcctacatatttgtgctgttttggaactttagttagttaaatctatataattggttttttaaaattgctttcaaaggaatactcatacaatacgttgagtatgatcaagccatgtagagttgcttatgttttagtgcatatcagagtctcctggaatgcttgttaaaacacagattcctagagcccagcctcagactgtaacttcataaagtctgtggtgcgcctgtgaatgggactttctaacaagatcccaggtgatactgatgctgccaacctgctgaccacactttatgtggagtccagagtatgattcaatctatttagagaaatgttttcagctgctatctagtttattctttagttgaggagcaaatagtgagatgctgcatctgaaaataaaccaggacagtttctcctttttgtcttgggggctctgtaatttgtaggtgaatgttaccaacatcaaagagctgaggcttgtcagcattacttagtgggaaagaatatgcgatttgcaaacagacaagagtttaaatctcagctttaacatttattagctgtgtacccttgggcaaattattaaaactttctgaatctcctttgttttttcatttgtatggtagaaataataagacccatgtgaaaatgttatcataaacatttaagaaattaactgacgtagatacattatgaaagctataaagcacttaacccatatcctttgagacttcgttccattcgttatgccctctatttctcctacattttcaacttctccatcttcactggctctggctctatgccagaaagcatactttgtcctccattttgaaaatagttctctatgacaccatgtaacggctgacttctcccccaagtctgtctcataagtaacctttgaaaaattacctacactcactgtctctagttccacattgcttagtcatacactgaagtactatagctgaaattctgcctccaccactaaaatgaagttgccttcataatgatcacattgactttgtaagtgttaaattaatccttatcacatgtgatgtctcccaaacatgtgacccctggtcctaagttggggtggcatggctcaccaatcacttgccttggaacttcctcgcaatctcagctcaagcaacactgctttcttggtttctcttttcctcactctttgctggcatttctttacatcttgcctctattttccctcagtctgcacactgtttctgggagatctcatccttacacatgccttatgcatccctctcatccttacacatgcctcacacatcccctcttgtactttgacaactcctcaaatctacacatccaattcaaacttctctcctaagttgcagatccacccaacttccaactgaatatctaactgatgcctaacgctaaattacacaaaactaaacattatgacatacacagaatatgctctcatattttctgcatattcacaaaggtgaatagaaattccatgctccaggtttaaatggttatccgggagaattcctgttgtgtggaagatgctttgccctttcttcatctggaaatcatttttccatcctttaggtcacagcttaaacatgattttcccaggaatttttctctgaccacccaaggagcttctactgtatttccttagagccctgcacctcacctatggcagagttccctggacattgcccccattacagtgtaagtcacatggagtaagagtccaaactatcagtacatagatgagcatacggcatatcataggtgcttaaaaatgttgtttgactcccttttccaaaatcattcaggcattcaaccagtaataataatgccattgttcttctgggtagcaggtaagcagaacaaagtgcctgcatcccgtgtcagagaaagataataaacaagttaagacgaacaagtaataaataatcacaaaatttcagttactatgaaagagaaagtattgcactgaaagaacctcctgtaaggagagatgtggggaagtccagaaagtgaaggaaactatagcctggggcaaggctgaagaattaagccaagtccactccttgaagagacaggctgtcaaatacaaatacttttctaaattgtatccaataagtttcaatgttctagtaattgttcaggaaagagtctcacccttgtatttttttcttcagtcatctgaattctatatggcaatgtatttttagttgtactttaataatacctgtataatttctaaaaattaacttttacatattaatattttgctagtaatccgtttgtttatatcatttttaacaaagcaaagagccttgaagatatagccatgttttttagtaaatacatcagaatagtctgtcaatataatttacatataaaatctctagtagatgtataataaattagatttatgtgatcactttaatgaagaaaaaaatcctatatgcttatggtgtcaatgagaaactgaagtacaaaaatgttattttccaaaagtaatttatttcagaataaattttcattaaacaatattgagtatcaaaatctaaatttcatttttattgtaagtagtacaataactttaattagtaccagctgtaatctaagtatcactttttttttaactttgctgtaaaatttacaatataggtttatcttacacatgagtatcaacttcagaataggacatttctaaattgcaagtccaaaaaaagctttaaatatttaatgactgttgcctatttaagtcatctaagttaatgaaatgattgatggtttaaaataggcaatttgtatcaggatttctcaattttggtacattttgggctttctaactgcttgctgtaggagtcttgtgtgttataggatattgagctacgtccctggcctctatccaccagatattgtttgcaactcccaggcccccaagttgtgacaaccaaatgtctggttgacaactacatgtggatgtgtttcagcaacttgaggcttcagttttgaaatatagcatttcattctttcttaaacaattggatgtccctattttatgccattagtatccagtacaatccttaatgagatctgttgtctttatgtgtctgaacactgaagttggttgattctttttttgaaaatgactcaggttttgttgaattcactggttgtctgtcttgataacagcatgacaaggacaatttttaaattattgtttttccttaattatatttataatttgtgattgtatgaaatttagaaaactaaataaagcataaaaaagcttccacaaataactacattttagcattttaaaatatttggcttgtctgcatatgttatttataaaattgggaaaatgctatatgcaattttgtgtttataggttgtagtcttctattagacttaatgtcatattttgtgcatttgcctgtgtcattaaatattcattgaaaacattaatttattgcctttttatatactataattaggagagatgatttattaacctacccttctcagagggtactttttctcattttttaaacgacaaaaatctaagagcattatgcaaatagtttaatacataatcatctaatgttcagtttttgagggttggctttcttatttctatgtaaaaaatgcagattttgaggcagctttccttacaattcatttttgattattttctttttggtctaatattgaccacagctatataaaaaataatatatatattatttatatatatatatttattatttctgtggcagaaaaatctgaaaggaaatctacacacagacacacattcacacgttgcctctaatttcagaatttttttttctgcatttacaggcaaaagagattggaaaaaagtttttctgtttcctagtcacaaattcttaaaaagtgaccaaaagagcaatagcttccctaatgaaatgatgagttagttacagtcttccaataattgtatatatactgaaaggtaatttgatctgcttttcacttaaaattagtgtacgagaatcatccatctatccactcctaggtatatacccaagaaaaataaaaacatatgtccacactattgcttgtatgtgaatgttcatagcatcattactcataatagtccaaaggtagaaacaactcaaatgactatcagctaatgaatggatacacaaatggggaatatccatacaatggagtattatttaactataaaagagaataaaaaaggacagagtactgatccatgctacaacatggatgaaccttaaaaatattatgttaagtgaaaccatattgcatgatttcatttgtatgaaatgtctggaataggcaaatccatagagacataaaatagacgagtggtttccaggagagggtggagggttggttggagagtgactgctaacaggagtggggtttctttgtggggaacagggggtgatgaaaatgttctggagtcagaaactgatggtagttatacaacactgcaaatatagtaaaacccactgaattgcacacttttaaagaagcagatttcatggcatatgaattgtatctcaataaaaataaacaaaaaaaatccatctattattaattttccaataaatacctgaggtggctatgctgaaagaagtagagaatcatattgatgccatctccaagaaaggagaaaactctagttgataaagaaactagaaatctatctctcagttcagaagaaaatattttaaaaactctctgagtcttcatttccaatgctttaaccaaaggagcttggtagattattcaaagtgcctatctataaatatctctagaagtaactgttccccctggaaacttgaggttttaaccacaaattaaagtctagcataaagttatatcaggagcatcaccttccattttctgaaagaatatatttctataaacactgtctctggggcaatcacatgaccattgtctttcaaatacagtatgaaagcaatagtgcaatatttccattttacaaatctattactttatcatctgctaatattattctggttactctgggtcagaatataaactgctctcccttgccaggatttatctccattttagtgaaagaatcaatagtagttctatcattttaataaattatgggggagagaaggtcagctctaaacacataacaaagcaattaatactcccctctcagttgaaggccttggatgatacgaagttatttcagtttctaaatcattgtaatgtattgttgaaaaattctcccaaggatttaaatgctgtgagaaaaaaggtaacagtataactttcaaaggatgcaaaaataaaacataaggcctattgctgtcaactaaccggtatgggaaaccactgtggatagctgaagaaaaatatcatattaatgtgaaatgtcaaagggaatggatagaaaaatctttgatcaacctgttgttaaacacagagtttgaacatctttccaaaccccattgctgaccttgtccttgactgattcctcacattgcaatgggtgctatacctacacaggaaaggactaatgagctatagcatttaagctgacatttaagaacagattgggtcagaggggagagtgacatcatttgcaggtgtacagtagggcaacgtgaaaaaggagatgtggaaagatatggaaaggcaacaaaatgtggcaaagatacttctggaaattttcaggtaaaaccgttggtagtatgagtgatatgaaatattactgaattgtttacaacaaatcttatttactattcagtactttttaggttttagaagtagtgagaaatgataatctttaatataatatgccattttgacaaggtaccatgatgtgtttacatttgtcatgctatgccccagtgaacatggggaagtaatgtcaatcagatttcaaaaagaaaaaaaaatgaagaaaaaacaagttctccattaaccgtacaatctggaagaaaagaattggagataagctggaaacaaatatgcctttttcaaagtggactaaatttagttatacttgcatctcatttcttaggcttaatacaccgcaatttttaacacactattcatgtgttctaatcatgtcagatgggtgggtatatagcaagtcttcatgagaaatatagaatgcaaacagtgtggctgtcttcacgctcagagttgcctgtactcttgactcccaatttatcagcttttaattgaaatagataatgtttattgctgtaggaatagtttatcttgtgaagataacattgatgttaccaagagaacaaggtaaaaagcacttcaccaatgactgggttcctagacgttcttctttgaagtgataatttcctaaaattcattcagcttatttatcctagcactactgtttattaaactgccatgtggaactgacgataactctgcaaaaacgaatcagttatttagatataatttacaagatggtctctcagcatttttctccagagtcaaaacacttgagtggtagggaatatttatatcagtaatagtggctcaggaaagtactgaaactctatgggatgaagtaaaactctttccaggtgcatatattaaaagcttttccttttattttcctggtaggggaagggtttacagagaagaggagcttagctagcctggaaaagctccccaggtggtccttatataggtcccaaccccaactttctcccttcttaatgattctcactttagaatactttgttaaaatagcacttctgctatttataattgacattcttatagacaaaagataataggtagttcaaaagttgttttaaaaagatatttatacaatggtaactctccttataattatctgcgttgaaaagaagaatcaaataataaaatcaaaagtaatttacaagacatctcataattaatatattcatttattgagtaacttccgtatgctagatgctattttacatattttaggaatacaaatatgcctcatacatggattctacttttgtagacattatagtttaagaagacagcttataaatgcacataaatgatcactccataaactaaaaaggctcgtggcttgcgaggggtactagtaaaataaaagtttagaagaggaagagactattagataataaagggttattttatagggcagaccttaattcatacatgtgtcaaaataatgttagtgtttttagatcttgtcaaagtgttcccaaattgaacccataataaggcaaagtatgtgaactgagccaatgataaatccatgtaatgtgaactgtttacaaatgattcgaggtacaaccatgaaattttattttgcatagtagagttaaaagatcttgtactggagataaatgtaagacattaaacatatctgtgatcttatctatctacatcacaaatgtcacctatttacaaaggcctttcctgatcactctatctaaaatggcaccctgtgtcattctctaatccttcttctcacttttcttcagtgcatacaggtataattttatttatttgtttgtttgtttgtttattgactgtctccctccagagaatctaagctccttgaaggcaggggattttgtgctttgttcactgttatgtcatcagtatctggcatatggtaagtatttaataagtattaactgaattactgaataacttgctaacttaccagcaaaatgaacacagactccagaatctcaaattatcaagcactaaaaatgatgtcatctaggtgatttcatccaatgtcacggctttaaatggaatctgtaactcccagataagtacctagagtcctgacctctccccctgaactctctctatttggcatctctacttggctgtctgaaaggcactccaagttctccaggtcaatgacagaaagtttgatttgccctttggggctcatcttcctctagcacgctccatcttcctctagagctctcctgagccactgccgtccacctagttgctcaagtcccaaagcatccttgattctcctcattccttcaccctccacatccaatacatcatctgcccagggacatcacaaatctatccacaatgttttccatctcagatgttcctatcctaaatcagctttatgtcttgatttattttgctctctttctatccttgccatcctttgagcctttctccacataacaaacaaatatacattttaaagacttaaattagatcatgttgttctctgaaaacctgaaagggactcaaccctgcacttagaataaaatcaaatctctgacatgatcaaaaaggctcttcatgacctacttctactgatctcctctcctacaatcctgtctccttgcaccctaaaattcaataacatgtatttctctccattctgtcaaccccaagcttagtccctctttaagacttctctgcctgctgtttcctctagtttcaaggctatttttctttgtcactactttttgacactaaggtctctgccaaaatatatcatcctagaagtcttcctcaccacctatgtaatgtcatcatccacgaccagccctgtttattctcttatctcttatcaccttatcaccaaatcacttatgtatttgtttgcccacatttaaatatagactccatgagaacaaagactcatttgtcttagaaatggcacaatgcttggctaatagtagaagctcattaaatatttattgaatcaatgaatgaactaaccaattaatcatcaaacaaatggttataaaacattgctttttatgcaaattccaaatttatttcaccttaaggatttagaaactctattctaatttagtgttattaatatttattgtaaacttcctacacataagagactgagataagatctgaatacgcaaatattgataaaacatggacttgactttttagacgcttactggctagctgaagaaatatcaaaacaatcacagtacctgagtacaacaatacaagtactcaggatgcagaaatagtagagaaaggagagtgagcaatatcttggatatggaatagcaaaaacaaaacaaacaaagcaaagccaaccaaccacccaaacaaaaatcctaccacattccagcagagagttggatacatacaatctaataattcaccagtgtactaagcaaatccactaagtaattccagcagagtgaatgccatgcagaaggtaacacatgaaggctgcagaagcaacacacgttccttttggatttggaatttaaagtataggaaataggggaaaaaaatggttagagtgaaaggcagcagggctagacctttgagaaaccaggtgtgtcatactagagagtttaaatgctgctgtgcaagagataaggaaaaggtgaagagatttcctcaaaacattctcaaacactagtcttatcaattgtgaaaatgaaaggaaacctctctaaagatgacgtttctgacacttaagattgatataatacttaataatgtctcagaaatgattttggggagtggtatatagacatggtgcttttattctttattttgttatttttccatagcaaggattaaaattctacctaagtaaatttttttctcatggaaatacaataatttctatataaaaattcagcactaaatacttcatcttgacttactcttaaactataagaaactttgcagattaccaaattaatatttatgtttagtgcctgacctggagtaggtaataaatagttgctgaatttaattactttccttgttttcccaactatacaataaattgtatagatgcttgtcctacattaatatttgttaatagatccatgaaaatttcaaattgaatggtaaatgtcactgcaaatgaagctgaataacagaactagcattacttgagtttttaggtgctgttttacaaatgataaaatagagacttacagaggttaagtatcttgcccaagatctgtcatccagcagtggatggagcaaaaagtcaaatgaaagcttcagtctaaagtccatgtttttaaactgctgctgtagtgcaaagtctctatttcagaaggagagtataacatcctgattacatataatagggatatacatcactaaaaagaaggcattaggaaacgatggcattattataattaaaagtgaatacacagtattaaactggtttgctccaagttttgctaaatttagcagctgacagctggctaactctgttgtgctgaggaagtggctatttcgtatccttttagtgatacacgttcccagtataaattcatctttcatggtggcctagatgttcttatccttacttccttgaaattttgagtttttcctggatactcctgtagtatcatcagacccatccctcaccctttccctcaggcactgtgcactggggaaagcaggactttgctttgagggagtccctgtctctgacttatttgtttaaagcagtctgtgctacaaagtcttgctatgcccccaaattatcagccaaagcactgactggatttgacatttttaattgctcattagcaaacaatgaagatttcaaaacaacagcagcaagtctacgaacaaagatactgaataggtagaactttaattaatttttcctcagtgactttttttaaaggaaaaaaagccattttcactatattttaaacataaaatgaatatcacatgactggatgtcttttttgattgtctcagtacacagcaatgatattgcttaacattaaacttagagatttattttaatgtttatcacctccttatagttatggctaggtattcattgcaaatagctttaaaatatattattttttcgtagagaagataagaaaataattgagcaaaactagaaataataataataaataccgtgattacattttctttatttagaaatgaattcccaaagggattttcttgccaccttcaattttctcattgttagtccatttaacaagcatatcttaaccacaaacaacaagatctatgctaaatgtcaagggctttaagagtacggcaatattaatttacagcacatgcccctcctggagtgctgtgaggggcacaatgttctttggaaattccgacagagagtaactgtctcagacagtgacatatgacataagtattcttatgaaacataacaataaaacaagcagggtgaagttaccactcaatttaaaaagataacattcccattacaatggcaactccctgtatattcctcccagatctcacccctctgtggtcatccccaaggtttgtttctatatgcccttgcttttttacattgttttttctacctaggtatagctaaacaaatattgtttaattctgctcatttttgagcttaataaaaatcatatcacactgtaggaagtctgatatttgtatttatcattcaatattatgtctgagatccatccatgttgacgtctgtagttagagttcattcatttgcacttccatatggttatagaatctgttaaacattctcttgtttgtttccagttctttgcctttgcaaacagtgcagctataaacatccttgcccatgcttgatggtatagatatacaaattttcacatgcttaactagtagagttgatggaacacaaaacacatacctgctatctgtgtattttacctaaaaataagaaaatcttacccaaattttttgtaccagtttacactctcactagtagtatatgaatgctaattgttccacatcttgacagatattatattgccatatttttaaagtcttgtcgatataattaagataaactgtttatattattgggggtttatttgtatttattattcggggttaatttgtatttccttaattactaatgcatttgagcattttttcatatttttattgccccattgcttttcttcaatgaaatctattcattttgtctacctatattccaacagaattgtttgcttttgtcttattcttttgcaggaggtctttgtattattatgaatatcaaattttagtcaactatatgtgtgacagatatttctccagttttctcatgatttttttcacgaacaggaaacttaagttttatatagttttgttaatattttcctttatggtgatacttttttgtgtcctgtttatgaaacatttccataccaagaggtcacaaagataaccttctatgcattctaaaaattttaaaagtttatattttcctcttaagaatttgattcacctggaattgatgtttgctgatggtgtacagaagggagagattcaatttttttccatatgcagaatcatttgtcttaacattacttaagattttaacacaacactaatctacaaagctacctctattttaaaatatgacacttacatatatgcatgataaatttttccaatttgtactattggaaactacagaccctaaatgatgcttagccctaatttggggaacgaaaagagtagagagctcaatggctctgcttaagaaatttaagtgatttagcagtggagggtggcaacataaaaagacaggagttttgatttggattatagtcagtctcaagaaaatggagaggtccagacaagataaaattcctataaaagcaagaatgatggatttttagaatagtgatgtataatcttcaatacaaagttgctgtttgaattagctattcagttttctgaatctccagtaaatgtcagccacatattagtgtctgggaatttggagagcttttcatgaggaacaaagcaacccaagaaaaaatgagtcattttagaaggcaagatggagatcaggggtcaagaatgcagcaggagcaggatattcgatcaagaacgggccaggcacagtggctcatgcctgtaatcccagcattttgtggttgtgaggaacaacataacttttcgtttaacagtccaataaagagatctggaactatataggaggaaaaacctaatatcagcctcccattaacccaccgtgtctaagaataacgctcatattactcttgtccattcgttctttttttttttttttttttttttttttttttttttttttttgagacagagtctcactctgtagtccaggctggagtgcagtagtgttatcatagctcactgcagcctctatctcctgggctcaagccatcctcccacatcagcctcctgagtagctgtgactacagacacatgccacaaagcctggctaattttttaatcgtttgtagagacagggtctcaccatgttgcccagactggtctcaaactcccggactcaagcaattctcctgcctcgacctcccaaagtgctgtggttatgggcgtaagccaccatgtctggcccattcttgatgtaatatcctgctcctgctctgactgctgctctgaatcttgccttctaaaatgactttaaatgaaagtaaaaagtttacattagtcgtctgtgcaggacctgtggatcatcactaatttccacattcacccctctcttggtggtggacaacagccctggtggaagagttagtcctactttgacacttgcaatactagagtctagggttgaggataggcaccctgcaatgccatggcaagataagtgtcctgataaggggacagaaaatctactgctgttatgttgatatgtttctctctctctctctctctctgtgatttaagagtttctatccaaacaagatagaaatatattcagcagctgagatggctattggaaattcatctacaatcctttctggggatcaactgtcagatacatttagtgaaataaaaattaaatttattgataaaaatctaatttccttctatttaaaagcctttctaaatttgcttcatggaaactatgtatactctagaaaaataaatacaacaaatatttttgttaattttgtagttaaactttagattatatatttaatgtaattttaaagcatttcttaaaaagtagtaggtcagttaataaagtctgtatgtaaatattaagatattaacaatgtatcttatgagataaatgacaggtgtgacaagataggaaccttgttttataatttgttataaaacttatacttgttttataatgagtaaggaaaaatttagaattttgtgtaaatgaaatgtatagagttacaaaaaatcataaataagtgtataaaaacgttctttggatctatagtaatgtaactgctttatatttcctaaaagtagaaaatgttgagtgttgaatgtaacaacagccgttataattatgagtgattcatattcagttccttagtaaagtctttgttaatctttgcaggctaggttggtttcttcttctggattcctttttttttttttattacaagatattttattagctcaacatctgaaatttccattttcccaagtaatgcttggcatagttgtggttttactttgtccaatgcattattttctctgtacttcttgttacagattggtatttatttcgattcagtaaaacatgtttaagcaacaagctttggtcaacattctactagtgatgcattactcttttatttttattcttgagacggagtctcgctctgtcacccaggctggagtacaatagtgccatctcggctcactccaaactctgcctcccaattcaagcaattctaccttaccttcctgagtaactgagattacaggcgcttaccacgacgcccagcaaatttttctgttttttttttgtagagatgcggtttcgccatgttgccaggctgaattactttttaaaaaataacttttacttaaaaaatatttttgtaacaaggtctggttctgtcaccctggctgaagtgcagaggtggaataacagctcactgcggcctcctgggctcaagccatcctaccacctcagccccaagtagctgggactacaggaactcaacaccatgcccagctaaaattttttattttaattatactttaagttctagggtacatgtgcacaacttgcaggtttgtaacatatgtagacatgtgccatgtttgtgtgctgcacccattaactcatcatttacattaggtatatctcctaatgctatcccttctccctccctccaccccatgacaggccccagtgtgtgatgttccccaccctgtatccaagtgttctcattgcacaattcccacttatgagtgagaacatgtggtgtttggtcttctgtccttgagatagtttgctcagaatgatggtttccagcttcatccatgtccctacaaaggacatgaactcatctgtttttatggctgcatagtattccatggtgtatatgtgccacattttcttaatcctgtctattactgatggacatctgggttggttccaagtctttgctattgtgaatagtgccgcaataaacatacatgtgcatgtgtagttatagcagcaggatttataatcctttgggtatacgcccagtaatgggatggctgggtcaaatggtatttctagttctagatccttgaggaatcgccacactgtcttccacaatggttgaactagtttacagtcccaccaacagtgtaaaagtgttcctgtttctccacatcctctacagcacctgttgtttcctgacttttcaatgattgccattctaacaggtgtgagatggtatctcattgtggttttgctttacatttctctgatggccagtgacaagcattttttcatgtgtctgttggctgcataaatgtcttcttttgagaagtgtctgttcatatcctttgcacagtttttgatggggttgtttgattttttcttgtaaatttgtttaagttctttgtagattctggatattagccctttgtcagatgggtagattgaaaaattttctctcattctgtaggttgcctgttcactctgatggtactttcttttgctgtgcagaagctctttagtttaattagatcccatttgtcaattttggcttctgttgccattgcttttggtgttttagacatgaagtccttgcacatgcctatgtcctgaatggtattgcctaggttttcttctaggatttttatggttttaggtctaatatttaagtctttaatccatcttgaattaatttttgtataaggtgtaaggaaaggatgcagtttcagctttctacatatagctagccagtttccccagcaccatttattaaatagggaatcctttccccattgcttgtttttgtcaggtttgtcaaatatcagatggttgtagatgtgtggtattatttccgagggctctgttctgttccattggtctatatctctggtttggtaccagtactatgctgttttggttactgtagccttgtagtatagtttgaattcaggtagcatgatgcctccagcttttttcttttggcttaggattgtcttggcaatgtgggctcttttttggttccatatgaactttaaagtagttttttccaattctgtgaagaaagtcattggtagcttgatggggatggcattgaatctataaagtaccacgggcagtgtggccattttcacaatattgatccttcctatccatgagcatggaatgttcttccatttgtttgtgtcctcttttattttgttgagcagtggtttgtagttctccttgaagaggtccttcagatcccttgtaagttggattcctaggtattctattctccttgaagcaattgtgaatgggagttcactcatgatttggctctctgtttgtctgttattggtgtaaaggaatgcttgtgatttttgcacattgattttgtatcctgagaatttgctgaagttgcttattagcttaaggagattttggactgagacaatggggttttctaaatatacaatcatgtcacctgcaaacagggacaatttgactctgtcttttcctaattgaatgctatttatttctttctcctatctgattgccctggccataacttccaacactatgttgaataggagtggtgagagagggcatccctgtcttgtgccagttttcaaagggaatgcttccagtttttgcccattcagtatgatattggctgtgggtttgtcatagatagctcttactattttgagatacttcccatcaatacctaatttattgagagtttttagcatgaagaggtgtcgaattttgttgaaggccttttctgcatctattgagataatcatgtggtttttgtgtttggttctgtttatatgatgcattacgtttattgatttgcatatgttgaaccagccttgcatcccagggatgaagcccacttgatcatggtggataagctttttgatgtgctgctggatttggtttgccagtattttactgaggatatttacatcgatgttcatcagggatattggtctaaaattctctttttttgttgtgtctctgccaggctttggtatcaggatgatgttggcctcataaaatgagttagggaggattccctcttttcctattgattagaatagtttcagaaggaatggtaccagatcctctttgtacctctggtagaattcaactgtgattccgtctggtcctggattttttttgttggtaggccattaatcattgcctcaatttcagaacctgttattgatctagtcagcgattcagcttcttcctggtttagtcttgggagggtgtatgtgtcgaggaatttatgcatttcttctagattttctagtttatttgcacagaggtgtttatattattctctgatggtagtttgtatttctttggatcagtggtgatatcccctttatcattttttattgcatctatttgattcctctccattttcttctttcttagtcttgctagtggtctatcaattttgttgatcttttcaaaaaaccagctcctggattcattgatcttttgaagggtttttttgtgtctctatctccttcagttctgctctgaactcagttatttcttgccttctgctagcttttgaatggtttgctcttgttactctagttcttttaattgtgatattagcgtgtcaattttagatctttcctgctttctcttgtgggcatttagtgctataaatttccctctacacactgctttaaatgtgtcccatagattctggtatgttgtgtctttgttctcattggtttcaaagaacatctttatttctgccttcctttcgttatgcacccagtagttattcaggagcaggttgttcagtttccatgtagttgagcggttttgagtgagtttcttaatcctgagttctagtttgattgcactgtggtctgagagtcagtttgttataatttctgttcttttacatttgctgaggactgctttacttccaactatgtggtcaattttggaataagtgttatgtggtactaagaagaatgtatattctgttaatttggggtggagagttctgtggatgtctattatgtctgagttcaattcctggatatccttgttaactttctgtctcgttgatctctctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttatttgtctcttttgatctttgcgggtttagagtctgttttatcagagattaggattgcaacccctgcttttttttttgttttccatttgcttggtagatcttcctccatccctttattttgagcctatgtgtgtctctgcacgtgagatgggtctcctgaatacagcacactgatgggtattcactctttacccaatttgcccatctatgtcttttaattggagcatttagcccatttacatttaaggttaatattgttatgtgtgaatttgatcctgtcattatgatgttagctggttagtttacttgttagttgatgcagtttcttcctagcatcgatggtctttacaatttggcatgttgttgcagtggctggtatcagttgttcctttccatgtttagttcttccttcaggaggtcttttagggcaggcctggtggtgacaaaatctctcagcatttgttcgtctgtaaaggattttatttctccttcacttatgaagcttagtttgactggatatgaaattctgggttgaaaattcttttctttaggaatgttgaatattggcccccactctcttctggcttgtagagtttctgctgagagatccagggtttgtccaatgggcttccctttgtgggtaacccgacctttctctctggctgcccttaacactatttccttcatttcaactttgttaatctgacaattatgtgtcttggagttgatcttcttgaggagtatcttcatggcgttctctgtatttcctgaatttgaatgttggcctgcctcactaggttggggtagttctcctggatagtatcctgaagagtgttttccaagttggttccattcaccccatcactttcaggtacaccaatcagacttagatttggtcttttcacctagtcccatatttcttggaggttttgttcatttctttttactcttttttctctaaacttctcttctctcttcatttcattcatttgatcttcagtcactgatactctttcttccacttgatcaaatcagctactgaagcttgtgcatatgtcacgtagttctcgtgccatggttttcagctccatcaggtcatttaaggtcttctctacgctgtttattctggttagccattcgtctaatcttttttcaaggtttttagcttctttgctatgggttcaaacattctcctttagcttggagaagtttgttattaccgatcatctgaagccttcttctctcaactcttcaaagtcattctccatccagatttgttccattgctgaggaggagctgcattcctttggagaagaggcgctctgatttttagaattttcagcttttctgctctggtttatccccatctttgtggttttatctacctttggtctttgatgatggtgacatacagatggggttttggtgtggatgtcctttctgtttgttagttttccttctaacagtcaggaccctcagctgcaggtctgtgggagtttgctggaggttcactccagaccctgtttgcctgggtatcaccagcggaggctgcagaaaagcaaatattgcagaacggcagatgttgctgcctgatccttccactggaagcttcgtctcagaggggcccccggctgtatgaggtgtcattcggcccctactgggaggtgtctcccagttaggctactcagggttctggcacccccttgaggaggcagtctgtccattctcagatctcacactctgtgctgggagaaccactactctcttcaaagctgtcagagagggacattaagtctgcagaagtttcttctgccttttgttcagctatgccctgcccccagagatggagtctacagaggcaggcaggcctccttgagctgcagtgggctccaccctgttggagcttccaggcagctttgtttacctactcaagcctcagcaatggcgggcacccctccccaagcctcgctgccaagttgcagttcgatctcagactgctgtgcttgcagtgagtgaggctccctgggcatgggaccctccaagccatgcatgggatataatctcctggtgtgccgtttgctaaggccattggaaaagtgcagtattagggtgggagtgtcccgattttccaggtaccatctgtgaaggcttccctttgctaggaaagggaattccccgaccccttgcacttcccgggtgaggcgatgccccgccctgctctgtgggctgcacccactgcctgacaagccccagtgagatgaacccagtacctcagttggaaatgcagaaatcacccgtcttctgcatcgctcatgctgggagtttcagactagagctgttcctatttggccatcttggaacctctcctgtagaattttacataatgcttattctgggctttctccccttgaacattcttatggatttaaggacctcttctcacttactcttcttcattatttatgtcactttcaaattttatatatgactcccccatacaattagacacacagataaactacaaccactttatactattttccagaagagttgatacacaccaattaatatctaagtatctggcttccaatcctccacctaccattcactagtgatgtcatctcaagctctctggctacatttattattttgtgcaaaataaaaataatgataatggtcagggcattttcacatgattgttttaaggatgaaattaggagaatatatgagaaagtaatatttggatactataaaatgtcacataaatgattggaattattgtggctaccacgataaacttgttcttaatgattaaatagcattgcttttcaattccctgttcacctacttttggagaatcaactttctattttatttaaaaattcatctgtttattcttagaatacatgaatattatttaacaatcaacagaagtgtggagctgttcttactgacctatttattaatgtggaataccaattaaaccaaatgtacaaataacaaaaattcagaagaaaggacagaaatattactaataagcctccatgattctactctgatttatcctgtgccacatatattactgtttatgctaaagcaatctatgtatttgcagttaattttttattcatatttgtttctactgatcctgaacttaattgtaaattccttgagagaaaggttttctttaatatgtccttgcttctctctcttttacaacagagtgcttagaatataacttcttcgtaaatgctgatgaaaccaacagagtttaaacacaaagatgatctcccacattctacaatgtggactttaggtctcctggtcctgactaaagacatgtgcgaataaaaatgaaaacgtatatgggaaaatttgcctttcaaatatttggcaaagatttctgggtgcttgtccaagatatttttggttatacattccctgttagtccttcacatttcttgtgactagtaaattatggagtttgtccaggaagggttttcttagttgatccttacattggatgaccaatatttataaatgaggaacctcaactgcatcatttccatagctacagaccaaaatatatctattttctaatttcattcatgaactttttcctaaccactcatgttctctcaagcatagagttaattcgatgtttctaactaacccttataaacattgaagagttaataatgctcagtgtttacataatcacttaatttaggaaaagatgtttattttgttatggtccattaccatctgggactaacagggcgattttgctacgataccacagacttggtccctttttctctcacaaagcctccataaaaggtggcaatactttactagaagatgcctagaataaagaagttattttaatatgttaaagcaaagacagaaaggcaaagttagacaagacattttaaaacattatcaacttttttctgccaattctaacaatgctagaagtaacaaactgtaaagtgtttgcagtctggagtattgaaaatctcagcctaatccaacttttaaggaaaaggtctttatgtggatccaaataaacttgtgtagaggtggctataaagaagttcattaattacaaatgacttaaaacatgatagcaatgcttcctatttaactttggataaaaaagacatggaacacataagaaacagaactgtgagaggcaatggagggaaggcctcctggcttctattccccagattctgcaaaccacttgtctgtttagtgttgctataaaggaatacctgaggctgggtgacttgtagaggagtttatttagcttatgacttttctggctgaaaaattgtgcatctggtgaaagcctcaggctgtgtccactcatggcaggaggcaaaggggagccagtgtgtgcagagatcacatggtgagggagggagtgagagagaaagggggaggggtgccaggctcttttcaacaaccagctctcaagggaactaatcaagtgagcactcactcattactgcgaggacagcacccagctattcatgagggattttctcccatgatccaaatgcctgccattaggccccaccttgtgcagtggggaccaaatttcaacatgacaactaggggtacaaacatccaaactatagcaccactctttgagaattgcctgattaagctctgaactttgctcacagataaatataggatcactagttataagatcagtcattctttgagctgataaaggccagagagtccttttgtgtaaagcattccactaagtccttaaggaaatgctcaatgtcaagtgtctcctgtttatccacttttatcttaaaagcaaaatgtgccctttatactccctttaaatttgtcccatttctaagacagcagaattttcagaattctctttacaatcattgaagaacagcttgaatccctgaaatgtgtcagtatgcatatggggaccaggcatggagggaagtacagtgttcatttgatgggaaaaagctgtacaaggtaagagttaagcttttgatttaatcatgccaaacattcaatcttcataatttcagttacacaatatatttttgtctgaataatctctacttggctttgtgttctgtaaatatgatattgccaactaaaaattactatcttttaaatactatatgtgctggctgacattagcaaaatattgcctggcaggtaatgggcttacccttacaacaaaaaatttaaggtgcctgagggaatatctaaatggtttaatgtggcattatgtgtgactctcaaatgcagacacctcctactttcacttacacgtataccattctacagcattgatgagaaatcatgtttataattcatacattagccattgaaaattaattgtacattttaaatatatattgccaagctagaattggcatccaaataaatgcttaaatcactagtcttataagaagcactttcctctggtgaatgggttaaattgctgctgtgagattgaatataattagtcctgctgatatgcaaagaattgctctgtcaggaaatgtcactgccattgagtactgttccttgtctgcattccattttctgtctggctcagaaaactttaataacaggttggaattcacatgtaaaattttaaccaattttcataaaaataccttatttcattttcattttgctctcatataatctttggttgtcataaagtaggatactaaacacatctgatttccttaacttttattgccttttctcctttgaaggtagacatttagggttcattttttcccttagtacttttcaaatttttaatggaagtttaaatttcattgaaaatgacaaaagaagagaaagggcagtgagatgcagaaagttgaagaaacacatgtgagcaaagttacttcccctatgtcttcaaggagaggagactactttaatgccccaggaacgcgcaactagttcctaaattttttgaattgcctctaaaccgtagaaattgtgctttatagagtattgctaatcagggcctagtgctgtcaggagagtcagatgtttctattacataacctgcttccgtataaatctagaatctctctccagtgacttcaaaatcctttgtaggaaacttgaggtctgaagagcagagatattttaatctcatcttttagttaaagtatataattttgaaaaaggaaagatgatattgggtttgaaaaattggttccacagagtagaagaaaaggacaacacttcctacattaggttcatgacacaaaattaaggactcctggcaagtggtagtgaagaattaagaagagtgctttgtgaggaagaccattagtcaaggagctcttaaaggaaatttgagggactgagggaaatatagagttggaattgtgaaatgttgatggacagaaacaaaagggggtggttgctaatatttggatattctggaaggaatcaacaagaaggtagatagcatgttgtctgtggtttccaatgtttataaagtaatgcacagagaatgaataataaatggccttgaaattttaacacaagaagagaaattaaacacaaagtttcatggagacttagagggatgtaattgactgggatatagcaatgggaaggtgaatcttgttcaaagcaaagtgctctaattgatgagaaagaaaatagcattttgttatgaagaatgggaaaacagaatcttatgtttacagatttttagaagtaaatttagccaattcttttcaaattcttcatattacagaaggtagactaaagtctagagagatttacatgtcccttaaacaaaactattatagtcagggagggagggtggataattataacttcacaaggaccatataggagcagtatacactggtgaagagtgaggtgagacagggaacaagctatttagacattttccagaaaacattcaatctgatacaatctgaatttaactttttgacaatttgtttcttagaagagagagagtacaatcaggagtgctgctgcttacaagttaattctgaccaagaaaaaaaaatgaactgataatttaattgaagtccagaattacttagtacataacttattattacggactgctgaaaaacagagaaatttgttccatgcaatccacttttccctgcttgtgctaaccttactgcttagaagcatcatcatctgtctttagttggagagttgattgatataccattgtgttatctcttcagatattcagccacttgatggaatgggaaggaagtccagatatggggagggccatgtaacttctcatctaaacagagacacttgtgaaagtgagtgagtatgctaactgaatagacataatctagcttgtcctggacaaatcaggaaatatgggcatagatatttatgggtgggggagggaaacatgttttctatttcttctctcatgtgaaattaagaagaccattagtcaagtttctatctctacctttctgcttgttctagccttcacactagtttgtgagtcccaggattcttccatagtcaatcccctatggtcctgctagtttcctgcttatcggggctgctggaaccaccctgtgctgctgctttaaaatgccagacatttgagggactgaggtcaaataacacatttcccatttgcctctcagctaaataatggaaaagatagtataaatttacaggaaccagatctcctgctaaagatagttgaggaagactccacatactcagatggacagaaagggggacagagaaaaacaacctacatgatccagaaactcctttttcacttcagaaaatttgaaaagatcagaacaaccccatcaaaaagtgggtgaaggacatgaacagacacttctcaaaagaagacatttatgcagccaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcacattactgggtatatacccaaaggactataaatcatgctgctataaagacacatgcacacgtatgtttattgcggcattattcacaatagtaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaaccaaacaccacatattctcactcataggtgggaaatgaacaatgagaacacatggacacaggaaggggaacatcacactctggggactgctgtggcgtggggggaggggggagggatagcattgggagatatacctaatgctagatgacaagttagtgggtgcagcacaccagcatggcaatgtatacatatgtaactaacctgcacattgtgcacatgtaccctaaaacttaaagtataataataataaagaaagaaagaaagaaagaaagaaaatttgaaaagaaggtggtgattgtcatggtgggagagctggggagacaacaatagactgtaacataagagtaagagaccgtagcccttgggatgcggagaaggcagcaaatttggaaagggtctactacagcctccagaaatagatttttgaaagcatatgtttcgggcttgaaatacatttaaacatggctttcatggggaaaaaggaaaacacagcaggagtgataataagagggggaccaacgaagagtgaaaaaatgtaagctgagaaaaaaaaagaatgtgttgatacgatttttaacaaatggagagcaactaaaattcaaagcagagtattaatcttcactggaaatactgcaaaaagataacataatacagaattttaattggtgacatagatgacgacaatggaaagtaaactataaatataaagaatgcataatatgttaaaactatggaaaatggcatacttaattaagaatgagtaaaccttaacaatagtcaaaaacaaacttagaaacaatgaaaataaccaacactgaatgcctactacataataaacactgaagctcaaaacaattctatttgttgttacactactatatgtactttataaaggagaaaccgaggaacagagagggcaagtaatatccctaggttcacaaagaaagtggaagagcaaggtcttcaacttaagcagtctggcaccagagcccatgctctacctgtaaccattacgttatcatgtcccccaaaggcaaaagaaaaattcttaaactataatagattaaaatttagctattgtaaaaaaggatgagagtatctaatataaaaccttttaaaggatattgtgtaaaatttatgatgagattagcaaacatttcttggagaataattggagtttttaggacacaaaaacttacattcggacaataaaacaaaataaaataaaatatattgtctaactagaacaaagttctggttgatttcacattttcctgaacattaaattgtagaaaaaaaggaagtaatacatactttttttttgagacagagtcttcctctgtcgcccaggctggagtgcagtggcgagatctcggcttactgcaagctccgcctcccgggttcacaccattctcctgccacagcctccagagtagctaggactacaggagcccgccacaatgcccggctaattttttgtatttttagtagagacggggtttcaccatgttagccaggatggtctcaatcttctgaccttgtgatccgcccgcctcggcctcccaaagtgctaggattacaggcgtgagccaccatgcccagccccaatacatacatttttaaaggattaagattgtcatcattttttcaaatgtcttaagaagttaccttttgtagattttggctattagtcctttgtcaggtgcatagttagagaatattttctccccttctgtgggttgtctgtttattttgctgtgcagaagctttttagtttaattgggtcccatctatttatttttgttattgttgcatttgattttaggtttttggtcatggactctttgcctatgccaacatctagaagagttttattaatgttatcttctagaatttttatgggttcaggttttagatgtaaatctttgatccatcttaagttgatttttgtgcagagtgagagatgagaatctagtttcattcttctgcatgatgccttgccaattatcccaacaccatttattgaataggttgtctgtattagtatgttttcacactgctgtaaagaagtacctgagactgggtaatttataaaggaaagaagtttaattgactcacacttctgcacggatggggaggcctcaggaaattgacaatcatggcataaggggaagcaattatgtcttcacaaggcagcaggagagagagtgctaggaagagcaaggaaaactgctttatgaagccatcagatctcatgagaactcacttactatcacaataacagcaaggcagaaatctgctcctataatccgatcacctcctactaggttcctccctcaacacctgagaattacaattcaagatgagatttgggtgggggcacaaaggctaaccatcagtgtcctttcccaactttatgtttttatttgctttgttgaagatcagttggctgtaagtatttggctttatttctgggctctctattctgcttcattggtctttgtgcctgtttttctaccagtaccattctgctttggtaactatagccttgtagtatagtttgaagtcaggtaatgtgatgcctccagatttgttctttttgcttagtctttctttggctgtgtggggtctttttagctataaggaactccaacaaatcaccaagaaaaaagaaataacctcatcaaaaagtgggcaaatggctgagcctgggcaacatggcaaaactccatctcaacaaaaaatacaaaaattagctgggcatggtggcatggacctgtcccagctacttgggaggctggggtgggagaatcacctgaaccagggatattgaggctgcagtcagttgagaccatgtcactgcacttcagactcttgcctgggtgacaaagtgagaccctgtctcagaaaaaaaaaaaaaaaaatagtagtaggcaaacgacatgaatagacaattctcaaaagaagatatacaaatgaccaaaaaatatacaaaaaaatgctcaacatcactaattatcagggaaatgcaaattaaaactacaatgagataccactttactcctgcaggaatggccatgattaaaacatcaaaaaataataaatattggcgtggatgttgtgaaaatggaacacttttacattgctggtgggaatgtaaactagtacaaccactatggaaaacagtatggagattccgtaaagaggtaaaagcagaattaccatttgatctagcaatcactctactgggtatctacccagaggaaaataaatcattatatgaaaaagacacttgcacaatcatgttttagcagcacaattcacaattgcaaaaatatggagccagcctaaatgcccatcaaccaacaaatggataaagaaaatacggtatatatacaccatggaatactacacagccatagaaaggaacaaaataatggcattctctgcaacctgggtggagctggagactattactctaagtggagtaactcaggaatggaaaaccaaatattatatgttctcacttataagtgggagctaagatatgagtacccaaatgcataagaacaatctaatgggccgggagcagtggctcatgcctgtaatcccagcactttgggaggctgaggtgggctgatcatgaggtcaggagatcgagatcatcttggctaacacggtgaaaccccatcgctatcgaaaatacagaaaaactagccgggcgtggtggtgggcgcctgtagtcccagctactcgggaggttgaggcaggagaatggcgtgaacccaggaggcgaagcttgccgtgagccaagatcgcgccactgcactcagcctgggggacagagcgagactccatctcaaaataataataataataataatttaatggactttggggactcagggggtgagggatataagactacgcactgagtacagtgttcactgctcaggtgatgggtgcaccataatctcagaaatcaccaccaaacaacttacctatgtaataaaaaaccacctgttaccctagaactgttgaaataaaagtatttacatagtgatagtaatttaaatgctgattattggttttaaagatttaaaatgattctgtgaacaaaaaaaagagaaagacttagttcttgttgtagatcagactaagaatgctaattattgaaaatctaaaagaaaaaagacaatggtgagaaaagctagaggaaaggatagggatatcatatacctaacttacgtaagagagaataaaataattgactaccgttgatggaaaaaaaagagttaccatttgcatgtaaatttagcaggaagacaattttaaatgaactctttaagagtttcataattatatacctttccatttaaaaaaaactgagttcagtttaagaaacactgaataattaggaaagattgagattttaaaaatgatggtaaatataaccaacatatattcacatatggttataaaatataatatacatattaaaattcatttttgaccttgcttaacatcaaccacaaacacatatgcacatacatacaagaatctctttgttcttcctttgaacaaccttttttttttctttcagttagcttttctcaaagtatacttatggaatacttttaccttctttcctccaaaacaaacaaacaaacaaacaaataaaattcaaagggcaatttttttctctagagattcctgtgctagttggtaaaaaacagacacaaaatataaagattgaaaaaaaaaaagaaagaatactactgacaaatttacattcaaacctcactaataaatgcaaaaaaacctagataaaatattagtaaataaaaatacagcaatttatcaaaagaataatacatgatcaaaaagtagggtatattttaagaacacaagattgcttaatattaggaaatatattcataaaatacatctcatcaataagttaaataagaaattgtgaaagatactagaattgcatttgctcaattcaacatacattctttgaatcttaagttagtaattaaaacattcttcctttttatgataaagaatttcaatctcaaaccataagtcaaaataatactgaatagtaaaatattagtgatagtcccgtttatatcaggaataagacaagggtaactgtccttactgagtttttttttttttagattcactctcagaagtaactgatcaacagtttttattttgtttatgcttttagttgtttgttctgctgcaagacatctacctactttctacctctgagggaaatatttctggcccgtgggtgaaatggtgcttaagacagagagaagaagattcttaacataagagaagtatctattttatgttatgttatgagaataaccatatatgaaatataatgaaaaacacctgattcatagcagcaataaccattatcaaatatacagacatatactaatcaaaaatatgtaacactgtgaaaacaagtacaaaattttatggagagaaacaacttgagtaaattaaggcacacagtaaagctagataaaatagttataaatttctatttcaaaattgaaaaaatagagaaatttgcatacatcagaggcaaattagggagtaaatgctcacaaggaaaagattgtgaacacaggaatgaaagactaagactgtaaatcttcatttagtaacttagatgacgattttaagaaaagctgctaaataagtattttttatgtgtaaaaggcagtctgcaatgcaaacctcctactaaggctcccctatgaaatactatacaacaggggtccccaacccctgggccatggattggtactggttagtggcctgttaggaatctggctgcacagcaggaggtgagctgcgggtgagattcgtctgtatttacagccacttcccatcgctggcattactccctgacctccatctcctgtcagatcatcatcagcattagattctcatagtagcgtgaaccctgttgtgaaccccacatgtaagggatctaggatgtgagctccttatgagaactgaatgcctcatgatctgtcactgtctcccatcacccccagatgggaccatttagttgcaggaaaacaagctcaggactcccactgattctacattatggttggttgtataattatttcattatatattatgatataataataatagaaataaagtgtacaataaatgtaatgcgcttgaatcatcccgaaaccaccccactcccttgccctgtctgtggaaaagttttctttcatgaaacctgtccctggtaccaaaaaggttggggaccactgctatgcaccaacaaagctaagtagaatttcttttgggtgggtgtgcaaaaaagtgctgagtactacttcaagtgcagcatagagcaaaggagagcttgctcacaggggagaggtaatgatatggtcacaatgatgtagaaaagaaaaaaaaagtcattaattatttccagataatcactacctactagaaaaacccaagaataaattgaaaatcaattacaataatagagttccacgaggtggctgttgataaaaactacaaagaatcagtatctttcttatgttaatgagaataaccatatatgaaatataatgaaaaacacctgattcatagcagcaataaccattatcaaatatacagacatatgctaataaaaaatgtgtaacactatgaaaacaattacaaaattttatggagagaaacaacttgagtaaattaaggcacacagcacagctagataaaatagttataaatttcaatttcaaaattgaaaaaatagagaaatttgcatatatagatattaagacaacaataatttaattagactagtatagtctagaaatcccagcagtatacacaagtacatacaaatatttagcatctgataagatatcatttcaaatattagagatagggttctggcttttggtaatggcggaatgaaatgtcctgtgaaccctcccaaggataatcattataaaaactgaataaaatatgattttcaaaaactgatttcctgtatgttaagtgaaagccaggaacagaatgaaaaattccacatgatcttattcatatgtgaaatccaaaaaagttgatctcatagatgtagagagtagaatatcagttactagaggctagaaagcataggaggaaagggaaatcaatctattagtcaatgggtatcaaatgatagttagataagaggaataagttctagtgttccattacacagtagggagaatacagttaacaataatacattgtatagtttaaaatagctagaagatctcaacacaaagaaattataaatggttgaagtaacggataggctaattgccctaatttgatcattacacattgtaacaagtatcaaaacctcacattctaccccataaacatgtataattattatgtgtcaattaaaatgaaactattggaaggaaatgtaaagtgactaaatgcaagcagaaatcagagatttacccttgagagactataactataatggatagtggctgagtagagagtctaagtatgacagaacagatagaaattagggacaaaattcaagaagcaaaaaagctgcagaaaagaggaaacaaaaaatctgagtatgaactctgtccatatccctggctgttcaacaagtgacagatgtaaggggacagctggggcaaagaaaaaataggcaggataataaagaaatctatcctcaaaagtcagaatttcaccaggtgagatctgaaagttaactcctttattgattgggtgcattccagaatatgcactcagctcgggaggcagagagctgaagtcttacaaggaggacaaagctcaggggtggaaaagcaactaaaatttatgaatcaatagaagcaagagaaccacagaaagaatgtctccaaatttgcatataaaccccgtccatatctttggctgaaaataaactacacaggctcagaagaccctcagggagtcagactataaaattggcggcttgacatttaaaaagctaagcagactatcagctactgcataccatgtgtagacaaataaatagtttggctttaagcaaattaattacttatcagaacaaacaaagaaacaaataaaataaccccatgattctacaaatgacaaaacagcacatattgccactatattatataaaatgaccaatttcaacccaaaattactaaatatgcaaagaatgagtagtgacccacattaaaaaaataatgaagcaaatgtaaagtgcctccaagtgagcctagattttgggcatagcaaacaaaaacttcagcagctggtctaaatatgttaaaatgtttaaaaatatgatctcaatgagtaaacagataggaaataacagaaatacaactaaaaagaactgaaaattacaacaaaagtcattagaatcattctacagattagatgtggggaaaaaaatcagtgagcttggtgatgcattaataacagctgtccaatcttaagaacagagagaaacatgatattacaaaataaatgaagcttcaaaaatttgggacatgccgggggcagtggctcatgcctgtaattccagcaccttgggaggccaaggcaggtggatcacaaggtcaggagttcaagaccagcctggccaacatggtgaaaccctgtctctactaaaaatacaaaaaaattagccaggtgtggtggtgggcacctgtaatcccagctactcaggaggctgaggcagagaactgcttgaacccaggaggtggacattgtagtgagccgagatcacgccactgcactccagcccgggtgacagagcaagactccgtctcaaaaaaaaaaaaaaaaaaaaattggaacaacatcatttggtccaatgtatatgtaattgaagtctaagaagaaaaagggaaaggtagaagaaagacaaaataatcatttgagaaataatggtctaagcctagccttcacttgattttaaaaaatcacacacacattaacttacagattcaagaatttcaattaacccaaagcaggagaaaataaagagaatcgtgaccaagttatattgtaaccaccaaaaggaaggagggagggaaggaggaatggaagggatatgaatgttgaaaacagcaaaagaaaaatgacacattatgtacatgggaacaatgatatgtttcttgatttatcttcaggaatagtggatgccagaatagtttaaaataacacattcaatgctgtttgttataggacattcaattccatgctttttagaagaaaggtgcaatgaatggtccatgcctaaaggctatggaattttgctccccatcattgaagatgaaatatttacaaatattatttggaaatcttttgtacatatgtttgtctattcttcctcatttatttatttataagtgtggacttacagaaatttattttatactgtgggttatattccaactgtttattttactatggtgctcagattgctccagctttggtcatctggacccccctcagttggttcctatgtcatatctccatctttgactgttttgagctcctccttactttctggcactacaagatgatccaagcttacctgttaactttatcaaatctttgtttagggagtgttataaacgtcaccttagaatacacacttttcgtgtactgatttattttcaaattctctaaattcagaggaatctggtttcttcattgctccaagctaatataaagtggtgagagttttgttgtgttatgtattctaataaaatactgtacttatctgctagacgtttgactagtctggtaaccgaatggttactaattggaagtctacaattgatatgactcaagtgtattcaagtaagctattttggaaataaataatcttacatgtataaaccactgtgtgctaacaacataaatcagcaaagaaacacaattttttgaggtagttttttcattaagttattaaaaatgttacttgtttttctctccatcctggcacaatgggcctcggctatggagaaagagaaaaatctaatagcacttgcaagacttcttgaggggcaagggttgaaggctgtagtcaaaggcactgctattaatcagctttgcttcactcccacaccatcttgtactagggaagcttaggaggaggatggttggctgagctgtcagaaatggcaataataaaaaaattaaaaagttttaaaatgtaataattagatctttcccacaaactgtcaaataaaaaatatgacccatctctcccctccacactattggctgattacatgattgatttaatttaacatcaggataattgcgtttttcagagattatcctacatcatagcttttttgagctgacttgcctaaaagtacttattgattaaaacatttagtgaatacactactcagacactgaacatttagcaccttataaattgatttacatttttatacatatgtcttatatcctcaaaatgagggcttgattagagtctgatctgaagtcagtgacacattctttaacctctgtgaacctggctttccttttcaataactgtgggtaacaagcacccacaaagtcatggtgaaaatcaagtgatataatttgaagtaaagaccttaccacattacatctgttacagataagtaatcaatatatgtttatttttgcttcatatatgcctgactcaatgaatgaatgtgacttgtgcagtcatacaaggccctctcatacttagaaaaaacctgtgcttggtttcatactcttctattgctctactgaatttcctaataattttaaaatgaggagtcctgcgttttcattttacactggaccttgtgaattatgtcctgggtccacccaactaaattgtaagccatttgaagtctgagatgctatagatgacattatatccctaatgtgtttctcaattcttaattagtttcctgtatgtggaatgtaaaaattcacatttattgaaaataatagtagtgatttgcttaagacagtcaatatagagtttcaatggtagatatagaagtcctgcctgaaaatcacatgccaatatttcgtgccttgtcatccatatgtcttttattaccaataaaaaatattctattccaatcaaagtactgttatgcatatctaaaataatgccatgattataagtctagagtgtgtttttggttatacattaacagaggcttagaattttgggtggagaaaattcacttaaaacaaaatcgtggtgcagtggggccttctccactccatgcccaggcagatcttcatacatctgaagcacctgctcacctggaccaaaagctggaatcacctatagttcctttgcatagatcatggtttagcagggccctctccatgccatggccaggctgatcttcaggcatttaaatcacctgttcatctggatcagcagcctgattcacctcattcttcctgtgtagagactatagttcagtagggcccctatgcttcatgcctaggcagatcttcaggcatttgaagcatccactctcctgaattaggagattaggcatcccccacccccacagagaacttggggcagaagaacttccctatctccatgcataggcccaactctggatgcttagtagccacccactggagcccccattggcataaatgcttgtacttgccactgagtgacctaaagatgagcctgcctactctggccccacccatactggtgccccacaatgggctgagcaaggagatcagagctaagacctctgtgcactacatggatcagcccattgcctggggcaacagagacttctctcaatcaacaagaataaattatatacccatctatgttggctgcctctctggctcttacccatcagtgcaatctactggcctgtaggttgaactgcagaacccaacgtaaaactggtcaatggaagtgcataggctatagaagcaaaaccaaaagaccctacccaacattctctacaggcactcaattagggaggagggcaagaggaaaataatgataataataataataatgggaaagaaaaaaagtaaaaaatcctaaccacatgaaaataattacaaaattagtagtgccataagcgccaggtgagaaggagccagcacaagaattctgttaccataaaaaatctgaacattgtgacatgaccaaaggatcatattagctctaaaacaataatcccaaactggaatggaaactcagaaataaaaaataaagaattcaaagcatgtattgcaaagaagcttaatgagattcagaaaaagtttgaaaattaacaaaaggaaacttttaatcaatccagaaaacttcttaacatatttaaaagtaatcaatcagcgcttctggaattgcaaaacttcacttaaggaattttaaaatacatttgaaagctttatcaataggctaccaagcagaagaaagattttcagagattagggactgatctttcatactaacacagttagacaaaaatagtcaaaagaatttaataaaatgaacaaagtctttgagaaatgtgggattaggtaaagcaaccaaacctataaattactggcattcctgaaagagaaggagaaaaagtaaacaatccaaaaaacatatttgaggaactaatccaataaaatgttcctagtcttcctagagaggtagatatccaggtacaagaaatacagagaacaattgtgatatactatacaaaataaatatcaacaaggcacatagtcaccagactggccaagatcagcacggaagaaaaaaatcttaaaaggcagctagaggaaaaggtcagatcttgaacaaagggtacaccatcagattaataacagacttctcagcagaaacctgatgagccagaagagattgggggcctattttcagcattattaaagagaagaaattccaaacaagattttcatgtccccccaaactaagctttgtaagtgaaggagaaatgaaatcatttccagacaagcaattgctacaggaatttgttaccactagaccagatttacatgagatcttcaaaggaattctaaacacggaaacaaaagaacaatatctgctaccacagaaacacacttaagtccatactctatagtctctataaagcaactacacaatgtaaattaacgcaaccagctaacaactccatgatagaatcaaaacctcacatatcattattaaccttatatgtaaatgctctaaatgctccacttaaaaggtacatattggcaagctggataaaaaattaagacccattttcctgctatcatcaagagacccatttctcacataatgacacccacaggctcaaagtaaagaattggacaaagatctattacaaaaacagaaaagataaaaagagcagaggtcactattaatcggaaaaaaatgactttaaaccaatgacagcacaaaaggacaaagaaggcccttatataaagatcaagggttcaattcaacaagaaaacttaactatcctaaatatatatgcacccaacattggaggactcagatttataaaacaagtacttctagacctacaagaagacttagacaaccacacagtaatagtgggggatttcaataccccattgatagcactagacagatcatcaaggcagaaaactgacaaagaaattctggacttaaatttgacatttgatgaattggacctaatagacatctatagaccgcaccaccaatcaaccacagagtatacattcttcttacctgcacatggaacatactctaagatggaccatatgtttgaccataaagcaagtctcaataaattttaaaaaatcgactcatagatgagaattgaacaatgagaatacttggacacaggaaggggaacatcacacaccggggcctgtcgtgggatggggggaggggggagggatagcattaggagatatacctaatgtaaatgacgagttaatgggtgcagcacaccaacatggcacatgtatacacatgtaacaaacctgcacattgtgaacatgtaccctagaacttaaagtataattttaaaaaatcaaaatcatttcaaccatactctcaaaccacagtggaataaaaatggaaatcaataagatctctcaaaaccacacaattatgtggaaattaaacaactttctcccaaatgacttctgaataaacaacaaagttaaagcagagatcaaaaaattactagaaataaatgaaaagagggacacaatatatcaaaacgtgtgagatgcagcaagaggagtgttaagaaagtttatagccctaaagcctatgtcaggaagtcagaaagatttcaaattaatgatctaacatcacacttaaaggaactagaaaaacaagaacaaactaatcccaaagctagcagaggaaaagaaaagaaaaaacaaaactaaaatcagagcaaaactgaatgaaatggagacccaaaaacccataccaaatgatcagggaaaccaaaagttgattctttgaaaagataaataagactgacagacctctagctagattaacaacaacaacaacaacaaaaaaaaaaaaaaaaaaaaaagaaaagaaaaacaaaaaaaaaagagagagagagaagacccaaataaacagtcagaaatgatgaaggtgacattacaactgctcccaccgaaattaaaaaataaaaaatctcaaggactgttatgaacacctctatgcccacaaactagaaaatctagaggaaatgaataaattcctggtaacatacaacttcccaaaattgaatcaggaagaaattgaagccgtgaacagaccaacattgaattctgttattgaaatagtcataaaaaacctgccaacccaaaaaagcccgcgaccagattgattcacagctgaattctaccagacacacacagaaaaactggtaccaattctactaaaattattccaaaaaatcaaaaagggacttccccctaactcattctatgaagccagtgtcaccctgataccaaaagctggcaaagacacaatgaaaaaagaaaactataggacaatattcctaaagaatattgatgcaaaaacactcaacaaaacactaacaaaatcaatgtgcacatcaaaagttaattcaccatgatcaagtaggctttattctgggatgcaaggttggttccatgtacacaaatcaataaatgtgattcatcaaataaacagaattaaaaacaacacccatatgttcacctcaatagacgcaaagaaagcttttgataaaacccaacatcccttcatgatagacaccctcaataaactaggcatagaaagaacatacctcaaaataataagagccatctatgacaaacacacagccaacatcatactgaacaggaaaaagctggaagcactcccttaagaatagaaagaagataaggatgcccactctcactacttctattcaatgtagtattggaagtctagccagaacaatcaggcaagacaaagaaataaaagccatcaaacaggaaaagatgaagtcaaattatctttctttgctgatgatacaactctatatgtagaaaatcctaatgtatcgaaagaagtctagagttgataaatgactttagtaaactcctagggaacataatcaacatacaaaagtcagtagcttttctaagcaccaataacacccaagctgagagacaaatcaagacgcaatcccatttgtaatagacacacacacaaaacaaaacaaaacaaaaccaaataaacaaaaaacaccaaggaatacatgtaaccaaggaggtgaaagatttttgcaaagagaactacaaaacactgatgaaagaaatcagagataacacaaataaatggaaaaacacacaatgctcatggattgaaataactgatatcattaaaatgctcaaatcaatgtacagattcaatgctattcctttcaaactaccaatgccattttttacaaaactacacaaaaaccattctaaaattcatatagaaccaaaaaagagcccaaatagtcaaatcagtcctaagaaaaaagaacaaagctggaggcatcgcattatccaacttcaaactatactacaaggctacagtaaccataacagaatggtattgataaaaatcagacaacacgggcctgtggaaccaaatagagccacacaactacagcaatctgatatttgctaaagtataaaaaaaagcaatgggggaaaggactccctatttaataactggtgctgggataactggctagacataggcagaagaataaaactggacgtttacatttcaccatatagaaaaattaattgaagatggattaaagatttaaatgtaaggcttaaaactatacaaatcctggacataaacctaggaaatatcattttggatataagccttggcaaagaatttatgactaagtcctcaaaagcaattgcaacaaaaacaaaaattgacaagtgcgacctgattaaactattgtgctttggagcagcaaaagaaactttcaacagaataaacagacaactcagagaatgggagaaaatatttgcaaactatgcatccaacaaaggtctaatattcagaatctataaaaaacgtaaagaacaaaacaagcaaaaaaccaataaccccattaaaagtgggtaatgaggctaggcactgtggctcatatctgtaatcccatcattttgggaggcaaaggcaagaagatcacttaagcccaggacttcaagaccagcttgagtgacttaagcagacccaatctctacaaaaataaaaaataaaaaaattagccaagtgtgctggcacattcctgtagtcctggatatttgagaggctgaggtgggaggattacttgagtctgggaggtcgaggctgcagtgaacatgccactgcattgcagcctgggtaacagagcaagaccctgtctccaaaaataaataaacatataaataagaggcaacaggatttgaaaagatagttcttaaaagaagacatacaggcagctaacaaacatgaaaaaatgcccaacatcactaatcatcaaagaaatacaaatcaaaaccacaatgagataccatcttacaccagtaagaatggatattatcaaaaagacaaaaaataatagatgctggcaaggccatggagaaaagggaatggttatacacttttggtggaaatgtaaattagttcagccactatagaaagcagtttggggatctctcaaagaactaaaaaagatctacttttcaacccagcaatcccattactggatatacacccaaacaaaaataagtgtttctactaaaatgacacctatacatgcatgtttatcatagtactattcataatagcaaatacatggaatcaacctaggtgcccattaatggtgaactggataaagaaaatgtggcaacaatatgcagccaaaacaatagctcaaaatcaggtccatttgcagcaacatggatgcaactggaggccatcatcctaaatgacttaatgcagaaacagaaaaccaaataccatgttctctcttatgagtgggagctaaacattaggtacatatggatataaagataggaacaacacacactggggactactagagagagcataggagaggggaacaggggctgaaaaaatacttattgggtattatgctcactacctgggggttaaaaccattcctaccccaaacctcagcatcaggagatatactcatgtaacaaacctgcacatgtagcccctgaatgtaaaataaaagttgaaattactaataaaaaatcaacacgtatgctaatactattgaaacactactctctaaagtgggttaactttgttgataagtgtacagagttaatgatgctccacgatgatcctttcaatgtgtcttacactatcctgaggctttatactgtgctaaggctatgaatgacaatgcctcaaaccagatattgtacatgaactttaagtggaacaatcaaaggaactttacaaagagcacaggccaatgttagaaccagccctatatcttaaagtctgctcagagggcaactgagcatcctttattgaaaggaatagtgtgtgtgtgtgtgtgtgtgtgtgtattttatataaaatatatttacacatttccatgtttaaaatgtatacatactttgaaattttaatttactataatatattttgaaaaccagctactttttctctcatagatgtggagtaaaactaatttaaatcagcattctttaccatctgctgagtataactcactacttgctctaggaagagaagctagttctaagtccagcacataaaacctttaccaaaacacatttcagctctttggcatcatggctcaagaacagactgtgcctgctgatcctctaccaaatgatttgactccagtttattgattctctttaagggtaacaaaccaatctactgctgtaagacagcaaaaatacaattgcctaaaatctcacaaggcagcttctcctgagatgtgaaaataaaggagaagcagtccatgtatttgcatcaacaaattgcccaaagcaattctgcatcagacccttccacatcccctgcagatgtatttcattccaccttagaatgtgatcaagttgacttacctattaatgagaaacaactgaaaggaagcaattaggcaggtgaggttccagtttaggggacaaatattttaaatactgttaatggaaatccagagcaatctaaacataaatagactttgtattcattgtctcctttaacctgggctgcattaataagaaattaattgattcttgacaactttaatgagtctttattaactgcataattgacaagaaaaatccatggatgtaataagcatctaatttcttagagccaatgtgattgactgattgactgaccaagtcatgacttactttgagaaatccctgcaatgtgctgagccatgtctccacaaatatctaggcaaggggaaacttctctggtctatgtttccttctttctttacctatctaaataagagaaagaaactgtctggaggcaacatttggagtagaatcagcactgggtggataatcctagccccatttttattaataactttctgtgtgacttttataaatttttatgtaatgtttttagtaattctttgtcacttatttcttcctgacttccactttctcatctggaaaacgataaggattaactcaaaatttcctttgagctctcaattatatgtttctaaaggtaaattacatggtgatatggtttggctgtatccccagtccaaatctcatcttgaataagatgagggagggaccttgtaggaggtaactgaatcatggggggagtccccaccatggtattctcatgatggtgagttctcatgagatctgatggttttacaaggggcttttctccctttgctgggcacttctccttcttgtccccatgtgaggaagaacatgtttgtttccccttcagccataattgtaagtttcgtgaggcctccccagccccatggaactactttgagtcaatgaaacctctttcctttgtaaatttcccagtctcaggtatttcttcacagtagcatgagaatggactaatacacatggtgacttctgtatcttaacgaccaaatcagtaatcaccatcctgtcatctaactccaaataaagtctctgcttagcaaagtaaatgccagctagtcattatcattaacattctttaaacattctttttattcatagtttaggtcagttatcttcaaaatgtggtagtttcaagttcaccagagaactttctagaaatgtaatttatcagcccattctgatttgaatcagaaattctgggagcaagccgcagtaatcagcgttttaacaagtcctcctgatgaatctgacaatgctaaagtttgaggttcactggtatggagaaatatttcctgtttcacatctttaactcattttgaaaaacaaaacatgctttatgaatggctatatcatcgtaggtggccattgtccataagactaaccaactgatactgtgtgggtctttgttcagacacatatccacccaactcccatttcttctttcatctctgcaatataattattgttttatcaactggattcacagaagaaaatgtagacttacagagcactttagaatttccaaatcagggttgagccaagatggccgaatacgaacagcaccagtctacagctcccagcttgagcaacgcagaagatgggtgatttctgcatttacaactgaggtaccaagttcatctcactggggagtgacggagagtgggcgcaggacagtgggtgcagcgcaccgagcatgagccatagcagggtgagccattgcctcacctggcaagtgcaaggggtcagggaattccctttcctagtcaaagaaaggggtgacagatggcacctggaaaattgggtcactctcaccctaatactgcacttttccaacggtcttagcaaacggcataccaggagattatatcctgcacatggctcagaggattctacacccacagaacctcgctcattgctagcacagaaatctgagatcaaactgcaaggctgcaggaaggctgggggaggggcgcccaccattgctgaggcttcagtaggtaaacaaagcggccaggaagctcgaattgggtggagcccaccacagctcaaggaggcctgcctgcctctgtagactccacctctgggggcagggcatagccaaacaaaaggcagcagaaacctctgcagacttcaatgtccctgtctgacagctttgaagagagtagcggttctcccagcacccagctggagatctgagaatggacagactgcctcctcaagtgggtccctgacccctgagtagcctaactgggaggcatcccccagtaggggcagaatgacacctcacatggccgggtactcctctgagacaaaacttccagaggaacgatcagacagcaacatttgctgttcaccaatatccgctgttcttcagcctccactgctgatacccatgcaaacagggtctggagtggacctccagcaaactccgacagacctgcagctaagggtcatgactgttagaaggaaaactaacaaacagataggacatccacaccaaaaccccatccatacatcaccatcatcaaagaccaaaggtagataaaaccacaaagatggggaaaaaacagagcagaaaaactggaaactctaaaaatcacagtgcctctcctcctccaaaggaacgcagctactcactagcaatggaacaaagctggatggagaatgactttgatgagttgagagaagaaggcttcagatgatcaaactactctgagctaaaggaggaagttcgaacccatgacaaagaagttaaaaaccttgaaaaaaaattagatgaatgtctaactagaataatcaatgcagagaagtccttaaaggacatgatggagctgaaaaccatggcacaagaactacatgacgaatgcactagcctcagtagccaatgtgatcaactggaagaaagggtatcagtggtggaagatcaaattaataaaatgaagcgagaagagaagtttagagaaaaaagaataaaaagaaatgaacaaagcctccaagaaatatgggactatgtgagaagaccaaatctacgtctgattggtgtacctgaaagtgacgaggagaatggaaacaagttggaaaacactttgcaggatattatccaggagaacttccccaatctagcaaggcaggccaacattcaaattcaggaaatacagagaatgccacaaagatactcctcgagaagagcaactccaagacacataattgtcagattcagcaaagttgaaatgaggaaataatgttaagggcagccagagagaaaggtcgggttacccacaaatggaagcccatcagactaacagtggatctctcagcagaaactctacaagccagaagacagtggggaccaatatttaacattcttaaagaaaagaattttcaacccagaatttcatatccagccaaagtaagcttcataagtgaaggagaaataaaatactttacagacaagcaaatactgagagattttgtcaccaccaggcctgccctaaaagacctcctgaaggaagaactaaacatggaaaggaacaactgataccagccactgcaaaaacatgccaaattgtgaagaccattgaggctaggaagaaactacatcaactaacgagcaaaataaccagctaacatcataatgacgagatcaaattcacacataacaatattagccttaaatgtaaataggctaaatgctccaattaaaagacacagactggcaaattggataaagagtcaagacgcatcagtgtgctgtattcaggagacccatctcacgtgcagagacacatataggctcaaaataaagggatggaggaagatctaccaagcaaatgaaaacaaaaaaggcagtggttgcaatcctaatctctgataaaacagactttaaaccaacaaaaatcaaaagagacaaagaaggccattacataatggtaaagggatcaattcaacaagaagagctaactatcctaaatatattggcacccagtacaggagcacccagattcataaagcaagtccttagagacctacaaagagacttagacaaccacacaataataatgggggactttaacaccccactgtcaacattggacagatcaatgagacagaaacttaacaaggatatccaggaattgaactcagctctgcaccaagtggacctaatagacatctacagaactctccaccccaaattaacagaatatacattcttttcagaaccacaccacacctattccaaaattgaccacatagttggaagtaaagcagtcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggaacataacgaaatgaaggcagaaataaagatattctttgaaaccaatgagaacaaagacacaacataccagaatctctgggacacattcaaagcagtgtgtagagggaaatttatagcactaaattcccataagagaaagcaggaaagatctaaaattgacaccctaacatcacaattaaaagaactagagaagcaagagcaaacacattcaaaagctagcagaaggcaagaaataactaagatcagagcagaactgaagaaaatagagacacaaaaaacccttcaaaaaatctatgaatccaggacctggttttttgaaaagaccaacgcaattgatagactgctagcaagaataataaagaagaaaagagagaagaatcaaatagatgcaataaaaaatgataaaggggatatcaccaccgatcccacagaaatacaaactaccatcagagaatactataaacacctctatgcaaatagactagaaaatctagaagaaacggataaattccatgacacatacaccctcccaagactaaaccaggaagaagttgaatttctgaatagaccaataacaggctctgaaattgaggcaataattaatagcttaccaaccaaaaaaagttcaggaccagacggattcaaagcctaattctaccaaaggtacaaggaggagctggtaccattaattctgaaactattccaatcaatagaaaaagagagaatcctccctaactcattttttgaggccagcatcatcctgataccaaagcctggcagagacacaacagaaaaagagaattttagaccaatatccctgatgaacatcgatgcaaacatcctcaataaaatactggcaaaccaaatccagcagcacatcaaaaagctaatccaccatgatcaagtgggctttatccctgggatgcaagactggttcaacatacacaaatcaataaatgtaatgcatcatgtaaacagaaccaatgacaaaaactacaagattatctcaatagatgcagaaaaggcctttgacaaaattcaacaacacttcatgctaaaatctctcaataaattaggtactgatgggacgtatttcaaaataataagagctatctatgacaaacccacagccaatatcatactgaatgggcaaaaactggaagcattccctttgaaaacttgcacaagacagggatgccctctctcaccactcttattcaacatagtgttggaagttctggccagggcaatcaggcaggagaaagaaataaagggtattcaattaggaaaagaggaagtcaaattgtccctgtttgcagatgacatgattgtatatccagaaaactcaatcatctcagcccaaaatctccttaagctgataggcaacttcagcaaattctcaggatacaaaatcaatgtgcaaaaatcacaagcattcttatacaccaatagcagacaaacagagagccaaatcatgagtgaactcccattcacaattgcttcatagataataaaatacccaggaatccaacttacaagggatgtgaaggacctcttcaaggagaactacaaaccactgctcaacgaaataaaagaggatacaaacatatggaagaacattccatgctcatgggtaggaagaatcaatatcatgaaaatggccatactgcccaaggtaatttacagattcaatgccatccccatcaagccaccaatgactttcttcacagaattggaaaaaactactttaaagttcatatggaaccaaaaaagagcccacatcaccaagtcaatcctaagccaaaagaacaaagccggaggcatcatgctacctgacttcaaactatactacaaggctacagtaaccaaaacagcatggtactggtaccaaaacagagatatagatcaatggaacagaacagagccctcagaaataatgctgcatacctacaaccattggatctttgacaagcctgacaaaaacaagcatggggaaaggattccctatttaataaatggtgctgggaaaactggctagccatatgtagaaagctgaaactggatcccttccttacaccttacacaaaaattaattcaagatggattaaagacttaaatgttagacccaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaacagcttctgcacagcaaaagaaactaccatcagagtgaacaggcaacctacaaaatgggagaaaattttcacaacctactcatctgacagagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaaggagataccatctcacaccagttagaatggcaatcattaaaaagtcaggaaacaacaggtgctggagaggatgtggagaaacaggaacacttttacactgttggtgggactgtaaacttgttcagccattgtggaagttggtgtgggaattcctcagggatctagaattagaaataccatttgacccagccatcccattactgggtatatacccaaaggattataaatcatgctgctataaagacacaggcacacgtatgtttattgcggcactattcacaatagcaaagacttggaaccaacccaaatgtccaacaacgatagactggattaagaaaatgtggcacatatacaccttggaatactatgcagccataaaaaatgatgagttcatgtcctttgtagggacctggatgaagccagaaaccatcattctcagcaaactatcacaaggacaaaaaaccaaacaccacatgttctcactcacaggtaggaattaaacaatgagaacacatggacacaggaaggggaacatcacaccggggcctgttgtgggttgggggcgggggagggatagcattaggagatatacctaatgttaaatgacgagttaatgggtgcagcacaccaacatggcgcatatatacatatgtaacaaacctgcacgttgtgcacatgtaccctaaaacttaaagtataataataataaaaaaaagaatttccaaatcacttttcttaggtaatagtctctgatttttactcactataatatagataatgaaagctcaaagtttaagtgattttacaaagttatatggccaataaatgcaagaactgggacatgaaattatcaccgaaatgcactaccttcagttttcaatgacattttcaacaagttgtaggaaaagaaagtaaccagatgatttttaaaaactgttattcttggccgggcgctgtggctcatgcctgtaatcccagcactttgtgaggccgaggcaggcggatcacaaggtcaggagatcgagatgatcctggctaacatagtgaaaccctgtctccactaaaaatacaaaatttagctgggcgtggtggcacgtgtgcctgtagtcccagctactccggaggctgaggcaggagaatggcgtgaacccgggtggcagagcttgcagtgagcggagatcgcacatgggcgacaaagccagactctgtctcaaaacaaacaaagcaacaaacaaaaaaaaacttttattcttaaaacataagaaaattggggcccaggattaaaaaataacattttctaaaggaaaaataattagtcttcatgtacctgtgccataatgcttttatctgtaaaactgatgtcaaagtttataagaatgattaatggtaacacaatttataagaaactcatttcactcataagtcatcatactaatgcaaatttttacaaaatccccaagaaaccagtttaaatttaagattaaaaatagatttttgaaagatgataggcaatacgaacaaataagaaaagtgtaaagcataaacaaatccaataatatattttaaaaaatattctgaattcaagtgttcaaagtaagagtaacagaaagacaatattctggctaatcctcacacattcgactttttctctgcattactgtttaaatcaagatatcttcactacttccaacagtatttaataattgttaccctaagcaacaaaatatctaaaactttgaaacagagatcttaagtaaacagaaaacatctgctatggtttgaatgtttgtgccttctgtaactgacactgaaatttaaccccaatgtaacagtattaaaaggaagggcctttaagaggtgataagagttatgaggcctcatgaatggactagtccattcatggcttcatggattaatgggttaatgaattaatgggttaataggttaatggattgatggactatcacaggaacaggttagttattatgagagttggactgttataaaagccaggctggctctctcttggtgctctcttgccatgtgatgcccttggccacctcaggactctgcagatagtatctgtcagcaagaaggctctcaccagatgtgatatcttgtcttgagattccccagcctccagaactgttagaaacaaattttttttctttataaattacccagtctcaggtattccattatagcgacagaaaatggactaaaacagcatctaacatatatattttttcttttcagcaaacagttcttcaagactgtaatgatgaagaactcaaactagggcacatgttaaccagagttgctttacaaaatgtttatgtagagctttaaaaaaaaaagtggctttactcagtgtagaagacagcagtgctataaattaaccccaaggcccacatctcgtgatgcatttgacagtttatcagttctagggaatgtgtgcaggcaatttaaatgaaagatgaaggcaaaggctccaagggctcgctattaaacacagagcattatttgctgtaaatatctgcatattcaaaaggttgagagagcatggtcaactcgattcacttggtttcattagcagaaacatcactgtggaaatctctgttattactgacttaaaaggtttatagttttgaggaaaaagggtgttcaaagttaacaaattatttaacttaaacaatgtaactttataacccttctaaaatatatacgcatgatggattataagtaagtggattataaataaatatcaaattatataagtaatgatatttggcatttggaaaaattttcaatcaatttttcttatgttttaaacttaaaaaaagaatgattcttttttcaaatcagattgttaggcttcaataagaactaacttctcaaaatgaatggagtttagaataaaatttacttgtcaacctatatgacaaatcaagttaatttgggatataattttcattcagcatgcagtcttaagaaagaccctgtttatttcctgcatttctttgagcacctttattatatttcagaatctatttcactttctatataaatatatttctagcatctggtgtacttgaaactatctttaggctcatgtttagttgttctacctagagtttttagcattttccttgtcctcaaaacttgtcagcacaatacaaaatatccacaaaagccatacaatgaggctgcatgaataaattaatctggtcgcttaaacaggtaaagctcctcattgtaaaataatataaataagcatatacgacactaaataaaaatgtcttctgttttgaatctatggaagtgattgaggaaacctatcctctaaatgggatatatatatataatataatatataaaaatataatattaaaaattatatgtatatatttgagacagagtctcactctgtcacccaggctggagtgcagtcgtgcaatctcggctcactgcaacctccacctcctggcttcaagcgattctcgtgcctcagcctcctgtgtaactgggactacagatgcgtgccactacgcccggctactgttttgtatttttagtagagaaggggtttcacctgctttataaaaatataaactgctctaattggcttttaccagttagagcataacaaccttcactttagtatgaaaagctgtattttcaacgatattcattgcctctttggcgtcattgccaccaactatgataacaaatagaaaatgtaatcaataatcactaacaaaaatcaccaacttactaagtagttttgtttaaaatgctcatttctaagaagaaacccagaatacttgttcaaggaatatattttataaatggccgttgagtttccagattagttggccaaatcctatttaaatcatgatataagtgagccaaaatactcacaatacagcccaatgcatttaatggaactctctagttttagaaaagttcaccttaaacatatttatcatatttatctaatttcatgtataaggaacacttctgaaggaaaaaagcaatcatcatttttaacccatatcaagggaagcatgtactttgtttcccaagttgaaggatcaaaaactcattaatctctcagaaagtctgcaggatcttaggcttgattctttttatactgatggcactcatacctgtggcagtagccactgttcttagaaggtttcttaccctttttctggagcctccagaatccaacagtgtcagaggcagtggtgtgctagagtcagctgaaaatggctttcaagagccaattaaatttaagaattttgactgtgttaaacataaccattattaaaaattaaatcatatgaacttataattaaacacactatattaaaatcaaagtatcataattcctccagctttgttcattttgcttaggattgccttggctatctgggctactttttggttccatataaattttaaaatgtttttttctagttctgtgaagaatgccactggtagtttaataggagtagcattgaatctatgaattgttttgtgcagtatggctattttaacaatattgattcttcctatttatgagtatggaaagtttttccatttgtttgtgtcatctctgatttctttgtcacttaagccacaagcaatcacaatgaaaacaaaaattgacaaacgagatctaattaaacttaaggcttctgaagagcaaaagaaagtacagacaacctacagggtgggacaaaatatttgcaaactatgcatgtgagcaaaggtctaatatcgagcatctataaggaacttaaatttataagaaaaataacaaagaaccctattaaagagtgagcaaaggacagacacttttcaaaagaagacatacatgtggccaacaagcatatgaaagaaagctgaatatcactgatcattacaaaaatgcaaatcaaaaccacaattagatactatctcacaccagtcaaatggctattattaaaaagtcaaaaaataacagatgctggtgaggtggcaggagaaaaggaactcttatatacactgtttgcaggagtataaattagttcatccgttgtggaaaacaatgtggcaaatcctcaaagacctgaaacagaaatgccaaatcaacggaatgtaaattgttctatcataaaggcacatgcatgcatatgttcactgcatcaccactcacattagtaaagacatggaatcaacctaaatgtccattaatgttaaactggataaagaaaatgtcctacatatacaccatggaatactatgcagccataaaaaatgatgagatcatgtcctttgcaggaacgtggatggagctggaggccattctccttagcaaactaacacagaaacagaaaaccaaatactgcatattctcacttataagtgggagatgagtgatgagaacacatggacacatagaggggaacaacacacactagggcctatcagaggatcagggtgggaggagggagaggatcaggaaaaataaataatggatactaggcttaatatcctggtgatgaaataatttgtcatcacactcctgtgattgtaagtttacttatataccaaacctgcacatgtacccctgaacttaaaagttttttgaaataagtaaatattcaaactcataattttctatttatttaataacatttcccttctatttttactcttcagcatattttacctatttgatttgtatggtggaaatactacataataatatgttattgcacgtattttttcaactcctcattcaatgatgttggttgaatttggccatgtagaagtatttgcaccatgggaattaggaaacactattaattaggggttttttcttctggagagctggcttctccaggcaaactctaccatttatagctaagagtgatacttaaccaacaagaagatttcacatttaaaacagaaaacaagacacttctccatgacattcatatgacactttttaatattttcataagaatgaaattgagacaaaatgaaaaacaggaagtattgaaaggaaaaaatgtcaccacattgcacctgaataggcattataaaggagagttgaggaagaacaagtaaaaatgtctggagttggttatatatacttaaatcgttaatgttatttcttctttctcctgcttttgcaatactgaccaagcacttggtcccaagataccgacaggatcccaaccttgatgtgatggaaggaaaataggcactacaagcaatgaatcagagtcagtttacctctgttaaaatcctaccttggctatctgccagctaagtatgtatagccttcataagctttagtttcctaatctactaagtagtcaacataagagtactttcctcataaagctgttgggggtttaaatgatataatgtgtgtactgcagaggttgtcaaacctcagtgaacattggaatcccctgggaggtgtgaaaaactactgacactccgggtctcaatcatacagatccaaacttaattaatccagagtggggctgagtgtattttaaacagtctccaagatgattctgtcatatagtctgtgttgagaactactgttagccattactaccagtaatccatcacaccataactgtctaaagaattaccaatgggcaaaggtatacatacaggaaaaacatgtttattaatttgttcacttgccaaaagagctcagaaattagagatttctttactctcatcactcaacccttcaatgagggtggagccaccatttaaaatttttatcacactcaagaaggcctcctaaaagtggatgcattctgagatccatttactaaagtgaaagggacccaaatcctttctaagcttatttgaaaggagcctctttgcttttgtgttactttgtgtgcacaatttagttaaagccttgagtgaatcctcatttccaccaagttccattgctgccactcacgtccaaaccactaccatatcaagatggacccttactcactagtgcttcctgtttggacttcctgctgcctcatatatctgaccttcagtacatatttttgcatttgtcaaggatatttttaaaacacacaatttatcttcttattcttactctcgaaactctcctttgatgttttcctatcacctttattcaaagtctccctacaaggccttttagagctggtccccagcttcctctctgacttaattcatatgcttctatcactcactccactccagcttctctgacccctttgctattccttgaacacatcaagcaagctctctatttaggtccttcacacttgctcggccctctacctacaatattcttccactccaaatgccatggttctctcccccttcctttggatacttgctcagatatcatctcagagatgtttatgatcactctaagattataacccctactgttgtcacccctatgccaactgttgtcactcttcattcgtttatgaaactctatgttcctttactgcactgattaatcctattaattataccatatatttattttttaatgtatcttttctccatggaacttgagctgtatgaaaggagaaaccttagttcttttgcttgcagctgtatacccagcatataaatatgaatatagagtgggaactcaataaatacttgttgtgtagataaataaataggtagtcaagatgagttgcctacaagtcctgtgagtcccagaaaattctagaattctttcagttcattgattaaaactgcaagaccaattagcttcacaacagatggcgaacctaaagccaagcagccatcttgctaattctggcatctgtcacaagacgaattaggagcatggatagatcagttaagattcagcagcattataggaaacacctcaaacccttgtccttccagcatttgtgttttcatgaaatgtgaaaaagaccccactgtaatatctataagtttaaggagcagggattaaatcaacttaaattctgttgttagtgatttaacagaaaaaattatcctatatttatatgtgatttgaaaaattcagaccaatacactaaacacagttatttaacaattttctttttaataagcttattgtttataaagcagacaatattacagagagctcaatatatgaaatgtaatgaatgcaagtgtgtgatagaatgatttaaaaaataaaatttccctccacggtaccgatgatagctgctaagaagtttggaaatagatgctatccaatgttattatcattatatcatcattgttaataagcaataatgaagctaatgtttcttccctggaagtggtagaacaacaacaaaaaacctgtcagaaatattcaagcaagcactttggttattttggtgttcagtgacaccagagatggtgagaatcattgtatgaattcatcaattttgttggtgtcatgtagacacagccatgctcaaatgaaatatacttttttttttttaagtaaaagggcttctattcaccgtacaggaaattaagtgatcggttcttgtcaaacaaaaagtaaattgttttaaggaaaaagaattcttttgacatttagtcaaattttattctttcaggaaacaagcaattctttgacagaaaaatatgttattgccagaggatatgtattcctcttttatattttgctagttttctattttctcagcacataaggaacagatggaaataaagccgatccaatgaaataatttcttttacatcccagcaataaggaaaactaaaattcaatgaaatgatctaaccaaatttccacatatatgtatacgtattttggaaactttataggaagtgtaaaaccaaagagaaatcatgggaattattaaaataatatttactttttcatttcctttcagacaactttatagttgttatttgtattcttctgtaaattctcattttcccctagatatgaatgcaaaaagctatactacttgctccaaaatgatgtttagttttcttagagagtttttcacactcagaataaattatactccctaggactgggcctaatcatacaactttagaaagagaatatgaatactctcatattgctggctggtaaactaacttttttccaatgcacttcctatgtttacctcatgacagtctatcacttggattttaaaataaaatcattttataataaaattatttgctttcaaaccaaaccatagtaccaatataagcaaataacctggagcaacattgggaacaattaatttgtctcaaatcaaatatttaacctacctcagatcatattcatagagtcaaactcatggtgattaagaaccatggcggccattcacatgaatttagaactcttttagaagccggagttctacaattcatatccacatgagaaactgaaacaaaaattaaggcaaatttcacatacagaaaatcaatagaacttttcagtgggttgcttgtgtgaaacatgcaaactttccttttacctggcagggatatatcctgtaatcaatgacgcttaatatcctttagttaatgacactaaacacaaaagctcaattggacccctgttggtagttctcccgggcaaccagcagaaacaaaccctaggaagtatgaaaagctaaaatcgagggaaaaagtagggaagatattgtaaacaatacatgacacattcaaacattttagagactggatcctggaaaagagcagttctagcacacagctttcccagcttagcttcttctcagattcccccaaattaccagggtcattctattactagctgacctgagtgaagagtgacagagaggaagtgagagaggaaagagaaggcagtctgaactcattgtccttaaaatagcttttgcaaaattttctaaaacatatgaacatgtgaacacattgctagggccactttctcgggattcatgcaagtgggagttcctgaatctttttttttttttttttttttttttttttttttttttttgagacagagtctcgctctttcgcccaggctggactgcagtggcgctgtcttggctcaccgcaagctccgcctcccgggttcacgccattctcctgcctcagcctcccaggtagctgggactacaggcgcccgctaccacgcccggctaattttttttgtatttttagtagagacggggtttcaccatgttagccaggatggtctcgatctcctgacctcgtgatccgcccgcctcggcctcccaaagtgctgggattacaggcgtgagccaccgcgcccggccgagttcctgaatcttaagctgtgtgactttgaaggtacatttcccacaatcactggaacacaatggtagtacagattaagcaaataagacaatggagtgagaaagtgaagttaaagccatagcttttattctttatcttgtttttaagaatttggtgccatatatttaaaatgtccctgacatacattttgacatacagaatttttttaccacctctctttgtcaccaaaggcaaaagtgtgtgtgtgtgtgtgcgtgtgtgcatagaaaaatacgcagttattagctttgaataaattgtggaactgactgaacaacttgagatatttatggctaactactaagtatttaaagatgtataactatcctcttctttattccctgttgcacagtgaatcagcggcaccaaatcattgtctatatgttttttaaatttcaaaacccttgagagctgcacagaaataaatcctctgtcatttacaaatgccattcttgtcttatttttaactacatctctaggacttacttcatttggggcttgtaataggtgggacagctgattcaaagaagtacaggcagattcatcagtgctcagccagtggctgcagctccactacaccttcccaagttctcagacaatgacataatctgattctaagtgtagaagaaagataaaattcatgcatggggaaatatgattttgccagaggagcgaaggatgctagaagacgtgtatgaaatcagaataaaatttcagatgaagaagaaagacaatagaagaaaatttccaaaaatatggaatataacattaggctaagactttaaaaattctatgaaaaaaaatcaataatactagtggtcctgaagaatggaagaaaacattttcctttttaccttggggaggataaaatcaaatgtaaactctgtgtcctctaatactgttagaagatcatacatttgaaagctaatacagttctctataacttgtggttaacactgcatgcatagcatactaaataataacgcagttcttttttttttttttttgagacagagccttgctctgtcactcaggctggagcacagtggcaccttctcggctcactgcagcctctgcctcagcctcctgaggactacacctgggactacagacatgtgtcaacacgcccaactaatttttgtatttttagtcgagaccgggttccaccatgttggctaagctggtcttgaactcctggcctcaagcaatccacctgcttaggcctcccaaagtgctgggattataggtgtgagccacccctcccctggcccccgggcaataaagcaattctcaatgttcactgtttacaaaagttttaggagaaagaatgaaccataagacaaacaggtcttcagttcgatggcacaaagcctctttgcttttttcctatttcttcaaactgtttattttctttctatgatttttcttccttcatctacctgtcaaagagtattgttcctcaaggattcattcccataggtaggtattatctttcttttctgtatgctctaccttataacctccctctccccatcattttacatatgctcttgctgacttccataatcttatccctaggcttactctccctgagtttcaaacctttatcattatttacagaatgtttccagttgaatattccatggtaactacttcttcagcatttctcaaatgcatgtatactctctccaaactctttcctacaatgtgttgcaattttcagtaatgacaccgtgccgtgcaagccaaaacatttggaagccatctagaattctctctctgtctcactcctctcaccttgaccccaaggttaggagcaacttaaattagtaatcagttgcttacttcaaagtctgcttacaccacttacctagttgtatgaccttggatagggcacgtagccttctatacctctgtcttataaggttaggatgattaactggataatgcatgttcagtatttagtgcattgcctggcatttactaagtgctcaataatttgttattgctcagctccatgcattcacacatgttgtttcttctgcctagagtgccctttccaggattttattatgatttagatgtcaggctgattgtagagagcagagacagctggaatgctgtctttgctgatagatggtcttctggttgtaacaagtgtcctttgaattatgagcaataaatctcctctaatttaatttaaggtacaggtgatttggattgttgcttttacttctgaaggggaaattgaatgcatttagtttggtgtggaggtaaggggtcacataccaaaaacatgatctaacccctaacagtgattctctaggacttgaaaaatttgtctatgagtttatagaatgaaaaaataaaagataccataaagaaaagtttgtcttacccacattcaaactttcaacacctaaaagagttcctggaccatagcagcaagtcttcagtatttatagaggaaaagaaagaagaaaagaactaaagcagaagaaagacagaaagatggaagcaaggacatgaaaaagaatgacatacataggtaggaaaagatatttctgaatgtagtcagctactactaatatagaaatgcagttacataataaaaatgtaggcatgttgattgttattagtaaactgtatgtgggccctgaagtgtctccactataatcgtgggaacacccacaccaccatgtcctttgtggtgggtagctgattctgtcaccgctagaaaagttctcctttggtacctgaaatggctaatactccctcttcattttctcttccgtttcattgctttcgtctagttacattttgaagatggctgaaactttcactgtctttggggtttgcaataggtagttgaggtctctcgtctatcatcatccttatttacctgcatactgatgttgacttggtttttatcaccatagagtaattttagccacatctgtgcttcaatagttaccatccctgagagtggagaggaatctctaccaacatggtttataatattttatccagccttgaaattcagtgatttcactgtcttttccttataatgttcctagtgatgcaaacattttcattcacacattctccaaatttgataattctcttttataagttataaaggaggctgagttgtagccaagcaggtagtgctatttttggtcaaggatgatatgctataataaagcttatagaaattataaacatctctagggtcagtttctaaatgggagcttcatacacacacacatacacacatatgtatatatgtgtatgcacacatatatgaatgcatatctatacatatgcacatatatgtatatttaaaagtaatggcattaattgctttgccttaagccatgtggaagggggaggaaaagcttaagcagggctgagtgttgttactatgggtgagtctcagcaagtccagccgacctttgatctcaaacaaaaactagacaatgggtgtatgcatttgagaaatcattattgctgaagttaagggattaaaacatttgagagtagaggtgggtgaaatagtgggtgggaggaggctactgcaaactactgaagacagggagaaaccctgggtagagaatgttccgaagagaggacagaagcccaaaagccctctttaaatggcctgagaccctttgttccaaaagaagagctagctcaggtgcaaggggtccctttgttatctttggtcagattccttaataccagatgttaaatcattcttctgttgggcttaaggtaggatgagaatttaatagggaatatcatgttttctcaatgcttgataaagattatcaccctggggtacacatgtttaattttccctcagaccatattattgggtttcatatcttttcctaacttggattaaaatctgggtggtgaatcttgtaggactggggtttattataatgatttttccaagctcgctaagtgaaagggcaacatagtagctaaaattcagtctgattttttctagtcaaaccttgttgacttttgtatactaaatacaagattaggattttacaatgaagcaaataaagctcagttctgctatcaaatagaattccctttttcctttggcttcctgaaggctcttaaaatctaagtatattcatttacctgactgtcacaggatttggaattacctatttccactaaaaaattaggcctctatttttccccaaattcattttgcaagcagagagataaaccgtgtctaataagccaaaatgtttcagaaaggaggtgtggggtctttcaaaagttaattaagataaaacaggatacaaacaagtaaacaactaaactaaaatatatttaactatttaaagcactgaataaaataaactagctttatctgagggatgtaaagagactttatgaagaagggaatattggagttacatatgaaaatacaaaacaaatgttctaaagaaagaggaggagaggagatgatgtcctacctaaaagcaacagcatatgcaaagacagtaagttaggggggaaatgtggtatatttgagagacttggtttggttggaacatcaggtatattgtagagtgacagaaagtgaagttggagtagaatgctataagtacctgtgggctatgccatagttcccaaaattattataccatcaagtaaaaaggagggaaactaacttcagaatctatttggtagaagaatgttgtcattatatttgttttacagaactatgacaccaaagtctctgaaataggaagtataccagtgtttaaattttggcatttcatggaattgtctcttttgttgacacagttgacagtaattcttaaatacagctgggtggtgaactctggggagttggccagacagaaagatttatttagttttctcaaattacatcaacgagtcaggcttcaggatcctgattgtgacctaaaatgactgggctgatattctaagacaagaagaatggatgaagggtgagaaattcattacaaataatatttagaggtagattaaataagctcatttgtgtaatatgattcatgttggtgtttttgaaaccaaatcaactgagaaagaaaataagctgatgctgagagcactaagaacagcctttagattccaagaagcaatttcatcaatgaatgtcatgtgaactttagagcaactaactgaatatgtctggaaccaattaacatgtacctattgaaaacatattatgtattcaatattttgctagaacatatatgtagatcactactatagaatgttgtgcagatagaaaatagaaagaaaaaaatagaagaaaacctaggcaataccattcgggacataggcatgggcaaaaacttcatggtgaaaatgctgaaagcaattgcaacaaaagccataattgacaaatgggatcaaattaaactaaagagtttctgcacagcaaaagaaactatcatcagagtgaacaggcaacctacagaatgggagaacatttttgcaatctacccgtctgacaaaggtctaatatccagaatctacaaggaacttaaacaaatgtacaagaaaaaaaaaaaaaaccccatcaaaaagtaggcaaagaatatgaacagacacttctcaaaagaagacatttatgcggccaacaaacatataaaaagaagctcaacatcactgatcattagagaaatgcaaatcaaaaccaccacaatgaggtaccatctcatgtcagaatggcaatcattaaaaagtcaagaaacggctaggcgcggtggctcacgcctgtaatcccagcactttgggaggctgaggtgggtggatcacgaggtcaggagatcaagatcatcctggttaacatggtgaaaccccgtctctactaaaaaaaaaaaaaaacaaaaaaaattagccaggcgtggtggcaggcgcctgtacttccagctattccggaggctgaggcaggagaatggcgtgaacccaggaggcggagcttgcagtgagccgacatcatgccactgcactccagcctgggctacagagtgagactccatctcaaaaaaaaaaaaaaaaaaaaaaaagtcaagaaacaacagatactggtgaggctgtggagaaataggaacacttttacactattggtgggaatgtaaattagttcaaccattgtggaagacagtgtgatttctcaaggacctagaaccagaaacactatttgaccgagtaatcccattactggatgtatacccaaaggaatataaattattctactataaagacacatgcacacgtatgtttattgcagcactgtttacaatagcaaagacatggaaccaacccaaatgcccatcagtgatagactggataaagaaaatgtggtacatagagaccatggactactatgcagccatgaaaaggaatgagatcatggcctttgcagggacatggatgaagctggaatccaacattttcagcaaactaacacaggaacagaaaacgaaacactgcatgttctcattcataagtgggagttgaacaatgagaacacatggacacagggaggggagcaacacattctgggtcctgttgtggggtgggtggcgaggggagggaacctagattatgggtcaataggtgcaggaatccaccatggcacacgtagacctatgtaacaaacctgcacattttgcacgtgaatcctggaacttaaagtaattcttttttttttttttttttaaaggaaaaagaattgtaaattataaccaagtcaaactttggaattaataaagtgaaaatttttccccaattcttcacttggtatccattatgccatttaaaaaccttaggtagtaatataaatgtaaaaggccttggataataacagaaaggtaataaatacaatttcattccagaaaatgagtaaagtttatatgtaacttggttctgtgaaataatggacatatctcaaatcttttacaaccacttatgaaagatttttttccattgatcttgcagagaacaaattttaagttagtaaaaattgtggtgcttttctcttgcccaagttaactattgcaaggtttcaagtacaacactagtctaatattccaacttcctaacgtgggaaaacggtactggttagtttggtaaatgttatacttatcctttatatattttctaattctttggattttacatctttctagaaacagctaaacataatttgataaaatgtctctagttcctcagggaaaggttctattcttgagcaaagtaaaatcttgacttgaatgtcttattaggaaaggaaatagtattttcatgtagcttgttttatatttcagattctgttctaaattcatttcctttgctacatacacacatttgcactcttgaccaataatctcaaagaactgaggaattctatggcctatgttttagtaagttgccttgtaactcccctttcaaaagtaactccccttccaagtttgtaataactgactttacttttctctgcttttgcttcccttgtctgtgtttatttactttttacttttagaattagttatgccacctaaatcagatgttctttaccatgattactgcaagctcagaatatccctaagaggtgagatacagtggaataagccctaaatttctagaaaattctttaacattgagggtgactttttttttcacagatagtggattataaaagttaaaaagtcacaaattgattgattaaccaactgtatctgaatatttgtattctccccaaatgtatatgttgaaattctaaccccaaggtggaggtattaagaagtgaggcctttgggatgtgattagataataagggcaaagcctcaggaatgggagtagtgcctttacaaaaaaggcttccaggaacttgttcgccccttccaccatgtgaggaggcaataagaagatgccatctatgagtctggaaattgtccctcaccagacactaaacctgtcagcatcttgatcttgaacttcccaccctccagaattaagttacccagcctctgctattttgttacagtagctctaagggaataaggcagtatctaaattttaaattataaaaaattatgtgtgtatatatatatatatatattttgttataattgtttttgcttaacttttattttaggttcgggggtacatgtgaaggtttgttccataggtaaactcatttcatgggagtttattgcacagattatttcattatccaggtattaagcccagtacccaatagttatcttttctgttcctctctctcctccaaccctccactcctaaatgctcatcaatgacagagtagataaagaaaatgtagtacatatacaccagggaatactatgaggccataaaaaagagcaagatcatgtcttttacgggaacacagatggagatggaggatattatccttagcaaactaatgcagcaaaccaaaaattatatttttaatttaaaaatgaataaagatcatcttttataatggattatcatattgtttcttaaaaacttccaatgatattcttaaactgcaagtttagcacttctgtgcatttcaataaacattaaattgaacagctactatgttccagggaatataaaattgctaggagctgcccttgaccctatacagttcataagacacaacaaatatgaaaatgtaggattactatattctgtgaaaaatgacaaaacaggtatgtacaaagtatagtgtgacttcaaggagaaagcaatgaactcagctgagttggtgtgatggttaatgctgagtgtcaacttgattggattcaaggatacaaagtattgatcctggatgtgtctgtgagggtgttgccaaaggagattaacatttgagtaggtgggctgggaaaggcagacccacccttaatctgggtgggcacaatctaatcagctgccagtaaatataagcaggcagaaaaatgtgaaaagagagattggcttagccttccagcctacatctttctcccatgctggatgcttcctgcccttgaacattggactccaagttcttcagttttgaaaccagactttccttgctcctcagcctgcagaaggcctattgtgggaccttgtgttcgtgtgagttaatacttaataaactcccctttatatatatatatcattcatatatatatcattcatatatatatatatcattcatatatatatcattcatatatatatatcattcatatatatatatatcattcatatatatatatatattccacttcatatatccatcatatatatatgatatgactaattctgtccctctggtgaaccctgactaatacagttgggcaggggctggcaaagattcccagaaagagagatagttaagctgaatcctcaagaagagaaatacagtttgggggtggagatcaagagaaagcatctgaagcagagggaacagctgttttggagcatggaggcaagaagcaatgtagtgacttgactggagtgcacagtgttcaggacaagattacatcatgtgaaaagccttctatattggactaagcattttgaatattagctagaagaaaattgatatggtttggctctgtgtccctgtccaaatctcatgttgaattataatccccaatgttggaggtggggcctgatgggaggtgattggagcatgggagcacatgtctcatgaatgttttagcacaatccccttggtgctgttctcatgatagtaagtgcattctcctgaaatctggctgtttaaaagtgtgttgcacttttgcctctcttgctcctcctccagccatgcacagtgctatttccccctttgccttctgccgtgattgtaagtttcctgaggcctcctcagaagctgagcagaaaccactatgcttcccatacagcctgcaaaactgtgagccaattaaagctcttttctttataaagtacccagtctggtatttctttatggcaatgcaagaatagcctaatgcaacagtgaagagtaactcctagagcatcagttcctttcctatcattctgttttgtctgtctaaagactctgtttattctttccatgtttgtatttaatgtcagtgtcaactaatttgacttgctgttatgttccatggtgcataacaagttagcacttaattagcagtaatgattttagttgtgtttctgtctgtactaggtggatctaagtattttataagtagacaaaggacatttttttaaaaaaggaaatgacaattaaaaagtgcaatatgcattatgcaaagtctatttcttaaacttcccagatcagtatcacctggaacactgataaagattccatgctcctaccctcccaataagaatctctgagggagaagcctgctacatgtgtattcaaggtgacatgaatgcctgggaaagcttgggaaatatcacttattccaagtatatttcttcacagaaagcccagaaaatttaagcattttgtttgcagattgagctaatgctaataaaagttcaaattactcacaaagcctcagcagttatggtgaattattggtggtttacttgccccttcaaatgaactgtaaactttttaaggacagaggatgtatcactattagagtctcagctcctaacacagataaaggattcaataaacatttaataacatatgaacaaacaacattgtgaccattctcatttttaaaaatggctcttcctgtgtgcatttctaggtgttcaactacaaagaacaaatgtaatttagtgaattattaataagactaaaaattcaattaattagacttactttggaatgaatggtgtacttttaaattattagtaaagtcaacaaaatactttttcatttcaaatatatatttgtcaaatatcataaagtataatgtttgtgtgaaataatttgatctgtcttttgtgccctggagtaactaacaatggtttttcatttcacatatattgcatttcacagaaggaacacacgatcaatcaaattgacacctgaaattaaaggcattggaattgatttccttaataaatactattcttcattaggaaggaactcctgattcatgaattttctcatatgtacagaaatatattgttagagaaaatagaggagtgaaaacagagaagacagaggagtgaaaacaactggacaaatacttaaaaaagtgtctcagtatggcaaaaaatatttttttaacaattgacatttaaaggacaaaatgtagcaggggccatatttttcattaacttgacaatgtcaaagagacggctcagtttcctacaagttaaagcagaagatcatgttaatgagataattttatttccttggaaactatcagaatagcgggtagaaaatacagaagtcatttataaaatattacttttcaaatatagaaaaaatgaattttgctattttcaaaacatactttgttttaagccatagctggaggagtaggtagagaaaatgccctggagaaaactttctgcattatctccacctgaatagagctttatatcaggaggttactatttgctcccgctataataatttcagaggatactactcatgatggagaaagcagagggcccacggtgtgaatctcttctggtgatttaatcacagtcattaaagaaagcaggattatgaacactgccagccaccagctgcaaatacaatatctgaaatttatttttgcaaatatactggcaattttatagcagtttgaatgaatactagggagagcctattcagttggtacatttactgaattaggcattgagttccagagagtgcaattgctgctagagttctattttaacattctcttgaaaagatgcatataaataaaattatattttaagcaccctagagagtatttacacacataggaaaaacctactctaagtccctttacaaaataaaattttactgaatgacctctaggtataaatttttttcaaattcctatgaatttataattatttcaaaataaaaagttgtataataatttactctctaaagtatcatatagctgggctttcgtaattttttttttgttttattttgttttacagaagagtacacttgttttatctcttcatggtttcatctttttttttctttttttaagaagaagagtacacttgtgcaccataggtagtatggtgaccagcttttcactcattcaataaatatttattgtgtggatatagataataatatggcaaggagtgggggactgcttttacataaggtcatcagaggaggagggtctctctgagaaggtggcgtgagcagaaacgtgaaggaagtaggggagaaaattatgtggatatctggggaaggagcctgacaatatatctcaatatactaattaagaatcatcattattgtaacatacgtttttatataagagagatggattatgcataatccttgatgcatagttcacatgtgagcatatggtttagaattgcaactaaagagtatagcagatgttgttcaaaacctacaacttaacaatcttttagattgtcttttagacatggaaatgttgtttatttcagtcttagttcctcatctgtaaaataggaacaacaatatcttggggtttttttaaataaatgaaataatatgtgtataatgcttcacacaaaatacgtacttaatgtagtagtgattatcatttaaaataacaaataaatgtaaattagaactctatcccgattgctttgaatagcattcatttatttattcattcaacaatattaattaagaccagactatgttctaggcactattataagtgattcaaataacaaaatttttgaaatttacagaagaccagtgtatttcttactgcatgggatataaaaatatatcatttataagataatgcaataattgtcacaataaagaatacaaagtaaattcaccctatttgagggtctgaatgaaagtttcgcagaggaggggatgcacaaaattaaacctttcaggatgatgaataagtgaaatgaagaaaccacagcagttagagcagaaaggatggagtaaagtcaaatggaaagaaataaacaaacaagatagtcacttttggagaactgtatgtcattctttgacagcctgtcagtgtacctgtaaaaaaaagaagtgaagttagaattgcaggctggaaggaaataatgcaggctcttttatgcctgagggcttatatgccacacccaagaacctagactttgttctgtgacattctgaaggcgaatagttggctttccatttcaaaaagctcatttggcagcaatgatgggaatggtgtggatgaatttctgatattggatcaagagactttaattatacatagtgtttcagaacatcctggctcaagatttggtgagaaggaggtaaagagagatacccaaaggtaggaagacagacgtaataaatttccaattcaattacttagtctaaaaaaattagtgatcagttacacaccgctattcaagacattggcacaatgtcaaatatcaatgaactaatactacttggtggctggttagatatggaaaagagaggaagaagaaggagtctaaggtattttttaaagaacataggctaaatgaaactgaaaaaggaagtagagtaagaggagtaaatctggagaggagggtactgaattcagtcctgcagaagtgaacatgtggacctggttgtaggaggtataagtctgcagaaagagagacattaatttctgccctggaggaagtgacacaggtaagggttgaatgtggtctcccctggagagcaagtaggagtgggccaactggataggactgtgaagaggaatagatggggtgggatagatgtggtggagaagaaattgtccttgtgatgtctaggatgcatctgttcttcccggttttatccttggccattttgatgttttctaacaccaacaactaattcttttgagaccaactgagtgtccaataattgaattcaatcctgatgctatctacctagaattaaagtcagatcccacaagataaaaggctcagccccacaagactgccctcagtacaaaggccaattgcaagtcatgggccacttacatatctgacagacaccggccataaattgggggtgctcacaacctcctcctcagatatgataattttctaaagggttcacagaactcagaaaagcactttacttatgttaatgggtttattacaaaggatacaactcagccacagctaaacagaagcgattcataaggcaaggtgtggggtaagggggagaatggtgcattgagcttccatgccctcttagggcatgccaccatcttagtacctctacgtgttcaccatcccagaaactctccaaatctcattgttcaagagtttttatagagctcaatctccaggactccaacttcctcgaaggtgggtggctgaacggaaagttctaaccctctgattacttggcatcttggtgaccgtccctgtcatgagtacaaacttgggtatgatttaaaggggcttgttatgaatagcaaaagacacttctattactcaagaaattccaagggttttaggagctctgtgacaggaaccagggacaaagactagatatctatttcttactatgccacagccatattccttacttgtttagtgtattttcttatcaagggctctcctatttcaataccatatctatgatgataactcctgcaattgcattcccaattcatggatgaatctaagcttttagtcttggcctgaacaaagtgatctttaaatgatctcaacatatttgacatccacaacacaaataaatctgagacaggcatttgaaacaatgaagtttatatttaacatccccaatatgatattgtgcccatagtaggtgctcaataaacatttaatgatggaatataaatccagctctagcttacagatttatcattttggccttagataaaatagagaaccaaggaccaatatttatctcaaacatcaccacacaatagatatcaactttgtattacatttttgaaaaggttatataactactggagacaaagttaagtttttccatttgaagatttgttgacagtgtaaaagagattaattattaattactgagattatttttgtcttcaaagtcatataacctcattcattaaggcccaaataattgcatataagtttaaacatcatatatatacgatgaaactcattttacaacaaatactgaaaagaaggatcaaaaataaagagatgcccaaagtgcttatctgcccttaaaatagaactatttcaattcggcaagaaaaatagtgaattctgggattatacatctaaaacagttccataaaaatgtatattagattctgatgcaatagttgtccctcttttaagaaactttgtttggatatattgactaaattggacaggttaaataattttactgtggaaaccacttgtcaacattgcatagtggaagagtcacacataaacctacccaagccattatttctccattttcactgtgtctttgtaatgtagtcttgttaaggatgggaacaattcttctcacttatgcttttgttggacaaaatctaacagtgaggtactcattctataaagcagtagcaagtctttaagcatgtagaagagtaagcaagtgtatgaattcattaatatagaacaataaatcagatcaatagaggcttgcctatcagtacctcatgtttaaaagaaatagattatatataatttaatagagatcaaattaccacaacatgatgttatgtgcatacaatgctttgctatcaatattgcatgatgtgtttaactatttacgataggagaaaaaagcatcaaataattaatagcataatagcatttcaacaaagttgttaagaaagtgttaaatagctttgaagctattaattcagtaatgtatcacttattcatattaattggagtgggtccatataaattagtgaaaaaatggacttgtagaacattttaatatacgtgtagttttataacatgatatttcaaactatggaaatgctatcaaaattactaggcagaggttttgctgagcttacactaaagatagatatgactcacttataacagacctattaattgtatgcaaatgtatgcttttaaaattctaaaacataatatgcatcttaatgagtaggttaaatatttctccttgaaattttattcatgccattcattcacttccattctttcatgggtagtgcacaaggaaatgttagccccatgattatgtatgcagtgaggtttaaattgatgagatttcattttctacttaagagggatcatatttagagccatctctactatttttggtactcttacaagaagttccattgcttccaacattgggcaagtccatggctccgaacttcccatcaaattcagaattcagcctaaaatttttactaagcctctatgaagaatcataaagatgagtcccaatgactccatgaatttctacatcattattttcatgtcatggagactgtatagtgtagtgtggactctgggttcaaaatgattggatgtgaattcacatatagaccatgtccctttgggcaaattatttagcccctctgtacaccagctgtaaaatgagaaaaataataacagagagtgattgttaggattaaatcaattaacacatatcaatgtcttagaataatttcttgaacatggtgagtactcaataaatctttgtattatcacaacatttattgtttttagtttcaagttaatttcacaaaagctttcctaatgatccacacagttgaatacttgtctttactgcattacatgggtaattattttttcttctcttatatagaggagttaaaactgtatttgttgttttctaataaaaacttaatgaattaactgaaattttagtatgaggaaatagtctctatgttctgttacctactgtgtctggtttagttctacattcattatggtcttattttatatcctccaagctaattttttcctatctttcaccttttttcctcttctaagcaaatctcaccttagataatttgaaagaaaaatattagtctctatttacttgcctcttcatacccagcctaaaataaaatgctgaacagagtatgcaggacgaaccacacctgatctaccacaaaatactactaaacattaaagtacacaattaagaaacaaaattgaaatgccacttggttaaccattgtttttatacaagacttaattccttgagggtttctactgtcacacaacttctccttgtgaggtgtacctgaacagcaagaggcttcctttgttcctaactttcctgatttccgtcaggaatacagcatgatatggactcaggaacaggctgattgtctattcttgacattcctgaagatgtttaggttatgaagttgattatagcatgaaatcttgggttcttgattcttggagctccacatctctgtctctttagtccctcttcctccactctctctctggggaagtggaggatcactggaaagaggctaaaggaggtaaatttctggctatagtcttctgttaatcacttttatgtagtctgtgtttatgcttaggtgctatgacctttctattccacgttcctaaagatatgagtaaaaaatggcttcttgactttatcatgcataaaaaccatttgggataatttatttgaaatgtagattcctaagttcatccctcccgccccctaatagattctaactcagtacgttgggtggaaccacagagtctgcactttaaatacggctcttctgtagattgtgatataagtggcctttgtgaatagtttcagaaacgctgccttacaatgcttcaatcaataaaatgcttccagatttctagtaaattgaaaacagcacaggaaatcacagctagtcaaactgccaattattatatgagatttatcacttttcaacagtttttttttttttctattgagatagagtctcactctgttgcccaggctatagtgcagtggtgtgatcttggctcactgcaacctccactgcctgggttcaagcgattctcatgcctcagcctcccgagtaactgggactacaggcacacacaatcacgcccagctaatttttttgtatttttattggagacaggtttcgccatgttggccaggctggtcttgaactagtgacctcaggtgatccgcctgccttggcctcaccaaattgctgggattataggtgtgagccactgtgtccggcccagattttaatattctaataccattgcctccagagccatcacctttaactacatgggaaaaacaaattcttcctttggccatgaagaaatatgatttcctacgttagactgagattatcaccaagaaaaagcaacagacatgctttatcagttggttcttagcaaagttatgccatggagtacacttgattctttctttctttctttctttctttattttttattttttatttttttttttggcatcagattatttcttttttttattattattatactttaagttttagggtacatgtgcacaatgtgcaggttagttacatatgtatacatgtgccatgctggtgtgctgcacccattaagtcgtcatttagcattaggtatttctcctaatgctatccctcccccctgcccccaccccacaacagtccccagagtgtgatgttctcctccctgtgtccatgtgttctcattgttcaattcccacctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcgttgttggacacttgggttggttccaagtctttgctattgtgaataatgccgcaataaacataactgtgtatgtgtctttatagcagcatgatttatagtcctttgggtatatacccagtaatgtgatggctgggtcaaatggtatttctagttctagatccctgaggaatcgctacactgacttccacaatggttgaactagtctacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcctactttttaatggggttgtttgtttttttcttgtaaatttgtttgagttcattgtagattctggatattagccctctgtcagatgagtaggttgcaaaaattttctctcattttgtaggttgcctgttcacactgatggtagtttcttttgctgtgcagaagctctttagtttaattagatcccatttgtcaattttggcttttgttgccattgcttttggtgtttttgacatgaagtccttgcccatgcccatgtcctaaatggtaatgcctaggttttcttctagggtttttatggttttaggtctaacgtttaagtctttaatccatcttgaattaatttttgtataaggtgtaaggaagggatccagcttcagatttctacatatggctagccagttttcccagcaccatttattaaatagggaatcctttccccattgcttgtttttctcaggtttgtcaaagatcagatagttgtagataagcggcgttatttctgagggctctgttctgttccattgatctatatctctgttttggtaccagtaccatgctgttttgattattatagccttgtagtatagtttgaagtcaggtagcgtgatgcctctggctttgttcttttggcttagcattgacttggtgatgagggctcttttttggttccatgtgaactttaaagtagttttttccaattctgtgaagaaagtaattggtagcttgatggggatggcattgaatctataaattaccttgggcagtatggccattttcacgatattgattcttcctacccatgaccatggaatgttcttccatttgtttgtatcctcttttatttcattgagcagtggtttgtacttctccttgaagaggtctttcacgtcccttgtaagttgggttcctaagtattttattctctttgaagcaattgtgagtgggagttcactcatgatttggctctctgtttgtctgttattggtgtataagaatgcttgtgatttttgtatattgattttgtatcctgagaatttgctgaagttgcttatcagcttaaggagattttgggctgagacaatggggttttctagatatacaatcatgtcgtctgcaaacagggacaatttgacttcctcttttcctaattgaataccctttatttctttctcctgcctgattgccctggccagaacttccaacactatgttgaataagagtggtgagagagggcaaccctgtgttgtgccagttttcaaagggaatgtttccagttgttgcccattcagtatgatattggctgtgggtttctcatagatagctcttattattttgagatacgtcccatcaatacctaatttattgagagattttaccatgaagtgttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcagtttgtcagtattttattggggatttttgaatcaatgttcatcaaggatattggtctaaaactctcttttttggttgtgtctctgcctggctttggtatcaggatgatgctggcctcataaatgagttagggaggattccctgttctaggatcagtgcctattgcccaggaaaagcccagtcgtcttctcatttgttgaacaacagttccccctactggaatacttgctgaaatcccttctacattattattattattactactattattattattattattattaggaacaaagcactggattttaaatttaaagtcccctacttttacttcgaggtcatgctttaataattgtgctctccaggttggaggaatccttcaaaagttagatagggaaaggtgctttattttgacatgtgatttggccactgaaattaaccctaaaagataattagagtcttggtttagtggccaggggtcaagtctcaaatttcatgtctggattgaacacatttttattttaagtaatttagctgtgctcccttttacgcatcccaaaatatattggccagaactccagtgggaaagcgaccttgagtttgcaatggcagttcaggattcatcacactaatttttcaatccctttgatatgactttaagccattttataaaagatgaaactatttgatataaaggtaaatgatttctgcctaccagatatttatcagcactgtctgaaaagccaggttacagatatttgatatacttttaaagtttgggaaattggttctatttctaccagcatgtggaatttgtatgcctctctattaaatattgtagatattagtcattctgaactttccatcattcatcttgctattccccttcttatatactaacctcgaatccaataggtctcaaagtgtggcctaggggactcctgtatggtcaaaaccatatgcatgctaagatattaattgcctttttagcttttataaaaatggaattttccagaagtgtgtgatgagtggtatctccacagattaaatgcagaagcaaaggtaagaatccattggtcttgcttctattaatttagacattaaagagaattgaagaaaatatttgttttaccttgcaaaatgtatttttcaaaaaatatttatgttaaaatataatggcttattattatttaaataaattagtaaatattttaataatgcatcagttttaatttctaatgtggcaaatattcattagtataacccataaaagccaaagcttattaaagccctccataactgctaagagtggaaaggtgtcctaataccaaacatttgagaatgattgctgttcacattacatgcccattgcttttttatgaccctgcctagtcactgtttttgactaaaatactgttctcatacttttcattttgtacatgtaaatcttcaccgctatttcaaatccagccgaatttctaccacttttgtaactgttctgttcacccctaccccaatgtttctctccctcatctgttaagagttccaatgagcttctctcactccattaatcctttttcaactttttaattacagtttatttttctttatgactgctcttttatgttagccttgaagatccttgaagaaattaaaaagcagagtctgcttattatttgtggattttctctccccatttccagaactccatataatgcctagtaaaagcaggtagcagataaatacgttctgggtatgcatcctacagatcttcctcctgagttcaaagaattctttctaaacctactgcagatttgattcagtgcaaacaatgaatacagaaccatctctaagcacaatcatgaacagacagaattgcctgtagttgcctccagtctcccagttgccctatgccatccatacagttcctgtctttctttcctcttcccatccccttcaagattccaaatgcccttcccaagattcctcctgcccaagaacctcgttaaataaagtttgaaaaacacttcacataaattggccaaaaaacataaagcctcttttatggtctcaaatttttatggaatgaggatggacataaagaagaaaataaactaagaaatgagttaatgatttattttttctctgcagtacttacattttaaatagagaccatgggccagtctccttttgtaatttaaactgtgtaggagaaatctttgtgtttggtggggaaaaggtttttttttttccttttgcaaaagtggaacatgagtaccattctgactgtaattcctggtaaacttgtcactgaggggaaacagtgagaaaaacctacaagctaaccttggcctgtcttcccaacttcactgttattgtaccactaatgaagacaataactgtaatactaaatctcatcccctaaacagtggtttacaggaaaaaggttgtatggccatggacatttcaaaatgggacgtagcatgtaatatctttatgtatatctacaacaatacttttcatcatgagaagcacactaaagtgatgaaaagagactgaagttgggcatcaggaaacctagagtctggtgtctgtctcccagaaaatagctatgtagccttagttgggccacttaaattctctagatctcagtttcctcaccattacccaatattttttgagctttcttctggaactgatttagtaaaatcaaaatactaacctagataacctctaatttatttccagttccatggaaaataaatcaatgttgactctaggtattaagcacagctaaattatgaatagctggttcaagttcaccaagttcatttaggaagttagtggtgaaatcaaggcaaaaatccaaattcagtgaacgtcattttctacactgtgagatttttagctctaatatcaacccagtatcaaggaaagggtagagataagggtaagggctcctaatggtgacagaaacacaggtagaactttattaaatgatttcttaacctaccttcacactaagtaaatctatgattaaaaaaaactctttcctttttttagcctttttcccctcattagatatctcttacacaactccaaaaaatcttttgagtaacttgagaaagataaatattatcaatattaatttagttaatattaaatttgtttatctgccctttcttcttcctccatttctgaattttgtccagaaaggtcaaaacgtgattttcaaaaattaaattttccaatgtgttcaagtgataaggaagtttgtagaatcatattcctgtttgtttatgactatgaactatagccccctggtggcttatgctatccctaaggtgccatatgctaaaattttagaaaaatactgaaattgtaaatttttgctgattctgtttgggaacatatttcaaaagttctgaagtcaaatatttatttattaaaatttattctgaattatgcttccccttttccttcccctgtggacttttctggcattcatatttatttccacttattaataatatatagcataggattttcacatttcaaaaagtaaacataacaaatagttccttccacaggaattagttcataaaagtgcctgaaattgtatctgctgtctgaaactctaaagaaaaattacttaagtgtacttatcaaaggcagatggggctcatcaccagccagcaggaaaaacccaccaactaaggttatgacaaagagagtcccttttagaatattaattatgggattgtttgacaagtgcagtcatgaggttccttctagttttattcagacactaattaattaaaaaaaaaaccctcaagaactggagataccatgtcaacttgaaggctcattccttttaaatagaacattggttaattaatatttatacaccctttttaggtaactagaataaagtcaccagggactgctgtctcacccaatagccatgtctaaagatgcttgtacttctcaggcacttgaaacattagcaagccaattaaatagaagcaaggtgcttaggtaggccctcaataaatacttgctgaatgattaaacctaaaatgggtatgatgcttctgctttgaagattacatatgatatcttcccattgaaaatttgtttttcagaaaatttctgctttaacaagaaatgcaccggagagaacagcaatggtcattatttatattgataggaaaattcaacaaagagaaagaaaatttgaaagtgaaattaacaatatgattcctaagcacaatcagaaattcactgcaatattttcctcctgtattgaggtcatggttaccagatggtccctttgatctacaatgaaattaacagataccatccaaatgccctataaattattaaatgctaatagttttgttatcttaaaaagagcaatgctataagctctctcagaggttaaaaaattccaatggaatattaaagaataatgttataaatccagaatttaatggaatagaatagctaatgctaaaacataaaatgtgtgttaaatataatgatgatagataattgacactgagcagtttatcttataaaaagaataacattttagatgcaactaaaagtagtacagagaaaataagaaaggtgaacattttaaaatgtctacaaagcagaaaatacttttaaaccttgaatttaagttattctggtgataagtgaattactttaacatcataaatttattcttcttgcagtagattcttatctcaacttactataaaaaggctgtagtaatttaccattgctgctgtaacaaattactaaaaaagtgatagcataaaacaacactgatttattctcttacatttctggagatcagaagtaaaaatcaagttcacctggttaaagtcaaacgtcagcaggagtggttattttggaggctggaggggagactctcttgcctttgccttttccagcttctagtggctgcctgtatttgctgatctgtggcccagttttccgtcttcaaaacacatcactacaatgtctgcttccatcatcacgtaggcttcttttatggttccttctgggtccctcttataaggactgttgtcattacatcagtctcacccagataacctctgataatccccctatctgaagatccttaatttaatcacatctgcaattctctttttgccacataagataatgtattcatagcttctgagatttagggcatagacatcttggaggggctattattgagcttaccagaaaggctaagaagcaaaatagaccttctaaacatatgcctacaaacccagctaaaaataagcttcatgtattaagtgaatgtgtttatccatttcttagggcttgcttctcaagacaatttgacttccttttaatttggggctgggattttaagacgtcaccagtagaatacctggcactggatgatgttcattctcattgttagttcaatgaaagcaaatcttactaataagtaaagctatgtgttaaagaagaaaatgtttacaagtttatggtaatccatgaaattttcatgatcacaaaccaagcatcagtctccaaaaatgcaagaaagcagaagcaaattactcaatttggctaatacagctcagtaagtattttgattttctagaaacttagcaccactgaaaagggttaagatatcaaacaatttcctaaatgcatcaagcatgcttgaaaattattgtaggaactctaattgtcttcagtgtttctttgatgaactcacaaccagtaaattagcccatggatcacagctcattagcatctacagaaataatgttagtgagaaatttaaaaagcaaacagcaggtgcagttctgtcttttcttcatgaagatctctcagaaacacaaggtcagtcagattcaatgggttaatcttgcctctcttttcaaatccccaacaaaggctagaaatggcatttagggaccttctggaaataattataaacatgtactcactgaagagtactttaaagatcttatcagaaacataagagaatccattcattacttctaactcattatttataatttggtatactatccattactaaatcaaatgtctttcatgggttccatactaatatacaattttctctcatgatctctcaaggtgcattgaaattctgttaatcatgtttctttgagaatgggagatcctaacaggaaagccattccaatttctgtttcctattctcctcacttaagtacccaaggtatgaatagtggggttgaaggttttaactgagcagttagtacggaaatacagtaattttggatgggcactgaaacatatcattgtaaaaaatgccactgcgaaacgaatttctattttgctatttaggaggatggaaaatattgctatctttgcagataggagtagaagaaaaaaagtgatcatgaagaattaacgcagaagcagtgacagattagttgggaggaagggaaactcatgagataaaaccaaacacagaaataaagcttcaacccacgtcaaggatgtgtaattgtcagccagactaggatggctatgagtgaagagtggcagtcattcttataggtagttgcaaaagcagagacctggactgattgtggattttcactgattcaatgactggatttgatttttttttaaaagggatggtaggctgtgtttaagatatgtagtcgacattaccactgtacataaattttagttcccctcttcctcctggaataactgaaatcacggttccttgctctcttgaagttaggtgtacttcttggcaaaagcatttgagagccagtgagcaattggccctgcccgcttccttttctactatgacaggcaatgttctggacagtgggacttctctgaattcagatgccagagtgaggtctgcattgaaacagagccttctacagaaacatgatgaacatgtagagtaaataagaaataaaatgctgccgtttatgccactgaaattttagagttgtcaacctcagaatagcctatcctattgataaggaacacccaataatttggattctcaactatgttagtagcttggattctagatgtggcagaaagattaaaagccagaagaattactcctacaccacagggtaacttgcttgtaaattattatatcatagcaacaaagctattgatctttcctttcactctcaattctgagttaagtttttaaaattgaaaagttaaatgttttctacttttaagtacaggttgagcattcctaatacaaacatttgcaacctgaaatgctacaaaatctgaaacattttgagcactgacatgatgtcataagtggaaaattccacacctgacgtcctgtgatgggtcatagtcaaaaggaaggcaaaaaaaaaaaaaaaaacccacatgatttattcagtgtccccatgagaataaagaccctcccctcctggcctcctttggctgtattgcatctttttcatgtatgcccaaattcccccatggaagcaccctcacaaagcataataaaatgacagtgtgcaggcctgatacaccaatgtcaagtttcccacaatgcctcacatgtggccaagacctatgtgcattacttattcttttgttgttctattctttgtggtgtaaagatattgttgataatgtcaaaaaggcctgcagatacccctgcgggtcatagtaataagaaaaagaggaagcacttatatttttctatagcacaggaattcaagttgttggagaaactgggaagcagtgcaagtgtgaaatgtcttacagcagagtatggtgttagagtgaccgccatatgtaacctaaagaaagagaaagataaatcattgaagttctgtactgaaggtaaagaacagaagttaatgaaaaataaaaaaaaaaacactgcataaagctaaaattaaggtctcaatcatgtattgaaacagtggatcttagtgtcacagtgaacacatgccacttaatggcatgcagatcatgaaataagcaaagataggtcacaatgaactgaaaattgaaggaaactatgaatgtttaataggatggctgcagaaatttaagaaaagacatagtattaaatttgtaaagctttatggtcataaagcatctgctgatcatgaagtagtggagaaattcattgacaagtttgccaaggttattgctgatgaaaatttgatgccagaactagactataatgctgatgaaacatcactgtcttcatgttattgaccaggaaagacactgactccaaatgatgagactgtccttacaggaattaaggatgttaaggactgaataactgtgctgggatatgctaatgcggcagccacgctaagtgtaaatttgttgtgacaggcaaatcttgcatccttgctattttcaaggagtaaaatttttaccagtcgattattatgctgacaaaaaggcatggatcaaaaagggatatgttttttgtttgggttcccaatccttttgttccagcagcttgtggtagaaaatgcaggaaagcaggactgggtgatgactggaagattttgttattccttgacaactgttctcctcactctccaactgaaatttcattaaaaataatgtttatgctatgtactttcccacaaatttgactttattaatttagccatgtgaccagggtatcttagatcaatgaagagtaaatataaaaacagtttctttaacagcatgctagaagcggtgaacagaggcatggaagatttcccagaagagtttggtatgaaaggtatcatataaactgttgctaatgcttagaacacagtgactgaagacacagttgtgtatgcttggcacaaactctggcctgcaactttgttcagtgatgatgatgaacaatatgcaaaaaattatacctttagaattcatcataagctggaagaaatagatatcagagaaatttttctgtaatgaggttccagctgctcattcattgaccaatagataaatagctgagatggttctaaatcaaggtgatcatgataatagtaatgttgaagatgacattattaacactgcaaaaaaagtgcctagagatgacatggttaaaatgtgtggtggtttattggagaaaataaggaatgtgcattcataagagaacaataaatcatgtcagtttataagattgaagagagactcgtaagacaaaaaatattgttaatgaggcaggtaacgctggagaaaacattttaaaaagccatctagtagattccctccgcatccctagaggacaaatccctggtccctcaactgcttctggtgtttcttcacacctaaaaaataaaaatacagtgtacaataaccttttaataaaaacacagcatcataggtggaaacttcaagcctgccattgtctgttgttgctgttgtttaacagctgatgcaggttttctactaatgatactgtgctgcttagttatccagaacacattttatttatttatttattaagatggagtcttgctcttgtcacccaggctaaagtgcaatggtgcaatctcagctcactgcaacctttgtctcccaggttcaagcaattctcctgcctcagcctcctgagtagttgggattacaggtgcctgtcaccacacccagctattattttggtattttcagtagagacagcgttttactacgttagccaggctgggctcaaactgctgacctcagttgatcagcctgcctcagccccacaaagtgctaagatttcaggcctgagctaccgtgcccggccagaacacatttttttccactgtattaatggtgtcatattttttactgtaagtacttatgtgtgaataaatgtaagaaaatgattgcttatcattggcatataaattcagtgtgaggaatgatggcgataccaaacaaccacagactgtccacataggtggccgacatggggacacctttgctttctgatgttgtttcatgcagaaaattattaaaaatatcgtataaaattaccttcaggatgtatataaggtatatataaaatataaatgaattttgtgtttagatttgagtcctttccccaagatatctcactatgtgcatgcaactattccacaatctgaaaaaatttgaaatcagaaacatttctgctcccaggcatttcagataagggatgctcaaatctgtacctaacatgatctgtttcagtatttgtctagacatccctaagtcatccactaaacataatttttatgcaggtatattaatggaggcttgactaaccactatataaattagttgaattttagctgatttatttcctgccaaagtacatagttttaattgacaagaatccttattcagcttgactaaagctccccaggtatttgcttcagtttaaaaagagacacttacaaagatcaccataatgagtaaataattacctgttgctaaaaatgctctgtaaggattacttgaaaggtatcacttgggttgaattttctccagaataaataccaaaaatatttaaatgacaaatcacaccacaaatgtatctggataagaaatattttaacttgttttcatcatcactgttaggaatccgtattataataaatagtctttttttattcaatgaagtttttctaatgtacaaactgacaagtctcagttgaatatgtttataaaatttatgattcttttcttccttcagaagtgtctgatattagattcagtgatggcagatcaaaaggtttaactttgagcttacatgactaaaagccagagtggaggaaaagacactagtttcccacctctacagacctctgcttaagcagaagtagaagtaaaaagacaaatggaaatatgtggtgtttccacagacttggggaatttattgttccttatgttcatctgagagatctaactgcaaataataaatcaggcatggaatgtctacctataacaactcctaaaggttcccatcttattatgtttttggatggaaagttgacattgaaattagaataggaagagaaacagcaactagattattcatgggatcgttatctctttctgccctttaccaagccacatggatgtaaatttttaagcaacaacataatcataagagtcaaagatcattgactctctgtaaactgtaaagttatattggttggtaggaaggagaccattagctttgagtttctcttgagtgtgctcaagtctggccctacatgtcactgagacatgttataatgttccagaattgcccattattgcaaccatcacatccaacttaaaagagacacccagctgtgctgaacttttctattagctgccttttctagatgtaattttttaatatactgattccccaaatcaatacatttcatgtcttccgttacaagtttcctcagttgaatcaaagtctatgcctattaaatatcaaatatgtaaattacatgaatattaattattaaagacaataaatagaaaccaaatgaatcaagcattcaacaatgtatgtaaggaaaatgaaaacaaagcaaatctaaagtaaataggaaaaatgaatttataataataatgacaaaaataaatttgaaaatagaaaataatcaataataattattcatcaaatgatcattacttggcaccatgctaagcattttgtatgtattaactcatttaattatcataaaatcataataaagcaagaatggaaaacagactttcctacatatactctgatttcaaaaacaaatatagttgaaggaaaatctaaaataatatgttgataatccataaaagataaatctacaaatatatacgttgtaaaatgaaaaataagttaaaataatatatatgtacttttggcattaaaaacattttcaactaatatatttgaaatgcttatgctatatattttgatgccaacaaaacctgaaaagaataacactaaaaataacactatagcccattcctattaatgcatactcatgtaaacatacaaattaaatttcaaaaaccacctcataatgatagcttagcaattctgaaactatataatgtgtatattaggattgacaagtaaatatagtgtgtataagtaaagataggttcctctactgtcagggaaaatagttaaaaataaggaaagagggaaggcaagaataactatggtgttggattgcaatcagaaatatcaaaaggaactgatggtttttaatatgcttataaatggatagctacagaaatgaatataaacatatatgcctgcttgagtatacatacatctattttctagctctatatactgaaagggcccagaaacaaaaatgccccagtaacaatgaatacatctagcacccaggtcttgaattctaaataccactctctaagaaaaggaaccagggttccttagaaaaatggctaatagcagttccggggaagaaaaaatactagatgaacctagaatggctttcagtgccagaaaatataaacgtgctcccctaaaaggaatgtgatcatgttcaaggggtacagaagccagtagtctgaaggaaatcccaatgtccaaatctgggacaatttaagcaataaaatacagaatgatagtaatgagttataaaccattgaaaaaaagaaatctgttagtccatactgacacaaacaattgaataaaaacataattggggaaatcaagacacctattccttttaatagaattccaattactaaatgaaagacaaatgatagaaacagaaaatcaccattaggcaaattactagaggagtaatagttgcagacaaaaattatttatagatgctaaaattagtggaataatgtttacataaggtattttcacagtctccaagtgtttttccataatacttatcaaagaggaaaatggaatcttttctgtggaaaacatggaaaacataacattaaccaaatgattaaagttaacgtcaccatcacaaagtagagatcaatgcaacgatacttatataatggggaattatcacaagccagtggaaaagcaacagattatttagtagttacagtgcagtatactagttatagacatggtctctggatcgaaactacctgggaattagtcccagctctggtgcttgggtaatcacaggcaagatacttaactcctctgtgcctctggctttctatcagtaaaatgggagctagtaaaaggattaacctcccaagattttggtgggaattgagaattctcaaatagaaattgtatttgagaatgcaaagactacaaaagagcctgacacatagaaactgctcaatatttattatgttgcagagttttcaagaaaattgatagaatgatgtggacgataaaaagatgaatatttcatcatcaatataaattctagacagtttaaatattgtatggcaaaatataagtgactgttaaatctctagagatggtgatgatatttctacacaaaacaacaaaagtcggggaaaaattaccatttaatcagagaaaagaataaaatttacatatgttgaaaaaacaaaatagacttgtacaaaggaaaaactgggaaaaactcttaacggcaaatctgacaaaaaattaatgttattaacatacaaagagatattgaaagagaagaatcaatgtttcaggaagttttcattcatgggaaaagatattatataacgattcaaagttgtgttcttgacaatgataatgtgaaaatagtcaccatattgcgtatagtaaaaaaaaattaggattcagaattagttatgtagtatgtcctatctatgatgcatatagagatgatatatatatttttgtttatatttctcagggtttttcctcttaaattttctggtatcaccagaaaggttataagcacacaaaataagaaatgatacatgattgaaactaaaggctgagtggggaaggaaaatatgaggaagtctagaccaagctattagtactaactaaaactaactgactgaaatttactaaatccaagactgggctacttagatatcacttaaaatctcaccgacagcttgtaatctctttatgccatgtacaagctttattagcaattaagacatataatttaggctaattcaaccagaaatttgcaaataacctattatatgagagatataaagatgaataggacattgtctttgcctttattgagtttacacttcagtgtgtggaaggggtgaggataaacacaatagaataacaagaatataaacagaagtctttaaaattttttggagattaagagaagagagcctaccggttggagttaatccattcatgtatgcaaaacattcattaagatccccacatataatcgttattttattttattttgagacaaagtctcactctgactcccaggttggaatgcagtggcatgatctcagctcactgcagcctccatttcctgggttcaagcaattctcctgccttggcctcccaagtagctggaaccacaggcacctgccaccacgcctggctaatgtttgtatttttagtagagatggggttccaccacgttggccaggctggtcttgaactcctgacctcaagtgatctgcctgccttggcctcccaaagtgctgggattacaggtgtgagccactgcgcctggccataatggtgattttagatatagacatcaggaaagtcttctttggaagaggtggcatttgagattggctttgaaatgtggatgggatcttgccataaagagacggggctgaatggacattctaacataaggattagcatggaaattgggttgactatggtaggcagctccatttgtaagtagaaaaggctacatagaagaaagagcaaatggtaaagttgtaaaggctcattgctcccatattgtgaaaagatgtaactctgagcctcaggcatttgttcttaatttcatgagcaatcaggtagtctgttcaacattaataataaaaatatgttttggaatcaaatagatatttgtcactctctgggaaagaatctattacctctgaaactttgtgggatggggatctctcaatgggatatctgagacactgcactgagtttgtaatcacaataataaacagtatcatgtttcttgcatctaacatcagctcagaaaagctcctcgggattcactgttgcgacaacgtaaagcaaagtgatacagccactggtggatgggaagtgacagcagcagacacatcatgctggcaggtagctcacagagatgagaatgcacagttaatctaaacacgctgttgcctggaagaccaagagggagagtcatagaaaataaacacaggcagccacttgagcttagaagaggagagactctatgtcttctttgaggaaaggaaaaaacaaaaccaatataaaaattgcctcatccccatgtgtgccatgccaaagcacatttgtacatatttctgtccatagatacacatttccaaagataaaacattgtattataataataatacatatcactttgcagataacaagccctttaaactacatttaccttttgctgatttcaagagttcagaatttattacaatttgtgtagaatttagaatgacaggtattactttaaaggccttgttatggttgacattggaattcaaataataatgatagggtcttcatggattaaaaaatacacagtcatgtataattatttatctatgtctgcttgtgaggccaaaatttttttgagagagtaaagaagagttttagtagatgtcacactttagagattgagtgatttattttctctatgtcattttagggcacatttactgtcatattggaacggagagttgatgtcatattacaagctgagtaaacctagcagctccttctctgatatggttaatcaaaaaggaatcaagcccccaactgcagggcttctgaattaatgatgaattgaaggagaaaagaagcaacagcaacagcatatttgtaaagccaaggcttcaaagtaactcaggacagctcatttagataagtcatgaacctaaatggctaaattaaagcaagactgtgattaccaacacagctgggattaggcaagctgtggcacaagaattaagccacatgaaggggaagagccacaggtcagaaggtccccagaaaatgtctaacaagagaagcaagttaaccggaaatcagccatgtgccttaaccagaagtcagctgtgacttttaggcctcttctggaagtggattataaagctattccctttggttttgaaaatgtgtcttcattcgtacatagaactttagaaagatgaaaggctttagatataatggaatggggaagccgctttcatattacaaggaaattgataccagtgtagatgggaatcagatgctcaggctttatacttggctatacagccagttagttaagacataagataattcttccctcctgagataatgtctatatagcacagttggaactgtcctcactgctccccagcatcattttggtaggtagcttcccagatctccaggtcttccttcagtccgtgaaatttagcattgacaggttcatctattgtgtcaaagcactgcctaaaactttctgttggctccttctgccttctcaaaacctaacaagatcttttgcaacaagacacctgctcaacacatacaaggtaatttctatttctttttgtatttatttatttttgagacagagtctcagtttgtcacccaggccagagtgcaatggtgcaatctcggctcactgcaacctccccctctcaggttcaagtgattcttgtgcctcagcctctcgagtagctgggatcacaggcctgactaatttttgtatttttagtatatacagggttttgccctgttggccaggctggtctcgaactcctggcctcaagccatccacctgccttggcctctcaaagtgctgggattacagtcatgagccactctgcccggctgataatttctaatcttttagactactatatcccagggaaaaacctctcatccagccttccttgttttaaaacagtttcctgagcctatttcatcacacacacacacacacacacacacacacacacacacacacacacacttctctttactcatgcttttccattgttaataaacatgcttattaaaaaacacctgttttccccctacccctccttttcttcaatggtcaaattgtcacctttcaacacctatatcaagccttatcttggcataaaactcatctccatcacataatccctttgacttctctactccatcccccaaaccagacttgcctattaagcttccaatttcatattttgagtaatgtgaaaattgtgaaactaaaattgaatttgaagttatgttggtgcagatcaatataccatatgttggtggaaagaaaaaatgttatatttgtttcagttttcaaagtccagtatattagctacaacatcctcctatgtagcttgatcccaacaatagaagcctccagattctgtgggccaggtggcaagatgatataccaaattttgcctggctcatatttgatattattctttttattggttatgaagtttgactctccctacttcctgtcactttatttttttaaactaaaatagaaagtttatccccattattccctgttgattgtaaactttctggaaaaaaaatcttgaaaaataagtagatgtacctacagtcatggttagactcaaataagtttatttttgtttaatagttcttgcattctcttaccatgatatatgtggaaacttagatataaatggaatatatttatagtctctttgccaaaaactacagctgctcccttcaaacttagcatttacaaaacttctgtcatttcgggaatattgattattaataaaatcaggaagttgtgttgtaagatttctgggtagttcatcatgattccatggatttcaacaagataaattttctagcaaaaactggaaactcagtttttatttttcctttttgtaaagtggcacaaaatataactaaatacttagaatatatgtaaacaggaaagtactaaaatatgcatttgcttgttaaaatgtatttgatctaatttatctctggcaatgtaaatgttacatagactataagctcatgaaagaagggaccatgtctaagttgactttcattttattgtagtggatagtgcagaatctagggcgtagtaagtgaaaaaaaaaaaaacaaaaacatttattggattcatggatgaatgactacatgaatatatatcttgttatcagctattgtgccatttcctcaatattatcatacttagctaaagtataggaaactagtcctaatttgccaagaaatagttgaataagcatgggcatgctattttaccaccctgggtcttagtatactaatttgtaaaataagggaaggtctgcactgcttacttcaaggagcagttttgaggattgaatgagagctttatgaaaaaacatcttgcaaacagtaaagtactttaaagaaggtagtatttgaacactatgggatatttgaagaacattaaatttatacctgagttattgacccgattttttaaaaaaattggcaagtagaaaaaaatagaacatgtaacaggaggctttggcaaaaagctttactcttgggattttcatatgggttatactttcacaactgtcaaagcagatcatgaagaatttaaagatatagaacacttacttaagagaacatggcctaaggatgcggtactaattttgattaattttctgtgttcctaagtggcttgctaaagtgggaggaccagtgaaatggcctcattatacagctttgtgtactggctgttgcccattattgtactttctggtaactgatttgcaaagtatgcttttaatgttttgttttaaaaactcattttaggaagattaggaacagagaacatttcttggaacaactactgacaatgttgagtggagaaaaaaaggtatccaattttcctttgcatactataaaggaatgatttattgcaagtagcattttgttgcctcggtggagataatttccttttctttaacattccaaactatatgggagatatttctattccattctcccatttaaaatatcatgtctggaaaataatattatcaagactgacttcattcattcaacaaatattaacttgttattatgtgctaggcactataaatgttttttcctagtattttaaactaatacatgtaattttactctattttcactgcagacttgtgaaaatcattcaaaagttcccaagagaaagtttcacatcatttttactgttatattttcagaacttggcttatagtaggtgtgacacacactaagtacacaggtgctaagtaaattcccagatggagaataaacagcattagcctataagccagagccacagaacttagacaatatggtaggttctactttcatctctgctctgccttaattcattttctcacctacactcatactattgcactcatacttttataatgatccccctgactctgttctctctcctcctcacttcatccctcacaatgtgaccagaatgtgacataagttccatgatttcactcctgtgcttcaggcctttcagtggctgcccctcattgagtagcatttcttcatcttttcccccaagttttcctaatggtgtgttaggatagacataagctcacagaaggcaggcttcactgggtctcctctgagtagccagtcacaactatggcatttcattcaagtctaattgtagttaaaaaggtatatagggtctgcattcccctccataaaatacccaagcctgtttcaatttcaagtttttcttttctttcaaatcattaaataaataaaagtgacactccaggaaaaggcaccaccatgtgtatcttgtcaatttattacacttgggtacatatctttgtaccacccgcccactagcacccagggatatatgtatgtcagtaagagaaatagactactatttatttatttatttatttatttatttatttacttatttatttatgagacagggtctggctctgctgtccaggctggagtgcagtggcacaatcactgctcactgcaacctccatctcccaagctcaaacgatccccccacctcagcctctggagtagatggaactacaggtgcacgccactatgcccaactaatttctgtattttttttgtagagatggggtttcatcatgttgcccgagctggtctggtactcctgggctcaggcgatctgtccgtcttggcttcccaaagtgctggatttacaggcatgagccactgtgcccagcctcattattaaattaaattaattaattatttttttgagatggagtattgctgtgttccccacactggagtgtggagtgcagtggtgtgatcttggcttattgcaacctccccctccccggttcaagcaattctcctgcttcagcctcccaagtagctgggagcataggcgtgcatccccacacccagctaatttttgtatttttagtagagatggggtttcaccatgttggccaggctggtctcaaactcctgggctcaagaaatctacccacctcggcctcacaaagtgctggattacaggtgtgagctgccacgcctggccctctttatttttaaatagataacattgtatgttttttcttataatgtacaaaataatattttgaagcacatatacattgtggaatacttaaatgtagctaattaataaatgcattacctaacataggtgtaattcttgtggtaagaacaaataacatccactctttacattttcaagaatacaatataacatcaaccacagtcaccttgctgtacaatagattccttgacatttatttttaaaatctacctgtagtcactaataaagcaaacaaggccctttgtgatctaactctagcaatttttttttgcctcattctatgaaatttcccatccttaactttctctgctgctttgccacttctgatcttcagaagagtctctgtttctcacaaacctctacatctttgcacatactgtgtgcgtcacacaggatacctactccttggctcacttaataaactctacatcctcaaaatcccagattaaatttgacttcatcttcgggatcttcctcatctgtcccagaatagcccagagatagtcctgcttctgcatttccatgacattttgtgcattcccagcatttataatgttatcagaacaatccttctgagcaggagtttattgttactcaacatcttagtgtctggtgtcttaaagatgatgatgttaaaatatttgtaactagcataatcaaagaaacatgaaaaaatggtataatcatatcatctgaggaccattgctgtagaaatattttaaattgttgtgagattatttgaaagaaagctgtttaatataattgttagttagcatatttaaaatactatagaattttaagtcagcctttggttggttttcagaatgcagacttcagtcttcaggctttaagtaatcatgtaaagcaactaaatatacttctttcttcctagatagttaatatgattgtcattacatcaaccaatgtaagaatttgcttatcacatacaaaagaaaattagatttggcacttgaacctatcatatgtaaacagttgatctcttattggtatattgcaaagaagaaatgaataattgcaaggtctaaaacatagttcaccattaaaaataagtatctgaattataatattatgattggatggtaccttatatagaaagcctctggctttgacacaagaaaaattgaatgtttctaagtgtattgaaattgtagtcattgcagcctaaacttgtctttctggcagataattgcttttcatgcaccttagaggtgggtataaactgaaatttcaagtactgcttctgggttatgtttatttcctgaaaaatggaaccaataagaggcttgtttcaaaattccacatgtcaattttatagtgttagaatgcctttgacacaaaacaaaatatttgacttgtaattcatctgtttatattgggtcttcagttaaaaaatatatttttatgtattgaagaaaattccatcacccaaaggaatttgttcttgactcttatctttattgattgaagtgggattctaaaaatccatctaggtgaaaacacatcgtccagattttcctggccatcatattctaagagacaaatgaattttataattaaccatggaaattacctattcagtagctaaaataatcttgtgtgggctatggttttgataaaagaaaaattctggcctgaattatgtttattacttatgaatgactttcaaatgcttccaaaatttgcattcagaccatggacagtaactaactctcttcttggtttagtaaaaacaaaacaaaacaaaaaaaacaaaccaaaacaaacaaacttaataaggatggagcgttcactctaagaacaggtaccatgggtaaaaactctgtttggtaactcctccatccctcaaactccctcctcccctcacctcacccaaatacgtgacacattttcctccatgtactaagtagatacttactgattgctgtgattgataagacaaaccatacccttaaaaacattacttcttgcagtttgattgactcttgagattgaaacaaaggaaaagaagaactgtgctcatattaataagctacttgaaagttacagtggatgatataatttctgatgaaatgttagcccagatgaaaatatgcttaagtatttacatattcagtataacatggcccttctcagctctgtaatcatggtgtacttctataggctgaatttagaaatagatattagttacgatatgaattcatgagattcatttttaacaaagtagagtttatattattaaatagcacttggctattctaagctattacttttggagatgaaacacatacacatgaattacagaattgacttcagggtcagttgctagcttgggataaaataaaccttttgattaacacacattatttttaaaatcaaaataatggtaacatttgtttgtttgttaggtcaacttgctgaccagtattggctctaaatgacttttggccatttcctaaaattgcatttatctaagaattatataaatttgtcaccaatgatgatattcaaataaactttccttagatcttttctgaataggaaccctaaaactgtgagtgacaatgtgcatttgatggaaatatggaataaccagaagttaagttaaaatgggacgttgaagatagtattattctagcttatatttcactgataggaaaagtgagactaaaatgatttatgtagggccagaccattgaggtactaaaccaaatgttcatgatatttgggctcactgtcctctgccatactgccttgaaaattaaatatatgttattgacatattttgaacacctgagtcacttcattttacatttatacatttaatattatttcttaaaaacagaagtatatacgattattttaatgcaacttttatttctacttttttttttcttttcctcaaagaaaacaaacacaattgtacttagcagcatatgattagagaggattgacttgagtcccagcttttcagatagcttttcagattattcattttcatgtgaatttttatactctgatatgaaaggtaggatgctcttccctgagattactttggttcactggaactgtcactgctggctggtaggaaataatggctttgactttaagtagccacatcttgtagacagttaaaagtatttattgacagaatgttaagtgatgcatttcatagtggagactcattttatagaacgacattaggcagaagtattcttaaactaatgagttattatttgtacattagaatcaataatagaaaacttgttaaacattctataaatagtaaatgtagaactcaaatcaaaattttccttactttcctaaataacttagaagcatgaaacatgaaggagagttttgaaattttaaaaaatgttaatttgctcaatacgaacatatcacattgatagtttattatacatattttgatgtgtgctttccataagtaccccagtttctcctttttatcctataataatctgaatggaaaaacagacacatgctcctaaattgtatactgaattctaaagagaaaaagtttcagtcaaaagttttaattatagcaatcagtcacaaagaaagttcagaaaacttataaaaaaacttcaatattttaaaattatagtggccatagggaacactcatatgaacattgtgaaatcagggaaaaataaagccttagttttattgtgaaagcaacattctgtgtatatacaattgcagaattactatgaaatgtggaaaaatagaaggatttgtgtttgcaacaaacagtgttttaaacaatttgctttacaattatttagaaaagttctatgatggcataatgcctgatgtctagagcataatagagtgttattatgcttattattgcttgctgttttattttgtatttgaaattacaaaccaaaacactggcaatgatacaattaatacctgatcaatggaattcttcatctggtaaaaagtcttggcctgctctgctttacccacaataactattagattaaagacaagtgaaactacgaataacaaaaccagagtgatatctagcacaatggccattgataagaagggttgcatataaagaaagcatgcttgaaatcagaggctaaaatacatttctacattgaagctcaaagtgaagaggagtatagaatttgtcattctatatttacctagtttctgtagacaaaaagtttattatcaaagtttttatgttgtataatgacatacaaaaattattgaaaaccagctaccaagtgttatagctaatctaatttcatttcattgttgtagagattgtttgaaatacaaccatccagaaataaacactgagtttctacctggtgacagccatgaaggtgcatctctcacatctccacctatagggagcataattgaaccaggatctagctgtttcactcggaaatccatgttggcatttgcataaggccttgctccccttcggcttctcctagccaatgcctgagcacatcttggaatattaaaccaggcttgtttctgggagatactggcctccattgacaggcaactctggcttggagactcctcaacagtcctgccaaactttccttagaactcatctgtagtctaagactcttctacaccttctttcccctcctctgcatctcctcccctgcctcccctctcttttcctcccttcttcatttggggttagacatgcatttcaggctgatgattctcctggtcttccccagctggctgctcatcttatcttattggtgattcacctaatacatttgttgtaagtttaacttcattttgatgtgtgttgcttggaagacccctgctaacacatatccctatctaaatgattcctatgattgcaaaaattttctgagtgtagctcttagatatttcatctaactgaactagcttacattgctgtaacatatatttggattattgctttaaaaaatgcagttagtatccatatttattaagactttaaaaaacattaagacactgatgttctttgaaaactctcagcaaagtcagattgccatgaaccttacacatttttagcactgttttattctgaaagcaagtgttcatacatttccatatgccggtttctcaccatggaataatctcctcccttttctttctcttgtaaatgcctatatttttcaatatccaattccaccttcagcaaaagttagtttcttcagctggaatttcaatatactataatgataatactaaaacacagcagtctttatgagaaaagataaggacttgttcatttgtagatatagtgatttgcttatgtaaattcaaaacaaaatttgctaaattcaaaaatgggaaaagtagctgtctaaaaggcaaggaattttgggggtacagggaaaactttttattaaaattttagaacagggaaaaatctatgaataaatacaagtggatataatgtgagtgaccctataaagttaacattgtcctctattcttagaataagatgcttgccactgagtctttgtctctcccaccctaacgttagcttttttttttttttttttttgagatggagtcttcctctgtcacccaagcgggagtgcagtggtgcgatctcagctaactgcacctcccacctcctgggttcaagcaattctcctgcctcagcctcccaagtggctgggattacaggtgtgcaccaccacgcctggctaattttttgtatttttagtagggatggggtttcaccatgttggctaggctggtcttgaactcccaaccttaagtgatccaccaccttagccttccaaagtgctgggattacaggcatgagctgccacacccggctgatgttagcttttaactcagttgctgtattagtctgttcaaatgctgctatgaagaaatacctgagactgggtaatttataaagaaaagagttttaattgactcacgttctgcatggctggggaggtctcaggagacttacaatcatggtggaaggggaagcaaatacatccttcttcacgaggtggcagaaaggagaagtgccagcaggggaaatgccagacgcttataaaaccatcagatcttgtgaaaactcactcactatcacgagatccaatcactttccaacaggtccctcccatgacacctggggattatgggaactgcaagtcaagatgagatttgggtggggacatggtgaaaccatatcaattgcctgttttttaagaacttagtttaaactcaaatgtatatcaccaaacttaactttcccctttatctcttcatccaaccaaaaattttcttttaattcatgacattaatcaggtaggcttaaaatttcttctgacctcttcctctttatgatttcttatattcagaaaattacttgtgaattctctgaaatacattgtaatctattacttcctttctgttatcacatcctctacactgattagggaccttacagccttgtattccaccagactatttcttctcttctaatatcctaacatttcacatgcctgcaatttaaacttctcaaagtatcttttgaattgtgtgcttttcatactaaagtttttcaatggctcttccttcctcactgaataaaacctaaacctctttgcctggcatttccatttctaaaatctggctccaaactacccttccaaatttatctccctcttgaaaatattgtgtgaccctttggttctgaaaagctaaaaggtataaaaaattaggggagctggttaaaagttaagacttctggtcttacaactccagagattctggaacaaaagtttgagggtggggtcattgtctctgccatttgtgtatattttccaagtgactctgatatgggtggtcatcatattacactaggagaaacacttacatttagctaaaactgaatagtttttcttggtgagcactgctttttcttttctgtctctttagatgggtctatattgccctctcatcaagaaaaaactgttttcatccatgtattttttcattaattcattaattcattcattcatttattcatttgtacaagcctactctgagtcgtgctgaaaataactgccccattcagcgttccataaaacaaatgttcctattttcttttaataaataattgcttaagcagttgaaacaaatattttacacctggtgatattcatttgttgctaatttagttatgtcttatatgtaactatgaagaaaagactcatgaaattgcttttggcaaatccttcagctacctagaaaattcatatggttcccatacgcagacttttagatggatttagaagctaaaactattttaatgtaaagtttccttacatggtttgcaaaacatcctgatattttaaaattctattttattatcaaatgtgtaacaggaaggggtcatccaaggattgaaacattgtacctgggtgtgagtagcaaggtcccttaaccatgttctggaatagcccattaaaatatttggcaacaaatgtttttggaatgcttattgtttggacctactaaagtgaaatatttgttaaaaatggttaatcagcaagtactctaaggagaagaagccatctgtgagcctggatgctcacttctgcccttgtaatttctgcaggttgaagaacctctggagtagcctgacagttactatctgaaacattcttcatataatacatccacacttctaacatgtttcctgaacctctctcctaactgaaaacatcaccatcttccccaaaacctgagctgtctcaaaaaacaattttctttctgatctacttatttggcatctggtatccatctgaatgcacatgtggtgaacgtgcatcagcaacccaagagggcagtaaaaacttacccacaaagatgatttccttgtttgacttcctccctatttcaaggtgtaaatcaagtgttgctccagaatggatagcttctgccacaatgatggaaataaagtttctgtgtgtggttttgtgtgtgtctctgtgtatgaaatagagttaaatggcttgagagtatataaaaataaaacaataaatggggaaataacttataataacattatgacattttccttccaaattctttattgtcatatttaaattataacccagtagtttaaattgtgaattcttagatcaatatgaaagtacataaaaagaaaaaaattaatcttcgtaacaacaaagattttctcctctgtctttgcttagtatcatgaatggtgtaagatatcaattctgctttaaaaacaacagctctacagacagcttcctagagttgagatcgccgatcattttaattttctttaaagctgattctgcaatcagtgctcactatacaaagatgatgttctaagaaccaaatgaaattgggctgtttctaacttgctacatttttcatcctcctccttaaacacaatcatgaaagtatttaagtgaaaaagaggaatgatgacttaaatgtttgaggatgactcatagtgttgaggggctatgctagatctaaaattttcatttgaaattttcaaatggaacaatcccttcctgtagttaataaatcattagacatactacgcatttttcacttgacatcagagtttttatgttgaattttcatttcagtttaaggttcgcctttgtcatcttaaaatgtatcctattacagagagagaaacctggataatatgcctcctcatttaatattcagtctttcctcaagcttacagacactgtaagccccggagagcactgccaaatgtctacttcttatggagaaccccttttcagcaataagtttttatccatttggcatgtttctgtaatatgcttctttttcaaaattatgacctcccacattacaaatgttctttttctttttttttcctctgaagataagaattttagatagtattcctgtctgtgaaactactcggaactccaaagaatcactggaaaaatagccacagttaaggaggtcagggtatagtgaaatgaaacaaggtaagtcatacactaattgagcctaactgcttatgctatagaaaatacattagtcttctgataaaatatgtccagccagttgttcctggtctggcaatagtgtggatcgacaatatgccctggaattgctttgtgatgcctccttcccctaatttagactgtacctacacttaatgctcacttttaaagttctggccaaaggtctagagaataatttttccctgcatactgcataacatttaaaacatttagttccttgaaaagtgctattgagctgttttactgcgtgttaatagatgagggagtatggtagttgtgatcattctttttttaaaaaaggagtcagtttcaaagcataaaatgattttattcttgtaggttttgcttataattcagcattaaacataatttgaatcaatataaaaaaagaggtctggttattatagatgtgagttttaagaaccttacacagtacagtctattatatctggctcagcagtggtggtgatatgaggtgtttcacttaataacaaaaataatattgtaataggaaaatgagactctataaagaagtcctgttggcacaaatgtacaatagcttatgttcaaaagaaaaaaaatacactaagccccttattgtctcactattatgcaactctttagacagggatcacttaatgagaccatttcataatgacggtatttagtatcttaataaattataaatagtccaagataattcctgcttcattccaaattttattttgtagttaaaaaaactatagtagaatatatgtctttgcatttatacatatatgataggagatatatgtatatatttacatatatcatgggacatatgtatatatataaataaaatgtaagtacattgcatacatgcatgtaatatgtaataaagcacagcctgtactcaaatgctgagcatatatttgtaagttatttgcatattaaaaattagcataaaggtacatattacaaaaaggaaaaattaatggatgaagatgaattgtctgaagtcggaaaaaaataagactcccttctttggtgaaaacatctatatttcattgttcaaagtgtcccacttatgtgggtagtacatactttcatactcaaccaaaattgcttccctccctcccttccttccttccctccctccttttctctctctctctcccttccttctttccttccttcctccctccctccctttctctctccctttctttctttttctttctttctctttctttctttctttctttctttctttctttctttctttctttctttctttctttctttctttcatttctttcgttcattctttctttcttccttcctcagtaataattttctgaggtctcacagatttttgttaaattgtctttgctcaactcttttacattagaaacacagtatttgttcactttataatatctagaaactacccaaagatgcctttttttttgttttcagtaattataaactccttgctgtttgtggtacactctgctaagttgtatgaatttttaaaaagttaaaaagacacagttcctacagtaagaaacatacagtactagtggtaaagagggacaggtgatgaggtatttaaaagtctgtgaagcaaaggccagtgcaagaggggcaccaacctgccctggaggttgaggaagaggtcctggagaaggttgcactctgcaatgtctgaaaccaggaggtctattaattttttccacagtgtaatttattaaaatgatgtatttatgtaagtttgtctcatcatatttgcattatgttaataaatgcagattttatttttaaaaatacccctctcctagcaattctgtctctgaaatgtttcccatccatgctgcctgattctctaaagggcattatagtctctgcatgcatatctcataggacctacactaaaaggtccaccttttatggagaaacagttagaaagtcaacttccagtctggagaacaatgttactgtgggaaaataatcacaaaaatccttttcatattatctttacttctgttttctaagttgagaaaaaaagtgctgatttctgactatttcctacattctattttctaagtttctgtttttcccttgtagtgtggctaagacattttggtaacagtgtaacttctgtgtcacacatggagatgaagagggaacaactgtagcagggtcatatttgtaaaacaaagagcagggcatatactactattctctaagttctgaagatagtgcccgttttttatgtaatacatcagtccattgactactgtttattataccaaggcagaaactaaaaagtgatctgaggacactcctttaagaatgaaacaaacagcaacatactatcaaatgtcaaaggcacagggctaaaatgaatagatgagatgtgtttttgctagctcagggttttctgcttctttatcgatgggccaaatgaaacattttgatggctattattaaagacttaggggtcaggcgcggtagctcacgcctgtaatcccagcactttgggaggccgaggtgggtggatcacctgaggttaggagttcgagatcagcctgaccaacagggtgaaaccctgtctctactaaaaatacaaaaattagtcgggcgaggtggtggtcacctgtagtcccagctacttcgggatgctgagacagaagaattgcttgaacccgggaggcagaggttgcagtcagccaagattgcgccattgcactccagcctgggtgacagagtgagactccatctcaaaaaaaaaaaaaaaaaaaaagaaaagaaaagaaaaaaaaatttaggaacccctcctaaatgctccttataagtaaaggagcatatttcattgcatacatgttttctaaaatgtttttggtttgaactgagcttctaaaactatagtataatttgcctcaattactgataattgtaattttctaatgtaaaactaataattcagactgataaatttactatatgtaatcgtaagtacatacataaatttactatatgtatatgtaagtacatacataaaatgacagttataataagagcttagctttctaaaacaataatagaccaaaacctgtttgaaatgcttttcataaactcaattaatccttataaggaagctataagataaattcagttataatttcgtttttacagaagagagaaccaaagcatagagaggttaggtaacttactcaagatcacacagccagtcaatggtatggtcagaattcaaacccactcagcctggctccagagttggcattcctagaaaccctgttgctacctctcaacatgtatataccttgctctttgtttttaaattccagcctgatgctgctgctccctcttcatttctctgtgtgactcagaggttccacaattaccaaaaaatcttacccacactacatgcaaaaattagtacattagctgtagcttttacttgtgtgtcattgattaaggcaatacctgtaagacccctgttcttttgagtatcttttctccgactaagccacccaattaaatcagttgctatgtttacctggcaggggaataggagccactgctgtttccccagcagttcacagtgtgttatcttctttgaagccctgctctcctgtttatttcctttgtccttcccacctgaagtccctcctgcagcagctatttgatggtcttgttatcagccactctgctcctttgtctatgccagaaaaaaaattatagtagcaggcagctgtgccctcagtcatggtggagtgcttacatcctgggataggtcttctaaattgggtgagatgacataggctttcagtttagcagtgaactttgtgtcacattgatgctgcagcctgtttctaagactccccagatgtgtgtgacagttcttattatgcttctccagaacagggaccctcaacatcatggtgtcatttgtagagtttgttatgagtaatttcttgccaatcataactcaatgaaaattgtgaaaattatttttagacattataccagattcccatggtattttgataattttcttaagcagaaaattaaatgtataaaaagtaattatagttagctagccagggattgtgcttaacatttcatctgcccatgggaacatgcggttcatgtgtgtcagagtggaaaaatggtgaagtgcttctccattcgttggtcaatgaatggggtgaagccgttctacctggaggccctagtgtaccagaaatggcttccaagcaattggattacctggtaatccaccgcaaagcatgtgatataatttactgtgcctaaatttgtgcttgatatagagttcactatttttataaacaaaagcttaaaagagcactgaagataatatttacaaagatatgtgctgtctgatatttagtgatgatgtttacttctcttttacacaagaaaattctttgttgcatgctgaatgcctctcatacacggtggggtgcctctgagcttcatactgatctacaaaccaaccctggctctgcaactcggccacgggcaaccttgtaagatcttttcaatatgtccatgcacaactggaatcctcttttttattttttaataatctttgaattgatggaattgcttttacatcatttatgtgttcataattatggttgctgaaaatatattgaaagaaaagagacaccttaggcaactcagcttcaccacttggttcatgcaaagttagtcaattccagctgaacattacttttggttatagaataggggctttggattactctaaaatggcattgttcttcaggagttaagcattgtagtgtgctgccaaacctataccattatttttctttagaagacaaaggaaaggtaaaaagtataataaattaaaaaaaaatccccatagaaatgtaaaatgcatcactacaattttttctcctactgaaacaataatagcttcaatgggccattatcatctgaggcaaagagaatgagacactacctgtcaatgagtgtttagggattagttaatacacaggctacgtcattgaagcaatacattataacatctctttcatgatggtgactgtctgatgtataaatgtttacttagggaatcattgatgtatgtttcattacaatgttagcagtttttgacattgtgtcaccgtgtggttgattacttctgaatctgtgagctcactttgacttttcgagcctggattactgaccccataaattgttatggctatttctaattgttttagtatgctgtatgaaattgacttatgagttaatcatgtatcatgggcaccggcaaacacggatgtgagccattccaaggtttctggagttatggagtgaatcactgtgcaatttcgatacctgctttatgtaaacatacatgtaattaattattataacccagtatggctaatttcaatatgtaacatggcctgcctatgtagaaaatattatggcatcatataaaataaatatttactgataaatacaggaaaatacctagagcaaggattctaagtagataccaataccacttccaattctgatctattggaactagaatcctaatgcaccatgttatgagtaattcagaaggtggtactccctcagaggagacagagaaatgatgtgttagaaaacctgataaaactgcaggaaagggatgtgtggggaggcagggatggcagcacacaaacatttactaacttggattggaatttatttgcaaaaaagtcacatattatttgttacctatgtttattaaatatatatggtataacgtagaacaggtaatgtgttcattcatataacgataccatgttacgtcagcgtagactcaggttaggagttgaagggagccagtaggactgtatttgtctctccccaagtctgttcccagattataataatcatgaatattttctactccctaaggagtgagtactgctagagtctttctttagtggccttgagacataatgtttgcagaaatcatattcaaagaaatgtaaaacaaataaaatgatggtactattaatgatggaggttgagttttcagatattttctgctagaatcctgtactaagtacttatcctaaacttgccattatttaaacatattgaaattccttcagggtaagtatattatcagtcttttacactgataataagagaggtaaagacagttgcacaacattgcatagttagtgagttagctagaatttgaacccagaacatggaactaactccaaaccatggtctttccacttcactctgattggttaaggaatctaagtactttcaggatatttaatcctcattagcccatattttaaactgaaaccttaatttggctttaaggaatgaagacctggaatgattccatacgacctatatccttttcaaagctctcctaagtaacagaaactccaggatagggaatttggggataaaataccagttctgatttcccttgccatctttctaaatgttgcagctccttggagggattcttggcatttatttcaggccttagctcttggaattagtttaattacaattcaaaagagagtactttaatgtatttatttttatgtacttagggatctttattgcaaatgaaaggtaggacttttagcttcaggcaaactttattgagtagctcaaatgaagtcaccaatgacctgatctctctccttctttccattacgtgatataaatgtaatcttcagatgccaaattgggcttccccatccctgccctgtgcagcccctcgaggctcccctgttactgatctgagcctcacagtctcacaccacaccatctggagaaggaaattctctcttctggtagaagagagaaacaacttcttttctatcccagaaaaacatctcctttggctcttactggattacgtaccctaaactaatcgctgtaatcacagttgacagataaccagtgatatctggattctccagtgacaaaaagaaaaattttaattgtgtaactaagtggtttatgtggatgtgcacatagacagcttgctgttttaataatcctcattataactgacttgtactgtaatgccagctgaatttttttcattttgcagataccaaaaaaggtgactcttgagccctctaaaacaaactatatctgctagtttggtgtttagagctaagctttctcctaattcattggcctaattttatcgtctaaatacagtcatgtgtagcttaacaaaggggatatatctgagaaatgtgtctgtagttgatactgtcattgtgcgaatatcgtaggatgtacttacacaaacctagatggtatagcctactatacccctaggctatatggtatagcctactatacccctaggctatatggtatagcctattgctcccaggccataaacttatacagtatgttactgtagtgaatactccaggcaactatgacacaatgttaagtatttgtgtatctaaacatagaaaaggcacagtaaaaatatgatattattatattatgagactatcataagtgctgttggtttattgaactctcgttatgtggtacaagactgtacattcactaaacagaatgatcttcctcattccactcctagttttctatctggaaacaaatctttgaaggaatcaaaactttttactaacaacatgatttttaaataaatgatggattatcataaagcaatcaaatttaaaatgtgacatgctagaaacaaacttgattttcagaggtccggatccaagtcatattgtcatgcttagttaaaacttcgtctcaaatggaaaaaggctgagctttttttcttaaactatttagtatgacttttgttttgttttacttaaatatagttgaaaggaacagatcatcatagagagaccaattatcatctctaccacctgctcaccaagaataatttaaatcaggccaattctgcaatgcttatgtttttttttttttcttcccagataggtacatgctgtgctataacacttcagaaaatgtaatttaggttccaaaataaaaaactcaactgaaactggaaaattgtagaaaaaaaaaagattctatgaatgtaatggtttctttgatctaataatttctggataatatattggcattgattaataaaacctgattagggaggcaatagtcattattcaattcatttaacttagtggcaaagatatatagcttaaaaattatagacttacagagaaaaaatttaagtgaagaatcattggtatgtgatctttgttctaattatcaaattaaactcttttaagtgaaatgtcttttcataaccttcaaacactaataatgagtttaactggaaagaaaaaaaattacctgcacaggatttgtatggaggacaatgaaatgttttaagtctttagttccctagaaaactttaactgttttattatttataagctttaagtatttttgggcatagaatttatcttcacttgctccctcaaacttggaagttttcttactatcctctaactcaagtgtctgtaaactatgagttatggattattcacctactttaaaaaaaacaattttacttgaacatggccacacttactagtttacattgcctatgggtgctttttcactatactggcagaaataagtagttgtgacagagaatgtctggcccaaaagcctaaaatatttactatcacatccattaagaaaagtttacagaccttgatctaatttccctccaacaacttaatatagggaaagcactttatctggcaagcttttattatgaacttctctgatatttcaattggagtagtattgtcttagggtacttagccaactgtcaaaatgtgctaaaataaacatcctcaaaacatctttgtagaaaatgcgtgagatctgaaagaaaaaacatagcaccatttctttctttcatattggtccttttttatattttcaaaatatatttgaccattgggtgttccaagttctaacaacatgtaaactgggagagctggaagtgacactggcctggagatcagaaagggaagctggcatgtgaagtaacaaaactgaaactccatacttgagcagaaattgctcaaacaacaactcctgaaagcttggcttaatgcaagacgctccatatatatatattctccttttttttccttaaaaaaaaagtgtgccctggtttataatggaataggtatacagataaagaacaatagattaaaactaggagacctaatttctggtgttggctcggttcctaatatttaaattatcagggcatcagagtttttattacattaataaaatgtggtgattttcgaactcagggttttttaattttggtttgctgcactgtgttccacagaggccatgatgtgtctcattagctcagagattatgagtctgtttgggaggggaatgagggaggaggcccagcctccaaaatcctaattttgcttgtttgataattccactggtgttagatatgttttatctgagggaagggttatttagtttagccctcctactttccttctaatacatttataaaaggggcatctacgctctttttttttcttttaattttttttctgtactgtaataatacattatttattcttattttggcaaatgaaatgatttaaatataaatcctgctaacattatagtttgaattttgcagattttctagtatttttccataaacattttaaatgtaatgttaatcattcagcacatatacttttatagcatacttttagaagcttagcttatatcattttcactttttgtattactacatcatctcataaccataattttaatggctgtgttttattttatcaaaccactaactcgtggtttaatgttttggtgaaccaattaagttgcttcctcttttgtgatgcaataaaaatctttatacaaatttatgtgaatagccttttttacagacagcattatttactttgaaagaatttttgagagatggaagcactgggttcaacaggaagatatatacttcccacctgcttcctatggataatgtaatgatacaaatattattcacacatgcaacaacatacaaagatgtctgtactaatttttagtatcttgttgatcacttttgacataaaggggttagagtaaaaattacaataggaatatacaaggagtagttaccagcttaggaacagaaatgaaatgactttccctagaacttatgatgactttacttcccattctataacaaagtgtctttatcattgactttttctttttaaaatattctgcttttacaccagaatatcatacagtctctcaagtcttcagcctgttctttgattctggagtaaaggcttatttcttttcatcaagaaaaagaatcatagagattgaactgtcctttataattagaataacttaaaaaccagattagtggataaaaaagagaaatcagttagggatcttcttttctatagcaattgtttaggtgtcattgaaattaatatattaactaatataaattattactttgtattcatataatttaaaatatttgtataaaaacaagtactttctgttaatctaaatctaaatctaattaattaatataaatctaattaatgttattgttaataacaacatatattatcaatgtatgataaagaataaaattaatttaataaaattaaatgacatagggatatgcatgtcacaaagacaaacgattaacttgttgaaaagttatgtcaaaaggtagaatttttttttttatatttcagaaagatcttatgactttaggaaaattgttggagcacatttcttggaggcagttaattatgttccctttgctagtcttaggtggaacaggaggaagaatgatagaatgtaggagagaagatgggctattttaagtgagggtataatcattataaatatctcagtctctctgtacatttcgttagcctagagatttttttttcatttttacttagctgttctcctaggaaatcagattattttatctacaaacacagaattttgtcttctttcagtttaccagaatatcagaaaccatcccttttagattagttgaagatatattttaaactatgacgtacagaaatcaaatcctaggtatcaagtactgctacacatgtaggatattagcttgttgcaatgattcaacctgattattgccctataaagcagaacttgagcttttaaaataactcttgtctgaatgttctgttgggtatacttacctggagatcatttcttccaggtcatgacatttcagttcacctaggactctgcggaatcaaaaaatagcttttggaggcaacctcatccctcatccctcacctttgttttacagatgaagaaactgaggcctctaaagtattcaggatataaggcccaagttccatctacagagaataatagagtatagtttccccagatgttggtggcattccctgactgcctttcagcatttgtccaacacactgacctaggttaacctgaatctctctacaatgtgcttaggagagatagaaataactgttttacaaagcaaatataaaacttaattctttaaaattgtggtaagaatgtttaccatgagatctatcctcttaataactttttaagtgtgcaaggcagaattgttaactatatttacaatgttgtataggaggtaggcaacttattcatcttgcctaactgaaactttatacctgttgaacagcaaccctccatttccctctccctctactcctggcaatcgtcattctactgtgcttctgcaaatttgcctatttaagatatctcatgtaagtgaaatcatgcagcatttgttttgtgactggcttatttcatttagcataatatcctaaaagttcatccatgttatcctatatggcagaatttccttcttttttaaggcttaataaattccattgtacgtatatgctacattttctttatctactcatctgttgatggacatttaggttgtttccacaacttggctattgtgaataatccctcaatgaccatgggcatgtgaatatctctttgagattttgatttcaattcttttggataacacccagaagtgggattgttggcacatatggttgttctctttcaatctttcaaagaacctccataatgttttccacaggggctgcaccattaaacattcccactaatagcatatgagttttcagatttctccagatctttgcctacacgtctttttttttttttttttttagataatagccatcttaagtgatgattagtgatgttgaacatcttttcagatccctgttggccactagtatgtctctttttatttatttttacttttgtttttattttgagacatggtttcactctgccacccaggctggagtgcagtggtacgatcattgcaggcttgaactcctgggattaagctatcctcccacctcagcctcccgagtagccaggactactgatgtacagcatcttgctggtctaactttttttttaaattttccttaaagacaaaatattccatgttgcccaggctggtctcaaactcctggactcaagtgattctcctgtctctgcctctcaaagtgctagaattacgggtgtgagtcatagcatccagcttgtatgtctttttttgagaaatgcctgttcaagtcctttgccctttttactgggttatttgtttatgtggtattgagttgtaggagttctttacatactttcaatattgactccttataggatatatggcttgcatgcattttctctcattccctaggaggtctttttattgtgtcaattgttccctttggtgtgatttttagttcattgtagtccacttgtctatttttgtttttgttgcctgtacttttggtgtcatattcaagaaatcattgccaagaccaatgctagaaagttttttccttatgttttcttctatgagttttatagtttcaggtcttatgtttaagtctttcatgcattatgagttgattttttttttatatatatatagtgtagaagtccaatttcattcttttgcatgtggatatccagttttccaaaatgacttgttaaacagactgtccttcccctttgtgtattcttggctgtcttgataaaaatcagtttattatatacgcatggcttatttctgggctctttatgttgcactggtttttatgactatccttatgtcattgacatttgttttttgtttgtttgttttgagatggagtctcgctctgtcacccaggctggaatgcagtggtgcaatcttggctcactgtaacttctgcctcctgggttcaagtgattctcctgcctcagcctcccaagtagctgggattacaggcatgcaccaccatgtcgagctaatttttgtatttttagtacagaaggggtttcaccatgttggccaggctggtcttgaactcctgagctcaagtgatcctcctgcctcaacttcccaaagtgctgggattacaggcgtgagccaccgcaccctgcctccacttggttttaactaccatagctttgtaatgtattttgaaatcaggatatgtgatgcctacaaatttgttctttttttcttgatgctttggctctgtggggtcctttatggtttcctatgaattttaggatggatttttctatttttgtgaaagatgccactgagattttgatagaaattgcattaaatctgtagatcactttgggtagtatgaacatttgatcagtattaggtcttctaatctatgaagatgtctttccatttatttatgtcttcttcaatttttgtcatcagttttttttttttggtcttaatgtacaggtcttttatctcctaggttaagtttatttctaagtatttcattatttttgatgttactataatgggattgtttcttaatctccttttcagatagtttcttattagcattgataagatttcttcacatttgtttgatcttcatagtatagcacttttcagctattgttatattacatacagctttctagaagttgtactatatcacattaagcaaatatgttaaattccaaaagaagtcattttatttatcaattatgagatccccatacataaaattaagcactataaatccaatttatttcttcttttaattattatgatgtagtttattgagacaggtggtgatttctgagagttaaggggagaaaaaagattcacaaggacacggcctttattttctttgcaaattcagctgctaatacaggagttattaagaaattattttgcagttagaaagagtaaaagaatccttggtggaattttccttcaataaaaagcagcctccaaaccatttcttttctaatataaagcagcctgaaaagtctagctgcaagtatagctatgtaagctagaggcttgcatatgtaaatgccagcagctgcacctggaagccaggtacattcaatatggcgattcctgctcccttttccttgttgccacgtgtgtcggggtcatggcgcaggacaagtaaagccatctgtgcaggtgtactggcgaccacctggtagtagctgtatttgcacagtaaaagattagggtaggagggccagtcttttctcgagctgtgtaaatggcacacctggtcaaaccaatcccctgggccttatgtaaatcaatcaccgcctcttcaagcctctgtactaaatcgatagcgttccgcccaaacgtggaaaccccgccttgggtaacctactttctcaacatgaggaagctttgtctctctctcctcttttttatctgttaaattttccgttccttaacccactccaagtgtgtgttcgtgtcattaatgatcttggcgagagacaacgaaccatggatatttccccggacaatgaagccgattcacgtctacaatatttagttcacacctctagttcgatgacttctctagttcagtaatttctccagttcttctttttctttatgcagtttatagccaaaaacattcttccttgatagccttaattcacttactttgaagtaaaccttaaaagtgatacttaaccctacatttgtgcagtagggttctcatttaacacgttaaatgatttagaaaaagcagttgactcgaaattactgcctactttttctaaaataatagtaaataaaatatcactacatattacaaatcatagtaacggtgataatgttagccaatattaatcagtgtttactctatgctaaatattttgcacgtatgaatcctcaaagcaaacatttttttgtgtatgaataccaatatcctcactttaaaaacgaggagactgaggcatggagatattataagctgcccaaggttgcatagcctggaattggtagcaccacagctcagacccatgcatgctgccaccattccccaaggctagtccacattccatctaatatccctgatgagttaattcattatggtcttccaaattcctcatttgttgattatcctatgttacctggcattatacaatttttaaatagcttcataatcaactagattattaaatccttgtaagaaaactgtgacctacacatatatgagggttataaatcactaatgaatatttataagtgacagatactttgttaagcaagtgacttattttattttatccttactacaaccccctgaaggataatttttcccagcccctttaagagatatttgttgagattccagcaacttgcctatgtcttattttgcttgataaatatctcttgttcataatgatcatgacatgcagaatcataaagtcattcttcatattttgaattaaaataacttgagatcccctatgctgactctcatttcactgaaaagcctatgagataaattcctatatgatagttcatcagaatagagcaaacagaaattagcaattatggaaactacatttttttttcctgagttgcttgctataaattctccttacattggcaaaggataaagaagactaaagaaatagttcataattttggcaatctggagagagaggtaacaagagctaattcatcctggctgactcagaaaatattgtgactgtgggtctgcactatcacaaagttgaattgtcagtcaggctcacaagaaactaagttttactaatggttagcaaaggatataacaaaggagtcacagctttcttgtatcctgtgctaatgctacatcagtgcctgggagcccagaaatcagtcaagcacagcttcctaaatccctttctaacactgtgatgcattttgggcttggagagaggaatgctaactgtttgacttccatcagcgcagggaagccctttagttttggggtctcgtactttccaaatgacttaatgagaatgaccatttaataacttccattctctggtgggtttgtgtctaataaattaaaaaatgatagtttacttacaataagcaatccagacaaacttaccatatatctggctaaaaatatttcatacagtagagcccccagaagaccctcttttatcttgtagctcctgaaatcagtaagtgtgtttacaagaaagtgtggtcaaggtcaaaatgcctcagcatatgggaggagggagaaatctgcttatacatacatatgctattaactcattacttcccattgtctctcttcaaagagatatggagataaatctataagcaattgggaataaaaatattactaatcaatgactattagcatctaataaatgtcatgcaaataaaggaaaataattcaagtactaaaatacatatattctatggtaggtacagcaatacttccttacaagtattgcacagtgtaacaaaatattcatttagggtaaaggtgctaaatgaaatataggacacccagttaatttgcatttcacataaacaacaaataatattttagtataagtatttcctatgcaatattaggtcttgtattttatctgtcaaccctaactataaatcctgttttatgtgttaagtttggccaccctactttcaggtcatacattggatgtagtacagctcaatgattagaacgtgaatttgggagccaaattttgggggatcaaatactgactttgctatttacaaactgtgtgactttggggacatgatttaatctgtctcaatttctcacctgtataatgggggtttcatcaggctagatgagaaaattcatggtaatcaagtttccagttctgattataaatagaaaatttctactttagtatggctatgctttatgtatgtagagcttataaagtagaaatgtattcctagtacattttaagagccatataaatattaagtactacttttttgagttctacaaatgtttgcctttcatacatcacaaaaaataagagatgaaaagggcctcaaatatttcataactgcgcctgcagcatgatctgctcatatttacttgaatattttagcattaacatgatatttaaaaatctatacttctaaatagcatataattttcagtctgtaagcaggaatataaaaagagccatcagacttaattagtaaaacatacctgatcactgatttaaaaaatgcatgaattcctataacctgctaaaatatacttctctaaatatttttaaaaaggaaagcaaacccaaaatcctcttttcagaaaatatttccttccttactatcaaaaaaattaattcttgttcaatattctcttaaatatgcatagtgagcatattatattttttataggtttagtttggttgtttcttaaatatccttttatttttagaaaaaattgatggcactttctggtatgttctaattgtgaaactaaaacattagattttgttatcaacaacataaattaccacctactgacttattctacctatcatttgcaagaatgctctgattttctgaggttttaaaatagtgcagaattgaggtagatttcatagtaattattctctcaatagaatgatgggtaaatagattaaataggcattatataatatatataatccaggcacagataattgtaattgactttatctacaaattttgttataaaaaaccaagtaaagttctaatgcttttagcaaatagtggtattgtataaccatagcaatcaggacagatatacagtatttggtcatttttcctaaaaaattatattcataaaaatatctttttaatgtttgccagagtaggggcatatgcttattttgggaggtatttacggctaaaattaactgaagtaaagaggagatagtttgtgattctgtgctcttgttgcttttacacacacacacacacacacacacacacacacagagttttctttttaaacaaatctgggctatatatttatcatttccctcaaagtagttacaggtacaaaaactgaaatactgaatggtcactgttgctctttataattctaattaaacaagggtttgccagctgttctgattgtcataaggcttccccaggatacaattatgctctggggtgttttaattctgtaacaatattaaaatataatctgtacagaagcacattttccactccattttcaaagcacacaattagattttccatgattttacttaacacaattctgtatgtccttctaggtataactattgtttagctgaaacttacttcttttgccttgattgggtgttgctccttctgtatttatatcttgtatgtctatttttgcttaaaccaaatgacaaatatcacagagggacttctttacagtgtcattagttagattgatgggaagatagattgatggatagaatttccattcctctgtgcaaggaacctgactctgtgcaaacagccttaagttgtaattatagattcactgtgatggactctagagaatttgctgcaagagactttttttttttgttatgaattgttcccttgaatgtaaaacctatgatagaagtaaattttcttaactggagaagccttatttcctccctttcttttctagttgtctttctttccttttcccctgcaaatgaggcctgcggagaaaagcaccagaaataatggcataacaagaagggacactcaactcctgaataatggaatatgtatctttctggttgccctgctgtatgctcgtagcttgaaatcacagattgcaaggcatttctcaattttaccccgttacaatagtcacctttggcccctcctcatttcttgggatcagctcttctcctgtctctacttttgaatatctaagttgcgcatctggagtgtgttgctgcgtttggcttgtgggaatcacactaccaaagtagttagggaatgctaactacatcaagccctgaacagcatcttccctttcaatttgggatacatattgcttttctcaaaaaataaaactctttgacctgctccatactattagattagcacctacctctttctaaatttgaaatgaattctacatgtgttttttgaaaaactccctttaattaattacaggttcaataaaaggacaagtgagaatgtaccttgatgtattttctagagaaaaaaaaaacaaaaaccctattgaatctttcatcctgctttgaactaggagggtttaaatatcaagcctctttcgggataacaaaaaactaaactgagaaaggccagttagaataattttttctctagtgtggctaatttttagctctaatgtctgacttcttggaccttagacactgaaagatctatgcttgttagccaatgaaaagaagtacagtataattcatgagcatgcagtattgaaacatattcaattcaatcacacttagtaaagtaaaaagtttcataattttcagttccatttattttaataattgtgaaacagttataaatcatatgtcatgtagaaaggtaacattttctcctttaatgtagttatttctaaatttgctaacttaaatattaactcttcatttttagcacattggaaaatatagagtatgtcttctgggaatttagaaatttttattgtaatctcatttatcttcctatttatagtgtacaatatgctcacagacatctaatccttattaatcagtcaaaaagcttttattaccaagcattcccatgcccaacagtatcctagacactgtatggcttaaaaatataaatcaagtaagaacatcatccacctaaccaaaacacctataatctaagtagttaacaattatcgaaagtttgactacctatattacttttaaacaaagttgacttcaaaacaaggaagattaccacaaatatagcattagataatgacaatggggtcgatttttaaagaaaacataacagtcctaaatgtgtatgtacctaaccaaaggccatcaaaatatatgagacaaaaattaatataaatgaaaggagaaacagggagtccactatgagagttggagactccaaaatccatctgccagtgattgaaaaaccaagcaagcaggacatcagtaaggatatagttgactcgaatagcaccacgaatcagtttaacctaattgacatttatacaatagtccatctaacaagagcaagcgatatgttcttctcaaactcacctggaacagtcatcaagatagaccacattgtgggctataaaatgcactttaataaaatgatagaactcatgtaaagtatgttctcagatcaccaagaaattaatctaaaaatcaacaatataagacgtttgaaaaatcccctagtatttgggcactgaacaacacactgctacataatatatgtgtccaaagaagaagtcacgggagaaattttaaaatactttgaactaaatgggaatgaaaatataatttatcaaattatatgagatgcagtgaaagtagtacttagagggaaatttatagtaacaaatgcatatatttgaaaagagaaaagatctaaaattaataagctaaatttctctccttaggaatagagaaaaattaagcctatcccaagaggaagaaagtaaataatgaaaattaaagcagatatcaatgacactgaaagtaggaaaataatagagaaaatcaatgggaactaaagctcgttctttggaaagataaacaaaatgaacaagtcttttaccaaattaatcaagaaaaaaagggagatgatacaaatggtcaatatcagaaatgaaagaagtttctttactactgattgcatgaagattgaaaagataataaatgaataatacaagtaactctatcctcacctatttgaaaacttacatgaaatgaatcaattccttgaatgacataaactatcaaaactcacataaagagaaatagccaacttgagtagatccatatttatcaaaaaagttaatcagtaataacttctcaaaaatgaaaaaaccagattagtccagattagcactttcctactgtttctatgagaggtatcactctaataccaaaatcagatgaaggcgttacgagaaaagaaaactgcagatcaatatctcattaacatagatgaaaatatcatcaacaaaatattatcaagccacatcaaaaatgtataaaataagttataaactacagactggtaagatttgtttcaggtatttaaagctgtttcaacattagacaatcaattaatgtaatctaacatatcaacaggccatggagaagaaaatctatgatatcatcagttatgatggaaaagcatttgacaaaatacaacatctattcatgacaaaaactctcaccaaaccaggaatggagaatttctttagcttggtacagaacatccacaaaaaataaataagtaaataaataaataaataaataaatcacctaacatctcatgttttgatgagagattggatgccttccctctgagattatcaaccaggaaaatatgtccttttttcaccactctatttaacatcatactggaagttctatctagtgaaaagatgagaaaaagaattaaaagccatatagattggaaaggaagaaataaaactgtaataattaacatatgactttttttaaaatgtagaaacaccaaaaaaactacaaaaaaaaaacaaaaacaaaataaataaccaagtatagcaaggttgcaggattaatggtcaacatgcaaaactcaattgctctgctttatactaacaataaaaaattggaatttgaaattaaaaaaataccatctacaatagcacaaagtgaaatacttacatataagtataacaaaatatgtacagagtctgtatgcagaaaattacaaagcaatgaggaaggaaatcaaagatctaagtaaatggtaacatattctgtgttcatagattaaaggactcaatattaagttgccattctttcccaacttggtctataaatccaaagcaattctaattcaaatcccagcaagctattttgtagatattaagaaaatgtttctaaaatttatttggaaaggcaaaagacgtataatagccaacaaaataatgaagaaggacaaagttgaaaggactcatggtagtcaatctcaagacttactacaaagctgtagtagtcaggacagtgtaatattggcaaaagagaacacatcacatataggtcaatgtaacagaatagaaaaacccacataaatgaggtcaactgattctgacaaggcaaaaaggcaattcaatgaaggaaccatctttccaacaaatggtacaggaacaatcagacagccacatgcagaatgaaagacagaaagagagaaagagagcgacagagagagagagagagagaaacataagcaaagaccttacaatttacaaagaaagaaagaaagaaagaaagaaagaaagaaagaaagaaagaaagaaagaaagaaagaaagaaagagcaaagaccttacaatttacacaaaaagttaatctaaaatgtaatgaaataaaaaactataaaatttattgaaaaacaggaggaaatctatgtgaactcttgtttggtgatgaatttttagatacaattcccaaagtacaatccatgaaaaaaattagactttattacaatttaaaactccttatctatgaaagacactgctgaggatataaaaatgcaagctacatgagactaggataaaatgtttgcaaaacatatatttgataaaggatgtgtaaccaaaataacagagtttatctcttaaaacacaacaataagagagcatgcaaaccaataaaaaacaggcaaaacacctaaacagatacatcaccaaaaaacttacaaacagtaaagacgttcaacatcatttgtcattagggaaatgcaaattaaaacaacaatgaggtaccactatgcaactattagaatggctaaaattcaaaaaactgacagtaacaattgtcagcaaaatgtggaacagcagtaacactcattcattgctggagtaataaaaaataatacggccactttggaagacagtttggcaggttctttaacactaaatggtcttactatataatttggcaattggagttctaggcatttacccaattgactcgaaaacttatgttaacacaaaaatttgcatacgattgtttatggcagccctatcacaattgccaaaacctgaagcacccaagatgcccttccatagctgaatagataaacaaactatggtgcacacatataatagaatattatttggtggtaatggaaaatgagttatgaagacacatgaaagacatgcatgaattgtcaacccatttttctaagtgaaagttggtcagaaagctatgtactctacatgattctgtttcaataacattctggaaaagacaaaacagatgaggggttcaggaagagggagggaaatgatcaaataggtgaaacgcaggaagagttttagggcagcaaaactattttgtatgacattgtaatggtggtacatgatatgacgcatttgtcaaaacccaaagaatttacagcagagaaatgaatcttaatccatgccaattaaacaaataattaagtaggtcagaggatcataggactatatgcagaatgtgacaaaagtatttaactgttattacaaatgtatgcaacatcttcactgaagagatggcgtggggtcggggagcaatgagctaggtaacttgggaaataagggcagtctgaaagattaaatgcaagggaactctgtgtcagctctgtactctagttgataatattgttattcattggaatacaggttaacaactatgaaaccactatacacatatacaggaaccgaacaactgaataaatgaatggtggatggtgagagccaggttttcactgttgggattgaaagtaacagcagagataagcaagagaaagcattaataatccatgtagtaatggattcgagttggagacatcagtaaaaactcaagtttcatttaatataaatatacatggttacacatagaagtatttttagatgtgtgtatgcatgtggattagaacatacagattggtttttgctctgttatgtaacaggcttagaggaaatgacaccccagtagtaatgagcataccaagtgcccaggttttgacttctaacaccatcctccaataaaaggaaccaggaccctttggagaaatggctgattggggcaggaattatataagacgagcttggagcatcttgattttccagaatttaagaaagaggtcaaaaaagtccccccccagccaatgctgggattatatcaaagtgacacaaaagccaaatggtcagagctaaactggtcaccttctcctctgtgctcccagggacaaggtctccagccaaataactctcctcatcaaacagaccaggtgaatttcttgcttctccctgagctgggggtttcacttccctaccagctcacaaagttattcaaacaaactattcccatgggaagtagaaggcattccaccctctctatcctacaaagcctttctcccacagtccctggttgttcactctgttctcaagttcaattcccaggtggtcttgcatggtgtgcagtgtcctttgggctcatctgaccagtgttgggtcttgtgtgtttggccatcccataatcctagagcaggaatccctcctttaccaaagggttgaataggtggtaattcacatagaacacactaacggaaaatgttaaaaattaaatacataagtcatggcatcccatgaacactctgtaatatctttgcaatctttctgtaaatctaagacaatttcaaatttttaaaatgttatttgaaaaatcataacacttcaataacccttttctcagtattttgtatccagattctctaaattgccttgggtcactcagctcataaatgaaggtatctggatttgtacccaagcaattcatacccatgagaggaaatttagcttagtgatcaaaaggacaaactttggagctggactacctaggtgtaaattctgactcttctagttatgagctgtatcatcccaggcaggttaggaaatctctctgttctttgttttttttttctcatctgtaaaatgagataatgattatatcttcctcacaggattaaatgagttgagtcaggtaaagtgtttgtacattattttgcacagaataaattttaaaaatcagctataattattattacacaaacaaagtagagttaacaaggcaaactgcaacacaaatttatacatccaagtgaattgtcctgtgatccaaatgattgtatgaaattaaaactaagtgactttttgtggtacagagcacgtacttggccatcagtatcaccagtatcaaggcttgtcagtgtcaggagagctgcctgttatgtagagtcaaatgaagtgagaagggagttgaactcagaacgaaggtatatttcaacgctaatgacatctctccattttagatgctgtaaatacctagtgtttaattccatcttatatttaaacatctcaaagttagccattattattgttgttactgttgttttacagttagttcctattttagatttaataatttcttagtccattatcatttcttgtatcctcacatatcttgcaaaccacaccttggttctgggttcaatttccttcttggttcagtttcgttttttgttttttgtttttttaaatattggagtatattgtttactagttatttcagagaaggtgtatctgttaaatataaattcagttagtcttttagtctaaagagtattttggcctaattcatgaatcacaggttaattgtgtatagaattctcagcaggaaattattttctttcagggctttttagattttatttcataatcttcttgtctttgttgttgttgaaagttttgcttagtctaattattgttcttttgggaagggatttttaaactcttattgcctttaagaattttttgcttggctcttctgactttcttctattatgtatactagtacaaatgtatatgtatttatctcacccaggccttgttggacttaaataaatataagaattatatttattattattattactagacactgtctcattaaatgctgtctgcctgccagtttttacctagtgtctccttctagaattcctagtagattataactgaatttcaattcctctcctctccttgtcgtaacttccctttcatagttttcgtctctttatctctctatgccacattctgaatgatttcagcagacaaaacctccatgttattatctctttcttctgatggatatttaaagccattcactgaaattttcattttaatgattataattttctgatttcaatctatgtcttttaatgtcacaatattctattttttcattataattttcatttcacatttcctttccttaattaatttaagcataatcattttatatctttcagattattctattaatcttaaattcttagatatattaatcttgccatttgttgcatccgactttttcagaggtagattgtacccttgtatagtttataatttttagctttaaagaaaatttttctttttcccatgtgggagcccatggcaccctggatcatagaggtgaattacaaattgtgtatttgtttctacagatagctctgtctagaaccaatctgagcttgggatttctgcattacgtagacagtgtaaattcatactttgcaatttcatgtagcacaaactgaagcatatatttctcatggaagaaatttttcctgcctagagcctcagaccaagacgatattccttgacaattccctggctcagcaggcagtgtagtctaaatctctttcacaagtgtaggtaatatttttagcatcccaacttcatttagtgtcttactttaccttcccacctcaggcaggtccaaaacctggtattctttccctgtgaagaattaggatctcatcttctggcgacggggctttaattcagatcccatatcctcccaagctgctatataagcttaggtgcttttcatgttgtcatccagttcctacttatttctggaagctagaggttttaaaacattcttttgagttctaaatattactgttaaaaattatattttaactagcaattaaaaaattgtcattaaaaggatttctactttggctttggccaccatgaaaccagaaccacaaattcttcatctatctaagcttcagtttattcatgataaagtttggacccatactttaggtttatagtggtaattaaatgggatatgtctgtaaagtttttggctaattatacttggctttttgtaagcactcatttgatgttagtgattattatcatcaatattcaaaaccaatttttttttagtttttcatttagcagttaattttttttaacaactgacaggtcacagtgaaccttgataagagaaataaatacttaaaccctccttttgacatgtaagaaagtctctttgccctcctgacttagcctccagaagtcattctggcctagatcatccaagaaacacaaaatcccctctaaccataatacacttttttattatatacatttatgaaagccaggaaggaacacctaatggaaaatgcctatttagaagggaagggaaggtactactacaccaacttatttgggtcctctgacttgctttttcttctactttgtctaagagtaactaaaaagccaaagaggatgaaaatggaaaggagaggctggtgctagcagttaatttgttctgtgaaaaaaaattgttttaatatgattataggacagggtttccctgtccaaaaatatgtggctaatgagcacttgaagtgtggttagtctgacttgagctatgctgtcagtctaaaataaatattggatttcaaagacttactacaaaaataatgtaaaatatcacaataatttttagaaatttgattacatgttaaaatgataatctttgggatatattaagtaaaatatgttttaaaaattaatgtcattggtttctttctggcttttaaaatgtggttagtaaaaccaatgaaaagtacatatgtggcttgcattgtattttaatgaacagtactttagatttagggaataagttcagtacaaaaggaaaagtgtcaggaatgaaacatggaagttctggacaagaggtaaatacatgtgcttttatatagactataattttctaagtattataaaactactgttctaaataagactcatgtcatattttttttaagagtggggctctttacttcctccatgtaaatcctttcggataaaggagattttcttggattagagtagaatgttctctttggggatattacaatagtactttttctctctacaatcttaggacagtgtcaaaggataggttgggagtacagagtgactaaaacacttatgccaataatctctatcagccactaacaagaccatcctaaatagtcttgcattctatataaaaaagccttcagtatatagcatagctttaatacttgccctctaatagttgattctcagttcccatcattttttgaccaatcagcaatatttgtcactgattattatttcttcattttgaaacattttatttaattattttattctctgttttccttgctggttccctttgcaactctccatctaaaattgaagtacctagggctcattcctaagatcaattttcttgctcatctgaactccaggtaatcttatctatttccctggttttacatattactcaatggtgatgtctccaagattcctatctccagcctgtactctaaactgaactccagatttatagcctaatgcctatgtgttatctccatttaaatgtcctagaggcaactcaaatttaatatttccctcctcaaacctgtttctcttgtagactttgcaactcattagaaatggactgcattagtccagagactcagacaaactgatgtcatgttaactcgttactttttcttccactcaacatccagcccatcaggatgtctttcacaatttatccaaaatctgaccacctccactgttgccccttggtgtaagccgccatcctctctgcttacaacagcttcctaatctaactggtctccctgcttccattccgactcctgttcagcattctccatacacagccagagttatcccattaaaacatatgtcagataacatcccttctgtgttcaaaaccatccatctcactcaacataaagtcaaagcctttatcaccacagcctatgtgtccctacattgcctccctccctcacccttcctttaacattatcttctaccactccccttccttcccattaattttattccagcaaatctggcctcctgtctattgtttacacccactacgccaagtatggtcctgctggaggggttctgtccactctgtttagaaggtcctgccttcagatataatcacagcttttgttgtcttcctttcttcaagtatctgctcgtatgtgataccttccctgacagtcctatttaaaattggacacacatgcacacacgcccttcatccacacccacactaccccacccacacacactcagcactatcacccctgaatttgctttatttttctttgtagcactgattttcattgccaaattatctatttttctgtttattgtctatcttgtcccaccaaaacataagtttcacgaggatagaaatttcatatgctttgttaattgctttacctccagtacctagaataatgtttggcacatagtgagcactcaatatacaatttctaagtgaataaatcaatcaatgaacctccaaatggatttttcttaaactctttctttcttctttcctttttttttttttttatttaaatgagtttgggtcttgttctgttgtccagacaggaatgcagtggtgtgatcatagctaactgtagcctcaaccacctggcctcaagtgatcctcctgcattggcctctcaaagtgctgggattacaggcatgagccaccatgcccagacatatattctttagagacataaaagtcaatacttttgtaaatgagttgtaaggtagcaatcacctcaatcattattcaaaattacttttgaaatcacactatactcatggttttatttttacttcagtatatttctgtccatttattaatttgttcatcaactagaagtatcaaatgctttgaatttagtagaatcaattatacagttcaatagaattctctctttgagaaaactatttttaatctacatatcatcttaaaagaaaatatttataatacccagttccagtgtttgagttgctttattcatgtcctatgaacaataaaagagagttaaatcaagtaataaagtaccaaccaactgtgggagatgtgggctttcaccatttggggaagattatcgccataactcaggcagtaaaatagtcctttttcacttggtaagcattatttctttaatagtttctttaccatggttcactagtaagtcacttaattttgtttaaactaagtctaaacttttaaagcgccatctaccgtacactggagtggctttgtctgcagcattagaggagaccttctataattccatactttatccttgtgacccaaataaaatattcatcttttaagtcatggcagaataattaggagaggatatgacagctttctggatatgtatttgcctttaatttaattctgatttgtagaacacttaatcattatagataggaaggtcatctttgttaattcagtgaaaatattcctatagaagattccaggtaatgctttccatgcaacccaatcaatctttaaggatgacagtaacacattctccacactgtattttgtcacatactatcagttactgcgctgtgtttataaattctgtgatgcacatcagagggcatttacaaagactaatgaagagtttggcaatttcagaaaccaaagctgaagtaacactacttagcacttagctgacatttttcattttcaaattacttttgcatgaatactaattaatcttaacatttccatgaagaatgtaaataaaattatgatccttattctgaatacgggaaaaatgatgtagaaaggctaaattgtttttgtattcctttaattctacctatatatcatgtatttaagaatctatttttccttaaataatacacaaatgatcaaacaaacaaaaacaacacaaaaccttctaaactcagatttcatctgtttgaaataccatccctaggagattagtctgttccttctcaataaaacctattatcctatttgctctatctcttgtccattcaaaccggtctttttttttccaatctagtagcttagagcttcagaaaactatgattgtacaatggccttgttgtagagatgagcaaagtagaggtgcagtggtgtgatcatagctcactgcagcctcaacctcctggcttcaagtgatcctcctgccttgggctcacagagtgctgggattacaggcatgagctaccatgcccggccatatagagaaccctagagttgaagtgatttagccaaagttccagaatcagcatttgacctcagatatatacatatatctaccctttgtgtcttctacagcaaaactagttatcacaataggaagatgattttactgtttttatttccctccattttctctcttgctccccatcagttaatcctctcttataccattttctgcttccatggtacaaagacaatcaagaacatactcacctgtgagtagctaggaaccagggaaagagagacgatggacagcagggtcagcccttccaggatggggattgcaaacaaacatgttcagagcaagaataagcagcagcccccaaattaagagaacttgctatgaaacccaaagaaaattctcagagtggaaacttggagggcattaattttcatacagaaggtcaatacaactggtgtggtggatgaataatgtggtatttcttctaaacaaggcaaggaggtgaagttttattttataaatttacactgcttcatgactttaggcaatggaaagtgagactcatattaatgagttggaaaaaagtgcagatataggtgtgcaaatgaatacaacgttaattgcaaaaatctttcaggaaagagcatctgcttataatgactattatgttaatttaacgacattaatgcagccaaaatatgacaacttaatgctgattattttccgtacatgttgataactaatgctttctagtccttgtatggagcctaattgaaaaataattatcttactttgaaggtttatcatcaatacaggataaaaaacactgtggtacttttgtttaatccataatgcaccaacatttcaagtcacggatttatctaagtgatgaaagcgatcaagttcaaggtgcaaaagagacaataaaaaattcacagacaactatggaatatttatttcatcttctgttttcccattaatcttgtttgaaaatcttctctactatagaaaaatgaatagcaataagaattttattaaaaacagtttcatttattatttttaataaaagaaataaccagcatgtcaagttgatgtgttttgtttgcactgattaaaaatgcagttaacatattctctatattaaatattttacgtttttatacacacacacacacaggcacacacacacagtaaaggaaaaaagatttataattatatatcttactattttcaagaactgagcaagaggttaacacattttgtctcaggatttgcttttatatgaaggacgctttggttcgtattagttaaaataatgctgttctatgcagtgatataacaaatgagcgtccaaatattaatataatgctaacattgcaaagctataatctggcttgtaaattcaacgtgggccaggacagcctccatattttgttgggtactggacatgtgactgttaagtttcctatagaaggggacgagagatgaaggaagttcaccaactccctaacagccttatttacatccatgtccagaactagtcacatggccccagcccaactacaaacaaagccacaaattagagaggaacacatgatatatgttgaggtctacattgaggtctatcataattgagatttgattattttcaagaaattaaacccaacccaaaccataaattggtttgattaaatctggattgtttttatttcaggtgagctaaattttcaccattagcacaaaacaaaaaaatatagtcactaaatccaccaaaatccaggaaaaagcagctatttcaacatggaaggttcattttaaacaaaagcagaaaatatctgaaaacatgctcactctctcttaatcttgcaattaaacccattaattaaagccctgtgttattttgcagtactctagcatataattgatcttctgtaagctagctattgaaagagaatcaataaacttaagcaaaattttacaacttggtgatattttacatggtggtgctgaaagcactctttattcaccgtgaacctctatagccccataattacaatgaactgaccaccgtgtaatcacccctcagtggaagacgcagaacttttattcttttgaggaggatgactatttttgagtctgcagcaaggtatttcattaaaaccaagatatggggaaggatacgttagcgctaggaggaaaaataagataaaaggccaagatagacagatgatgacatagagtaattgatctgaatcaaggtgaatcaacaacccactttcaagatgtgaaataaataacagaaaataaatagttgcataactctgtagtaatgtatatgcagaggtgcttcgtgtatttttgtttgcaactatgtccagaataagtatgcatggacatctgagtggaaactgtactagtagaaaaatgagccagagacattttatttcattgactaaacatctagattaattacatcaatgctaattacattgtctaacagtagctgtcctgctgctactctcatctttcctgtaaataaaaactaccattaccccaaagaattggctatgagataaatttcattatgctagtcaaggattaaccacccgtcatacttttattacagaaatattttggattgtaattacctgtgatgtcttatacaccagtaggaaaagtgcaagattctcaagggaagagctctgatttacttggctgctgctgaacgaagtttttgaaacattttattctacagggttgatggaagacatgatagcacaatggggcaaggaggaaaagaaaactccagaggcttgattttcaaagatgttacaggctgtgaatttgagattgttctcaggattctagattgagaatacaactctcaacacacagttgattctgaatgcatctttttctactctttcttgtattcttagcagccagtgctcctccccctgtatccgagagttcatacctatataattccaacctgttttgcctgcatgccaaattctttctttctgcctttaaatatatacatagggtgaagaagtgggggagtaactggttgagtctcaacatgaggccttgttgcataccaccgttttcagcctacccactatccttagctcaggttgcactgatccaaataactgtcacagaacaactcagctgctgttgcctttcttgctctactttgcactctattatctattttatataaatatttattccatccatctactgaaaaaatgttcgctcaactcttaaggatgaccaaattgggtagaattccagaaggtagcttctagcttagttcaccaagtgaacttagattaatcttcctaaaatacatgtttgtttccttaccatcctacataaggacttgtaacaaccaaatttattgaacatttactttctgcaaggcattgctctgagcatcttaattcatttaatactcccagtgtttctgtgagatagatgctattttattcccattttacaaatgatgaaactgagtcatagagaggatactagtttactaaggccacctcattagaaaatagtacagttgtgatttaaatccagtagtttagtgtgttatgttacatgaccattcttggtctagttgagctttactggaaaaaaaatagtaagaagaatatagttcaaaccttctaatcaagtttaagaccctctgtaatcttcacatcctctacttatcctgtcttaccacccaattccctgaaacgtagaaattccacctctattcctcttacgctcattacaagaactgaggatttgctcaaaaggtcttctcaatcggaatgtccttctagctgctgccatctattcaaccccacctggtttctaaagcaacttaaaatggttgccttttccctggaggtttttctgccacttactccagcttataagaatctgtcttctacactgctcactattttgaaaaaaataatttggggctttaaacatttattttgtgatagataaaataataatagaaaggtacattgatatgagataaacagatataaataaaagcatatatttgaagatagacccaagctgcattaaaaatctgtgttctatcatttaccacctatatgtaaccttgaactaaacgtaagttttccatctgtaaatatccacctgcacaggtgttatgtatgtcctattattttactgaaataagagattttatatgtacatacacacacacacacacacacacacacacacacacacagagatatggtttggctttttgtccccacccaaatctcaactggaattgtaatccccatgtgtcgagggagggatttggtggggggtgattagatcatgggggcagtttcccccatgctgttcttgtgatagtgaaggagctctcacgagatctgatgatttaaaagtgtggtacttcctttttgcttgctctctctctctcctgccaccttgtaaagaaggtgcctgcttctcctttgccttccaccgtgattgtaagtttcctgtggcctccctggccatatggaactgtgagtcaactaaacctttcttttataaattattcagtttcagtatttttatagcagggtgagaatggactaatagacacacacatacacacacacacacacacacacccctacatatacacatcatatttcatatagacataaatatatagttgtctacatctatatctacacatagagacatatataaacatatatactaaaatatatgcttaaatatacattataacatatatatctatcttatgttcagatatatatgtcttataatcaagataaaaactgcatttcaactctggctctgccagtaagttatataatcctgggatacgtacttaatttgcaaagcttcattgtcctttttttttttttttaaataatgaggagaacactcatgaactaataggccatgtgcttgatatagctaggctttttgggaacacaggtaaggatgtaccaatccaactgtccctaattatcttaggctctatttactaatggatttccactgagaaagctatggatccatttttctcagtctaaaagttttgctcaaagatgctggagacttcaaaccttttatagggttaaaaatgtgtactgctaactagcaaattgtgactaagttttccactacaggggaacccaagaaaacctttgatatttcagggattgccacaatatttttccttctttctttccttcctactcttctcttaatcataagaaatctggagcatgaatatacaagagcaggggtgagcaaaattccaagaactatatttgtatttttcaattaaatctttaagtttgagtccttattagtctatgtcttcatcaaagcaactaatctggtcattattgttaaacaaagatgaaataattcaggttttgtaacaattaagcatttctcaaagtcttgaggctggctatagaccttaactgtgatacagagtagttagtttacattagtcagttgtatgtattctgtttacccatctgtaaaatgagaataataatatataccttacttggatttgaacttgcaataaagatacatccctagagaataggacgtatgtcttaatcactctgtatttccagcacccagccactcatgtgtacataatagctctcatgttcactaaactgaattaaactaagttacaatatattaaagtttatacatttttaatctctttaaatttaatgggttattaagtgcattgctaactgaccatttttttttgcattaacaaccacattttttataaccaatgaatttggaagataagttgttataaagatagctatattcataaagagaataacatctggcctatttggatacctaaaataaattttttatttttgtatcagaaaaccaggtgtcttttttccaagctaatgttaggtcaacatataggcttaaatacaagttttccaacttgcttgtagtcatattttatttgtgtgtacatttttaatgtattttattctacctaaagactcatatcatgattctttaatgagctttgaggcaaagaaataatgttagaacctacaaaaagctacccaatgttgacctctggtcacagatgggccttagtgatgaaagcattttacttttttcaaactataattaattttctatagtgcttcaaataatatattcaacttctcatttttaattaagattctttttcttgctccaaatttaaattatgttctgaaagcaatttttgtcaattgctttttcatgtgagaaatatgattatgaactaaattttgttagtgtcacattcatacttttaaataataaagttgtgaataaaaaatgaacaaaaactcatgtacttaaagtgtctcatactataagcagaacagaacaattacagaatacactgataatgcataactatcctagttttctaaagaaaaaatacatttcttagtagcttataaccagttagcataatatgtatgtataattaggagccagagtataagtagaaaagtaaaaacattaattaataaatacactgtaaatcttttaaataaaatctgataacaattatttatgttgttagtctttgacaacataaaacaaggcatttaaaacttagagcagtcttttaataaataattttaaggtgctggtactatatgtatattggattatccataaaaagaaacatgtttaaaggtaaatttcctttcaaaaccaaaggacttacagacacaatgtttttgcaggagggctctactgttcatttcctggcttcttaggtgtcacaggaagttgtggcaattccagccacagtagcagtttctcaattaagtctttgtgacatctagatcttagttgccatcctcagaggcagcagttatgctggtggggcagttctgtattgtttattattcctggggatctagtctgcaaccttcttctgttgttctttcagcaactttctaaacaactattcccctaaaccttgtccttcttaaaacaccttgcatggttttattacctgggctgaatcctgaataacacattacttatactgttttgcttcgtgaaatagaaagaaaaaataatctttgacattgaaagcaataaaaaaaaataagagcttcgcagaagttaagcttggctgcacgctcaatgaatggctccctaatggtttaatttgctcagtcatcccagatatcactctgcatattaacctgaatcccctgagccagaattggggcatttttccaggaaccagggaggaagctggaaggtcacgtgtgtatatctcgattctgtatgtgcctagtgaagggatccagcttgtaagttttgtcaacttgtgtcaccatattattgcgcccaaagaaaaccagtaggagtcttggagatctgagaagctgtcattacactgagtctcaagtgacagctgagtcagtacagagccagctatgctgagatgggagactgttgcttttcttcatcaaaagaagggctatttgttctattataatgacaggaattctgaagtgaacagcactgctgtctctgttttgattacctccagatgagaatgagaggagacatgctgctgttaaatatcagctactaaccttggtctttttggagtctttgggagaatgacctcagtggtgcttctgaagagcagttatggaaataagtgtgcaatttagaggtcttatttaacccactaccattttcatgattttttccctgcttttgtggaaacattagacagtaaatatagatacacgttcatgtagtcttctatattctggagcctcctaagatttgctcaaagaactgtcagagaaaccagacctatagtgactaaggaggtaacataatacatcacacaaatggatataggcatcagatagacctaggtttgaattctcctcatccatttactagctatgtgggtttggggaagggtttgtataacctctccaagcctaagtttcctggtctgaaaaatgggaaccacaacacatttctcagaggactaaaaaatgcaatgacatgataatacttgcacgtagatgtttgttaaatgctggttcactttcttctttccattctatccccatcacccccaccctgatttgcaaaataagtgttttaatgaaatgcaaggatgaagaactggggactcttatgaacacctatttataaaattttatatcgttagaattttagatttagattagaattcaggttatgaaatgcaggtagaaagtctagtagagctgacatcaaaatgtttgtgcaagaagaattcagaaagttaaaaaaataaaataaaaggtttgcagggatgtccaatcttttgttttccctgggctacattggaagaattgtcttgggccacacttaaaatatactaacactaacaaaagctgatgaaaaaaaaaatcacaaaaaaatctcataacgtcttaaaagagtttacaagtttgtgttgggctgcatcaaagctgtgttggattgcaaatggcctatgggctgtgggttgggtaagcttggtttagataatgtagattcctttgtatatttaatctttcttcctatatcaaggtaatagctttaattactgaaataatataattatcaattaacaatttctttttctcccattagatatattacaatatttctagcaattatgtgctaaagaaaagataatttggaacctgattgattagtgaccaatcaagaggttcatgttaagatgaaaataactgacttgaagctagtcagtcaatcgaccttcactcaaaaacttccctgataattatccatatgttttttcaattgtgggtcaattgaagatacgttcatatcttcttcacaataaatatacatcttctattactggaaatagactgtaatagtctaatctatttaattttgattcaatgtctgttgctggtagacttcattgcttttcttttcttttcttttcttttttaccataggagcatctctgaaactcttcagaagcatgcttatggttctgactttccagagcttctgttacagagctgctttcatgtagtgcgaactggaagcctgatccacctgggatacactccctctttctctgctgacttactgcctggtatcagtctggttaaaagacctcagagcctcaatttcccacatgtcttcaaagatgggaaataacactcaccttatgggaacactatgagaattcaatgagataatatctgaagaatatttcttgcacataggaaatgctcagaaaatggtggctgctatttacatacttgttttagttgatgttcagggagtttcatacttaggaatggccctggctggagacccaccaaccattctccctctgggaacaataagatgaattgaattcaggatataaagtctcaggtttcctataaatatgcatatatcttactgatctgtagtttttttcatcagtgtcaacaaattaaaaagataagaagagctgaggtaatgtgtgttgtaagatgtatgtcacctaatgttaactttgtggtctaaactgttgagctatcaagccagattcccaaatcttttgtcactgaagtgttctgagatataccttgatgtttagaagaaaatagcaagctcacacaggaacagaaaagcaaataccacgtgttctcacttataagtgggaactaaatggtgagaacttagggacacatagaagagaaaacctcacactggggcctttctaagggtggagggtgggaggagggagaggatcaggaaaagtaactaatggatactgggcttaatacctggatgaatgaaatagactgtacaacaaacccccatgatacaagtttacttatgtaacaaaacggcacttgtatccctgaacttaaaataaaagttaataaagaaaaataaaactacaaaaaggaaagtatgttctacctcttctaggatcgactttaaaaactttccattccctgtagttgccaattctgcaggtactagtcctctggaaataagtatgttaaactgaaggaatgggaggaacgctccacagagtttgttttccaaagaaaattattgtttagagaagcaaaattaaaagtctagctaggtgtggtgtaaagctgttcaaaaagtaactcagagcaagacctgtaaattgaaatgtagtgcccgagtcatattctgcttaaaaaggttgtaacaaataaagatgagtttaaaaaatgacaaggtaaatcagaattcctactcaaaatgggaaaggacaaatatacataggttgacattagctccccacattagtcttgtctttggaggacaagttaaaaagttattattgatgcatacaagtgggtcttgttgagcagcaagtgaaactattgtctttattagaatggagatattgtgcagatatttgccgattttgcatgcagaaaaagcaactttcttgcctttaagtagaaaagataacagcttagaagagaaactgggaaactgagaattgatccaattccaaacttctgatttttgtaataaaagcgggatccagccaggcatggtggctcatgcttgtaatcccagcactttgggaggcctaggcaggcggatcacttgaggtcgggagttcaagaccagcctgaccaacatggagaaaccctgtctactaaaaatacaaaaattagctgggcatggtggtggtcgcctgtaatcctaactacttgggaggctgaggcagaagaatcacttaaacccaggaggtggagattgcggtgagccgagatcgtgccattgcactccagcctgggtgacagagcgagactccatctcaattaaaaaaaaaaaaaaaaaggcaggatccatgtgtatttcttaaaacagaattgactgttgatcacatatcagtcttaccttttaattaatctgtgtgaaaaatctgttgattctcctaaatttttcatctgtgctctaaagtccttgattacactaagcattgatttagcctccctttagctatatctatttgggcttccaaccagagtcattcacttgcataagtgacacttattaaaattcaacattagaaggcactatattcaatgttaaatatcatttcataaagattacaataacatttttataacaatacacctcatgcttcagaagtctttatgtcacatctcaactcattccatcttctaaaggaggagagcaattttaaaagctttgtatttctcattatgtttattttcccatccatttactaacgctggaccatatttcagagtttcatgaatagtgaaggcagatttcaagggacatcagagttatgatggcatccttaacttgacattcatagaaaaatctgaaagtacatgcatggctggttttatccagaactgcacttaatttaaacgcacctctttatggttttctttccctaaagtgtctgctgtatttgatatatcttcagtttccataagctgtttacacctgctcaatatcaaggacattccatactcagaataatttaagccaatttgatgagttgaataatgataaaatacagaaaagtaagccagcagaatcagaaaaccacaggattttagagcagaaagagccattagagttcattttactcccccctccctcccctgagtcctaaagtttaatacctttgccaaggccctataatgagttagtggcagaacctgttctagaaccaatggcttccaattcttggatgagtgctcttttcttagtttcatgttacaaatagataaagccaagggtagttgcttcttaccatactctagcaatgctatactgcaatgtgtaaataacttggacaagtgatctggacattagaatagcagtgactttaattagtattcctttgtcattgttcttttggctaggcgcatttaaatcagaaattgatcaccctaatataaactaccgtctttaagtcccataagaacactgttatccattgccatctgtctattcctttccttcagcaatgtaatcatctaatagctaagactctggaaacttgggtaggtctgaatctgatggaatcctatttttttctattcaaaatgtgcagtggtgtacagtaagatgtgttgaccttcttacgtccagcaaggctatgattttggagcctgcagggagcagattctgagttccctgaaaggtgcgttattttccatcaaaactgttgactggcttttccagagacaaaatatagcctcagaactctctccccatttattccttgggcagcttctaggaccactgaagtccaagggtgtatatttcacctgcgtttatgatcaatagcccacaaaccaatttcctatggaaagcctccctcctatgaaaaaaaggaaagagaaatacaaactaagagggaaaaaacaaaggaaagattgtgtcacagcagcagaaaagccaatcaagtcagggcaaagggaattttatgtggttgcgaagatcagtaagatcgtatactgttggtgcttattcctttttttttttcggtgccaaatatgttcctttattctcaaactagtgtcctgtggtgtcaaattgataaatcaatacaatcacttttaatgttccttgattttccatcttaagcaacattttgaagccatttatattctgtagagcactctgtcaaccaaaccaatgaatgttactctgtgaccaggaaagatacattcattttgtttaatcgaaagaagaaataaatctataatactttcacatatatgacatgaaactagatcttaatgttttcagtaagaaagaaggtaaacctaatatagctttccgtaaagtaataacacatttaataactatgccaagggcatacatcgagatgagtaaacaagtagaatactttcaagtatatgctactgtttagaagcttttgaagttttcccttggtctagcctcccaggccagtttatatgtctcccaagaaattaagtttcgtttgtttacagacttcctttctttttggttaacactgctaacaaccatatttattctctaataacccttattcttcacaacaccaaatataattagtctataaatatcaaattcattctcaaattttcaaagaacaaaaatctggcagcttcattctgaagtaatcacaaaagaatatgctttacactctaaaaggaatttcaaaaaagagttgccaaattgatgattcttatttgaggcaataagattaatgtagaaacagatgtacgatatacagctgttgcaatatgtgggttgaaagttgtagtttgctttaaaattcagttggatatattgcttctactcctctgtctaaacgtggagctacagttcaacttaacatcccagaactcaaagctatattacttaaagatactctcaatacataccatttttgatcatttttaactcagggaatttctttccattggaataagatgattgcttttttggtgatctaatccacaggttgatgtcactctcccttcttacaacatgtttagaaataaatgtaccttcataaataaagtcacaaataattagattcattcatatccacaaaaacacattgccttgttagatgttaacacgtatttttacaacctttatagtactaatttttgcttgagaaataaaattatttttcccacaaagtatactagaaagctctgctctaattttagacattttattagatatgtggccaacgagcctcactctaacagtcctctgtgatcatagtcttctagggattatataattatgaaaaggggatgctgactccttgcatagctataccttttggtgtgttagtaactgctattcttaacaggagatggtttctcataatttttgaagagcctgcttttctgtgaaacaaatttggcataaatatcaaaaatgttaaagatatattagaaactttacagttttacccttgataatgcttctttttagtgtgttttagttttactaacttaaagggcttaaatatgtagaaacactattgtgagttacaatcagtgtaattcagcgtaactcagtgtaattcaatcaggtcttccacaaaactaatttctttcatatcccaaatctatgttcaccttattcactgttttttgagatggaatcttgctgtgtttccaggctggagtatagtagcatgatctcagctcactgcaacctccgcctcccgggttcaagcaattctcctgcctcagcctcccaagtagctgggactgcaggtgcacaccaccatgctcatctaatttttgtatttttagtagaaatggggtttcaccatgttggccaggatggtctcgatctcttgaccttgtgatcctcctgcctcggcctcccaaagtgctgggattacaggcgtgagccaccatgcccggccactttattcactttttataaaacagaattagagtttagttttgttgatttttgtcttttacttggtatacactggtatttgttctggcttcaaataaattttaaatatttcccaataaaactgtctcaccaaatgacaaagaacagtcttgggagagaagtttaattttaaccaccttccttttcattttgaaacttttaaaattggtcattgaagtccttctccacattctttggtataatggaaaatagtgtctaaaatttatatctgttcttatacttgcttcaaaaattaatttgtgtctctaataaatatcaaagctagaaaggactagaactttaccaataaacagccgtgattattttttcctcatatttaagaagcatgtcagtttaattgtggttgattagactcaagagtcaaatatatgcaatcattatgctcagtagcatattaaaaccaaaataaactccatttttgctctttaaacatttgcaaattaatccaatattcttccgtattaattctattaatttctttcatatattttcgaatccatattacccaagagacaatgcatgctgccttaactttgcacatttaacatgctgtgatgaaacaatcctgtttaatcatctctaaataaatgctgctaacttattgcttctggaattgccttttgtgtactatgagggtaattgaaatcccatgtgatggatgttctaaactctttcaagacttttatctatatatgtttttcatggttagtctttatcacattctagatgacaacggttttgtctcattgtcattttctcccttctcctgaagttcaattacatacaaatcttaaaaatcttatatagcctgaaatctaatcgtagaaagattcattcacaggcttcttcttcttcttcttcttttttttttttttttagacagagtctcactctgtcacccaggctgacatgcagtggtgcaatcatggctcactgcagccttgacttcccgagctcaagtgatcctcacaagtagctgggactactacaggtgcatgccaccatgcccggccaatttttaattttttttttgtagagatagtgttttcttaaggggtcttgtagagatggggtttcccaggctggtctcaaacttctgggctcaagttcctaaggatcttttccttaggaacttactgtggaaataatgaagaatcaatctcagcctgtgtatttgcacacacatgagcatacacatgcatgcatactcatgctctcactcattatgtgcccaacaattcttcttttttagtagctataaaataagtttattatcagttagctaccaaagaatagtacgatagtaggatagtgaaataattatgaaaagtatatctgggagataaaattagaacttgaaaattcccccaaaactgtaaaataaactcaacatttacaggcttcaatgagaaaaaaaaaatctccaaacatttccattgagaaactgcacaattgtcttcttaagatgtaagttttgttacagaactcaatatatagtagtttcattacagaactcaatatatgcccaacaattctatttctgtgaccatctccttctattctaagggatgtggcttttattgaaaagtgtgtgtgtgtgtgtgtgtgtgtgtgtgtgtgtgtgtgttgtttgcttgttttttttttttttagaattaggcgggctctgagataaggttctagggagacaaaatacaaggctaaatacagtcagtccttgtttatggggcatggaacagattgatgggctttttgtattatttgtagttaagggtcagtggagacctagactaaccaccttcctcccctgcttagctcagaaatcagcaagcagcaggaaacaggcttcctaccaaggagagtgcaaggaccaacttgtccacaactagattgactgagtatatgtatatgtgtgtatgtagcaggtggtgggggggaggtctttggagccctagctctagaactctctcttactaggcaccaataaattccagctccaagatgtgcctcctttccttccagatgtagttggtggtagagtaatgtagtggttgtaagcagaattactcagttaggtcttgttttgtgaaaaaaatttatttactcttatatagttataagtcactacaattttgtttcaatggagttatcaaggacctattcctgatgccaatgctagattaaacaaggagtgaatgtatcattaatgcatgcatgtataagagcaatgatatagtcttcagtagtctgttttccttctacgctgctgggttcatgaaaaccaatgagaatttctttgaccaaggaaaatgtgtaacaaatgtgattccatactcaataccaacagatatgctggatacttatttaagtttctaacaatggcaggatttttcacatcatggacacacttctactgcaccctttctgaacatatttgaaaacttcattaaaggatatactgagtgaacaaataacccaactaagaaatcaaataatcccattaaaaagtgggcaaatgacatgaacagacatttctcaaaagaagacatgcaaatggccaaaaggtatatgaaaaaatgttcaacatccctaatccccaaataagtgcaaatcaaaaccacaatgagatatcatcttactccagttagaatgtctattattaaaaagagcaaaaataacaaatgctggtgaggatgcagggaaaagggcactcttacactctgttggtaggaatgtaaattagtgcagccactagggaaaacatatgaagatttctcaaaaaactgaaatagaattgccatatggttcagtaatcccactactgggtattgttccaaaggaataaatataggagatcagcatatcaaagagattcctgtactcatatgttgattgcagcactatttacaatagcaaagacaaggactcaactgaagtgtccatcaagggacaaatggatacataaaatgtggtatatatagatgatggaatactcttcaaccataaaaaaaataaaatcctgtcatttgcagcaacatggacagaagtggagatcactatgttaaatgaaacaagccaggaccagaaagacaaaaataacatgttcttactcatatgttggagctaaaaaagttgattccatggagatagaaggatgatagataacagagggttaggagagtgaggaattgggaatgaagagaggtagattaatgggtacaaatatacagttagataaaagatagaagttctattatttggcagaagagtagactgactatagtagacaacagtgtattgtatatttcaaagtagctaaatgaaataaatagaattgttcccaacacatagaaatgataaatattcaaagtgatggatacctcaaataccttgacttgatcattacacattctatgcatgtaacaaaataaatatgtaccccataaatatgtaaattattatgtatcaattagaaattcaaaaaagatacaggaagaaaaaaatttttttaaaggtatactgagttgggccgggcgtggtggctcacgcctgtaatcccaacacttctggaggccaaggcaggtggatcacctgaggtcgggagcttgagaccagcctgaccaacatggataaaccccgtctctactaaaaatacaaaattagccgggcatggtggcacatgcctgtaatcccagctactcaggaggctggggcaggagaattgcttgaacctgggaggcagaggttgcagtgagctgagatcgcaccattgcactccagcctgggtaacaagagcaaaactccatctcaagaaaaaaaaaaaaaaaagatatactgagtcaagatggtggatcatccaggtcaattaatcagtataaagcaatttttataatataagttagaatctctgtatttttgttcacttttttgccaagttaaaaacttcattagtcaataatgttattggaattggctactaggagagatggctgaaaattcaaagaataattgtttcatcgtgatattcaaattgagtttctaatcatctcctttataggagctatccaaggatttccaattaaatttatgaccttgtactgaaattacatcttgaagctctttatgtttactcatataagtctagctgttttacccttatatttacttttccttcgtagtcttctttggtactctaaaaggagatgctctatttaagaagttaattaactaatgcaaaatttactcctattatcttcatatttaattaagactttcttatttatgtcatcgccttagcaaggactacatgtattcctgaatgtcagcttcttatctatttttctcagcttttaaacataataaacagcctggtttctttattcagtatttcagatctcctttctttcatgtcacaaaagataaattcacattgctgcactgacaacatcatagctttgaaaatgcgtccacccgttaccttataaatagttcagtcacttactttaatccatcttcctttgtccatcactctaatgtcaaacttacaagtttaagaatgcacttttctcaacttccagagttaaaccatgggtccaaaagcctattcacttaactaacacacactgacagaagtatcattttgactgacaaaatgccaatcatcaagtattctcatttaggaagatttgataatggtgtcctggcattgtcgttttgatgaatatttagtgctaacaatggcaaaagtccacctctcctaaaaggtgggtaggtcaatagggctgggtgataacctttccatcttgacatctctgtgtgttttcattatttcagtataattatccagtatctattccagataattatagttacataactctggtggttcaaccctacataataattttttttgttttgcttatttgtttcacttataccagccaactttttctttatttaatgttatcctttcaggactcatagctttgaatttatttagaacggaactaaaagaaaagaaactcacacaacatccacagcccagaatttctagagagtggaaagtgtctgaagtgcatggaatctgccttgaagaaaatggatttttgatatcaatctaagatctagaacctgagtttaaaagtccttcatttgtcttaaagttaatagaggattttcaggtgagctgtaacagacactaaaaattgtatcattttaccaattcctctccttggaaggataatcagaaacgattgtttatggatatctataggttacatataagaaatttaccccaacatgctttctaagcatcattgctttctaagacttgcagaacactcagctttactttccaatgtgcacttttctttttacttgtgagactctcctgttgcaaacaagagatgaggttgggagtcactgtgaagattctactcacagaatagctgtttcaactaataaattaaatttgcattctcctgtctcccaatgtggagttctatctccatcataattcattcggaatcaccaacagtctggactagaatcaatatttctcaatactaacttcagaaatgtaagttagattttatagcttgaaaatcacaagtttcttctggctacaacttcatcataaaccatactactgcagttataagcatttgcacttaaaattgccacatctcaaataagttttctgttccaaaagcccactataaaaaataagtgcaatttcactttcttttaatcaatgaatatatagctaaacatttatctctcaacataaaaatattaatactgcccattgtactcacatggcaccgtgcggaggtagaggttgtcacgaatgatttgctgaagctcatggtccacagaacccttttgaaatcgtaagttgaggtagtgacgaaggtctttatcaacaattcctcctaaaaataaaaaaagtttcttggtaagggatgttggaaaatattttaagcatgtaatttgattctgtcatcaatatactcaggaacccattaaaaagatgcattatttcaaagtgttcttttgatcttctcaaacatttactgccacaatgataacagagataacatttactgagacaataattgcctgccaagtctgtgttcaatgctttgcatgtattcctaaatttatccttcatttagaatgaagcctatatcatggtaaaagatatgttactcttgaatcatactgaaatattatagtacatctcattgcatggctaaaaagactatttactcatttattcattcctccccattccatcctaccccaaatcctggaaaccacttttctgtctataaatttgactactctaggtacctcatataagtagaatatataatatttgcccttttgtgactggcttattttacttagcataatgtcttagaagtctgaaaagatttttaagttattgaaagttgctctagatttagttaagtaggatggtataaaaagttaaagaagaaaaacctacacaaatattaatgattttactccttttatgcaataaataaaaggaatttctttattttgtagtatatctacaaatgtttttagcaagagacaaggtttgaaagaatgtagggtttttttttccttttttcaattcaaacaattttgcgactgtttgaccttataatctaataaaaaataaactgggatatagttaaaaagccaataatgtagatctatcaaatacttatttgatatttaaagatgacttgttaacttataaagatttatcttaaaacctttcctatttccatactggaaagaattaattataaatcaaaataccagtaaaaatgtaagtaagaattcctgaaactcttattatttcaatcaaatatactagggaaattgagccaagacaaacaattaaagatagaagaaacaggaaatctgcaataatcataaaattatattccttcaaatccttctgagtctcagaattagaattcatgaatctatttgcactaccatgatcacacaaactagcattatgtaggtgtgcacaggtgcaaaacaaacagctttgacataaactgtagctaatagacttacatattgtaacatttctaaagttttcaaaatccatcatttcagttgcctcctaatctgcaggtatagtctcaataagatgccatttttaactgcaagatatcattttcaactgaattaactgtcaaaattcttaccctccagatgatgtttctttcatatttgagcaaatggtctcttaatctatttttccacccaatataatatgatagtggaaatcaaatgacataaaagaaaaacattttttgttgggtgtacataaatattacatccggaatggctgaacatataattttccaaattcaaatccattttctcagccaaagaagcagagcagtcagaaataaaagtcatttgaaactgccattacacaattgcaacaattacctattatttacttctccaaatgccctgtgtttccatgtgtcttggacttgctggcaccacactaaaatagctaatagtttagaaatcctgaaattctctttttcttcttcttctttttttccagtcagcaatacttgcttacccttgctaatttatcacacctactgagtaagcatcatgcctgtgactgctctcagctgtcatttctgccggattctaaggctacaggtcctttggcaactgcaccccctcttccttctccttttttttcaatctaatatgtgggacataccaagtgatgagatcctttctggcatcctaagaaaatgccaactatagaacaacagatgtagtctccttattaaggtaagccagaatcactcacctaatgtaatgtggataaattcacattttgtagttcaggatgattcttatccctaaaaatatattatcagtttaaacctttttttttctttactacagatatactgaattacatttcttgaaagttatctacctcagaaaacaacaaaaaagtctatttattcatttcaatgactgtatcttttttttcatagaagaactgtcgaaacttttaagaatcaatataaaatttccttcactaattaaatgagttgtcataaattataacaaaatttcacatacaatcccctttgttttggaaggatttctctttcctcctatttcccaaatgctttattatcctttacaatttatcataagcatctttcaagtcaggcaattttattaatccagtattcttacagcaaattctgctagttgcctacccaatattcctcccattattctttccttttaaaagagctctgatttagttttgggcagaaacctgctgagcctcaggacatggatcacagtggtctggaaagtcattcaatcattctccactttcctaactgcccttgcagcttctagcagctatgttctggccattgacacttagcccagaaggaaatggacataatatctgagatgtagcagccatattctgaccatgaagtgaagtgacaagcacaaggaaaaattcaccatgctcaggatactggagtagaggttagaaacagcctgcattcctaatggctttactaaacagctaaaaacaatgtcagtaactacatatcttaagatttcttgttatatgagaaaaagtaaacactcattaaaaaaactattttgattgagcattcttttaaaactaatatagttgaacaactgtacctgatcctaaaacacacatatatatatacacacacatgttatatgcatatgtatatatacacatatatttttgtgtatgtatatatacacatatatacacatatatagatgtgtataatacatgtgtgtatacacagtatgtgtgtataacacatgcatgtatatgtacagtatgtgtgtatatacacgtgttatatgtatgtgtgatacatatgtatatgtatgtatgtgtgatacatgtgtatatgtatgtatgtatgtatatataatgtatacacatacacatacataggtataaaggcatatttatcctcaattagaaatttcaattagagaggaattaaacaacagacattgggcaatgatgtcctcaaaaagtagagtctgagtctcaaaatgatctgatttcaggtttaaaagttagccttttaaagcaagctaaaaaatacagagttctaaaaagtgtacaataaatgttatctattgttaaaataaataatttgctatcttattttccatacttataaattttttattttatttttagtgtttgtagagtttctgctctatcatttgttaatgattcctagatttggtagttcataggatgcacacatcaatcgttttgttgagcagagcactggcaacattaatgtctcgttgcatgctttagccatttgtactttttccttcaaaaaaatcagtggctcttacttgccattatatttgaataactattgacttatttagttatgtgaaaaaaattttatttcctgtatttttaaaaataagactgtagacaagtattaaatgccttctgaagtgacactttcagtaaatgagagagctggaaaggatttgaaacctacagttccaaaaaacatgtacctaattttcatcctctatagtctgaagaccaaacttcttagtgcaaagcagtcaagtcttttctcaacatgaccccaatcaagcttttgaacttaacatcaaaatataacttcagaagaacgtttggaatagagctcagttcaaactcttcctattgcaaacgaggcaagtgaagctcacacaaagagtatggtactgggcttagaacaatggtggggtggggagtgagggaagcactggggagcaacacctatggtctatttgaggagaaaacaccaagtcccaacgttcaaaactgggctgcatttctaaggtttccatcattttcaggaatgccctcagtagaaattgactgctttgtcatttctattacttgaatacgtagactgaggaaacaaaggaagaagatgctgcttggattggagagacataatctccttggtatattccttaaggcaatttgttagctccagcattgtagcaaatgccactctttcaaaatttgagggagaaacatgctagggtctataatgtttgtgccaagtgtctggttgctagtagtcccatctagtaaagtagtgtcatctctcactcagacatgaccatcagctcaaccttcccctccccttgagtcaactgcttctggaatgaaagcgtaccttataaacttttatcagtgtaaactggagaaagcagttcactaattgggatagtaggggttaaatagagaggggaaaggtggggatgaccaccagggtttggctcattttgatgtaatctactcatcctgtgcttcagtcaaagcaaactactctaatgttctaatcatcttatttatttttgtttgtttttcaatcacactcaacaaaatactgtggtgaatatttaattttagtttgtgctttactttttgcattcaactttgctctttatcttgtaccacgttcttttggtagaagatccttccttccttcctttcttccttccttccttccttccttccttccttccttccttcctttctttctttctttctttctttctctgttctttcttcctttcttctttctttctttttcttgttttttattgagtagctatatcattcagtacatgtagtgggtctttgtgctgagctactctgcccttacttagtcaatcaaaatgtttcttccaggaaatggctatagaagcagagtgcccaaagaatgcgaatgcaactggcttcatcttgaaagcgacactctgaagaaattacccataatttctccctcttggacatgcagaattatcctgttcttgtatttttctggccagcttctccaactttccctttcttgtttgcaactaattaaactttatggataagaatgccttccctttgctattatccatggaatttctgtccaaccttcaggcttaaaattattctgtagttggccttcctatgatctttgagccggaagtcttctctctgctctgaacttccacatcttgctcatttctctttagtactttgcgcattataacaggccaaactgtaatttgtggacctgttttatattttctattatgttacaagcttcccaggagagagtgtttcctattcattttatatcttctcccctcttatatcttcttccacgtctaaagcaatgtgtttttaacatacaaggccatgaaacgtatgctaaataaataaatcacaaatgctgtagtagaaagaacactaggttttcagtcaggtaaacaagttttagttaccatcccaacacttattcattaagtggtcttgcacaaatcatttctggacctcattttttctcatctataaaaggaaggtggcttagttacttaaagctgctataacaataccatagattaatctgtatttctcacatttttggagtcagaaagtccaagattaaaccaacagatccggtgcctggtaagggcactcttcccggcttgcaaatggccatcttctcattatatccacacatggccaagaggaaaataatgtttctttttataagggtaccaatcccattcatgagggtctcaccctcataatttaattacctgtcaaatagccccacctcctaatgtaatcaccatgggggttaagatttcaatatatgagttttggacaaacattcagtccaaaacaatgggtgtaggaccaaataacatctcctctaggtctaaattttatgcttccctataaaatatttgctaagtgcatcttataatttgggatttcttttggtaacaagacaaccaaattattttactatttacttatagtttacaaattagctatactccataagaaataaaactatgaataatctccttttgatattgttttctagttgtggaattattcaggaatcttacatcatcagtagacaactgacttcagaccttatcttcatcaaataagtaggaaagtagttaagcaaagcagtctgtgaggaattagaagagaaggaaatctacccatatgctgtaagatattttaatgagtaaccgcaaatgtaccttaggttaattgattggatggtggataagttgaggaatagacaggaaagtattatagggctgtgttgttaagttcctttttcaaaaatagtttctgcttggctcacctcaaaaatgagaaataaatcacaagaaagttgattgattctgctaagagccacagacacaaaacaggtgacagacatatctaatctagcctgccagaacagcctccattccctttttaggtagaaattgtgtctttgatttctgatgatctagaggcccatctcattttcaggtggccagagtactacacaaaatcactgcatgcatttgatctagactagacagtctataaattatgaggcagtaaaattctccttcccctaataattcccaatttgcctattttaaataggaaagccataaagctcattgaagatgccctggtttgttagtttttccatagctgaaaatttttacttacatgacaatttctatcccttcaatattttattcataatattagagagtatagacaatctttttaatcatgctttaatatctgtgctgtttcttcaaaatctttgtggtattgcatgttttgtataagaaatggaataagaaagacaaaatatattaaacatttgcagatcattagaagatttaaaactaaagagaataattgctatttcagagaaaatgacagagataaatgtaaatggtttataatattctctagctcaattgaaaatagcttttttattatttcctttcccctactattgtacagatgggatattattattgagtttcatttttcattgttagccttggtctcaaactaaatgttagagttgttcctatagttatgatatttccttccattgagaagagaaaatgagttctcagtacatgccaggcatcatagtaggtacctgaaattttattatctgaaaatatgaactatgaacccaaagttgaaaacaatctcaagtatatcaaaatttttaataatgtaccaatggctaatacagtctaataagagcatatatcctattagtttctttaattacctaactcttacaaattagatgttcttcatacaaagcaggaagtcacaccaaattcagcataatgaaaggaaaaatatatatgggtaaaagggacataataatctaacctaaattcaatccattttttttaaaactagagatataccactctaaatttaaaagggaaaagcaatctattaggatagttatgaaggagtttaaaattattgaaggttaataaacctcataggtataaggcttctacataaaacacttactaagattattaaactgaagaaaagccactgttgtccaaaatatctagataatttagcaggcaaaattttttcttcttagagtcttggtttattgcctctctaacttcactccaaagtttcagtataaaaattttaaaatgtaatgataaaaatatcacaattgtttttgttcttggtaagtccaatttaagaatgcatccacattaataaaaaagcaaaagaaaatgctcatactttggtatgcttgaaatatcttcattcataaaactaaaagtgaacatgtaaatggtatttaaacaatgaatatttaagcttatttcattttatattagcaaggtctatccccaagtcaactgaaaaacatttgacattattttgtgttttaagaactataaagccaggtcaggccagccatacggtggctcatgcttgtaatcccagaactttgggaggctgaggcaggaggatcacttgaggacaggagttccaggtcagcctgggcaacacagtaagaccccatctctataaaaatgaaaaattaaaaaaaaattcttaaaagccaggtcagtcctctaatattttttttcaacctgctgacacttaaaaactctccaatgatctggtacaatacatggttcactccaaatggctttatccttaaaagtatcacgacacagaacaccttgcccaaatcaacaaaaaagaaactccagctttgtttttgattgcattttacaatggaaacacaaagaaattccctggcaaatctcattccaaacaacagactaatatagcctgcatagtctgtgttgtgatggatcagtactaatgaagttataacaattatagggtcatgatttgaactgctacaagactgatttcaaatgcggaatgtgtcccaaaggtttattttggaatgcagaatggtttttactgtagaaaaatgttgtatattataattatgtcctcggcccacctataagtcttttcattcattaggcaactgaaatgcacaatttatggtatgttggaaacaaattgttgttatacatgtacagcatccccatgagagatggggacattgggaagactggcatacttctagcagatcttcagagggaagatccattgaaaatggagagagggaagacacagatactgggtcaaaggggcaggaagcagggaaccctgcaaagggagttatttctagccctcaatgactcctggagaagcggggggggggggtgggggttgagcaggcaaggagcaacacattctccctgggggcccctggaatcctgccagcaggagactacatgaaccccatggacaactgagctggcagagagagctgcttagagaagtagtatgggcagaactccagccattgtggaacccagagagtttggtgtgggagcatctggagtggagcactactagggacacccatcccccagggctgccttgcacccttaggaaacttaaggcctaagaaaactgttggacctgaacattgcagggtgatcttgctcatgaggctgggccagtccgaccagagcacctttggtctgctggcctctcctgtgaccccagctaggcctgattgcagtgcagcctcagaaatctaggttgtggtagcctcctggtggcacgcatcatagctcctgcactgacagactgtacttgaccagtaaacagctccagtagggtgccccaatagagtgtccctgcaaacatgcacctgtccacctatgcccttctcctaccacagtctcccctgagttgctttgctggcacgcacttgtccacaaccacccccctacattgctttgctgaggcaggtaagcttgggtagaccttgccttcccttccctgccagatgcgtgtgcaccatgctgtgacacagctgccagtgtgagtgaaccccaaccctccaacactcccccaacagtgctgccattgctattggagcattggctagcatggaaactggagactgtcagccccacacccacctgcaccccacccctatgccaatattgccactggtgcaaaactacaaaagtagaccaactgatctgcccccaaccccagcagcagctgccatctacgttaatgcatgaacacaggacacacagtcccatgcctgccagtgccacatccctatgctaacatttttgcccatgcaaatgcatgcacggacactggcgaggccccgtgcatctccacatagtggtgccctgccaacactgctgttgcaagtgccccaacaaaggccagcacatctgttcccatcaacactcagccatagctgatgagcatgcaacttgcagcactgccgctgctgctggcacataacaaataaggaccaatcctgctgccactgccctatgaagtgctgaggctggcaccacccatcagagagttctagccagctgtctggaaacaattcaggcccctccagtgagttaggttcctaacctccaggggccacagaataaagctggggcccatactggccccctagagttagagcacacagttcaggagttatgacctgagccctggccccctaaagtccttcaaaaatgaaaccagtcaactgaacccaccttatgccataatcaaccccccaaggacatcaaataggatagaagaaaaagaaatccaaaggtcatcaacttcaaaaactgaagcaacatcagcccacgaagatgagaaagaaccagcacaagagctctggcagctcaaaaagccaaagtggcttcttacctccaaatgaccacactagttccccagcaacagttcctaactaggctgagatggctgaaatgatagaaataaaattcagaatatagataggaatgaagattactgacatataggagaaagtcaaaacccaattcaaggaatctaaggtttacaataaaacagtataggaactgatagacaaaatggacattatatgaacaaactgatctgatagagcttaaaaacatggtagaagaatttcataatgcaatcacaagtattaacaacaggattgaccaagctgaggaaaaaaagtcacagcttgaagactggctctccaaaataactcagtcaaagaaaaaggaaaataaaaaaccacaaggaaaataaataaagcctctgagaaagatgggattctggaaagagacccagtctatgacttattggcatgcctgagagacagggagagaaaccaagcaacttggaaaacatatttcagaatatcatccatgaaaatttccccaattttgctagagaggtcaacattcaaattcagaaaatttagagaacccctccaaaatactacacaagattctcaaaggtcataatgaagaaatgtcaaaggcagctagaaagaagggtcagctaacctacaaggggaaccccatcagactaacactagtcctgtcatcagaaaccctacaagcagaagagattgggggaattcagcattcttaaagaaaagaattttcagccaagaatttcatatatggtctaactaagctttcgaagtgaaggagaaataaaatccttttcagaaaagcaaacgctaagggaattcattactatcagacctgcctttcaagagatcctaaaggaagtagcagttatgaaaaggacaaactgttaccaaccactacaaaagcacatttaagtacatagactagtgacactataaagcaaccacacaaacatgtctgcataattacgagctaacaacctgatgacaggatcaaatccacacatatcaacactaaccttgaatgtgaatagagtaaatgccccaattaaaaggcacagagtggcaagttgaataaagaagcaaaatctaacaatgtgctgtcatcaaaagacccatctcacatgaagtggcagccataggctcaaagaaaagggatggagaaaaatctaccaagcaaacagcaaacagaaaaaagcagaggttgctattctaatttcagacaaaacagactttaataaacataaaaaagtcaaagaagggcattacataaaggtagagggctcaattcaaaagaagacctaactatcctaaatatatacacacagagcacagaagcagccagatatataaagcaagtttttagagacctacaaagagacatagataaccacaaaagaataatggaagactttaacactccactgagagtattagacagatcattgaggcagaaagctaacaaagatatttcaggaccttaaccaaaagcttgaagaaatggacctaatagacatctacaaaattctccaccacaaaagaacagaatgtacatacttctcatttgcacatgacacacactttaaagatgaccaaacagttgggcataaaacaacactcagcaaatgaaaaaacccaaaattataccaaccacaattttggaccattatatgatttggctctgtgtccccactgaaatctcaccttgaattgtaacaatccccacgtgtcaagggcaggactgggtggagataatttaatcatgggggcagtttcccccatgctgttcttgtgatactgagtgaactctcatgagatctaattgtttcataagatgtttcccctttcattcagcactcattctctatcctgccaccctgtgaagaggtgccttctaccatgactgtaagtttcctgtggtctccccagccatgtggaactgtgagttgactaaacctcttttctttataaatgacccaatcttgggtatttcttttttctgtttttctttttttctttctttttttttgagatggagtcttgctctgtcacccaggctggagtgcagtggtgatctcagctcgcttccacttctgcatcctgggttcaaacaattctcctgcctcagcctcccaagtagctgggactacaggtgtgaactactatgcctggctaatttttgtattttgagtagaaatggggtttcagcatgttggccaggcttgtctcgaactcctgacctcaggtgatccacctgccttgtcctcccaaagttttgggattacaggcatgagccactgagcctgacctagtcttgggtatttcttcatagcagcatgagaagagactaatacagtaaaattggtaccaggagtggggtgctgctgtaaagataccaaaaaatgtggaagcaaatttggaaatgggtaaaaggcaaaggttagaacagtttggagagctcagaagaagacataaagatgtgcgaaagtttgtaacttcctaaagacttgttgaatggctttgaccaaaatactgatagtgatatggacaatgaagtccaggctgaggtagtctcagttggagatgaggaacttgttgggaacaggaataaaggtgactcttgctatgctccagcaaagagattggaggcattttgttcctaccttagagacgtgtggaactttgaacttgagagagatgatttagggtatctggtggaagaaatttctaagcagcaaagcattcaacatgtgactttggtgctcttaaaagcattcagtgttatgtattcacaaaaatatgttttggaaatggaagttatgtttaaaatggaagcagagcataaaattttagaaaatctgcagccccacaaagtgatacaatagaaacacccattttctgaggagaaattcaagcctgctgcagaaattgcataagaaatgaggaactggtcaggcgcggtggctgatgcctgtaatcccagcactttgtgaggcggaggcgggctgatcatgaggtcaggagattgagaccatcctggctaacatggtgaaaccccatctcttctaaaaatacaaaaaattagctggacatggtggcgggctcctgtagtcccagctactggggagactgaggcaggagaatggcatgaacccaggaggtggagcttgaagtgagccgagattgcatcactgcactgcaacctgggtgacagagcaagactctgtcttaaaaaaaaaaaaaggaaagaaaaaagaaatgaggagccaaatgttaatcgccaagacaatggggaaaaatgtctccagggcatgtcagaggtcttcacagcagctccttccatcacaggctcagaggcctaggaggaaaaatggtttcattggctggttccaaggccttgctgctttgtgcagtcttgggacatggtcccctacatgccagctgcttcagctccagctgtggctgaaagaagcaaaggtacagcttgagccattgcttcacagtgtgcatgccccaagccttgtcagcttacaggtggtattgggcctgcaggtgcacagaagtcaagaaatgaggttggggaacttctacctagatttcagaggatgtatggaaacacctggatgtctaggcagaagtctgctgcatgggtggagccttcatgaagaacctctgctagggcagtgcagaagggaaatgtgggtttggagcccccacacagagtctccactggggcactgcctaggggagctatgagaagaggaccaccatccttcagaccctagaatggttgatccacacagattgcactatgtgcctgtaaaagccactcaacaccagcctgtgaaagcggctgggagggggcctgtaccctgaaaagtcacaggggtggagctgccaaaggccatgtgagcccacttcttgcatcagtgtgacctgaatgtgagacatggattcaaagcagattattttagaactttaaggtttaatgactgccctattggatttcaagtttgcatggggccggtagcccttgtttaggccaatttctcctatttggaatgggtgtgtttactcaatgcctatatcaccattgtatctaggaagtaactaacttgcttttgattttacaggctcataggtggaagggacttgtcttgcttcaaatgaaactttggacttgagcttttgggctaatgctggaatgaattaagattttgggggactgttggaagggcataattgtgttttgaaatgtgaggacatgagatttgggaggggccagggtggaatgatatggctgcgtctttgtcccaaccaaatctcatcttgaattgtaagaatcccaatatgtcaagggtgggaccaggtggagataattgaatcatgggggcagtttcccctatgctgtttttgtgacagtgagcgagttctctcaagatctgatggcttcataagggtttcccccatttgctcagcagtcattgtctatcctgctgccctgtgaaaaggtgccctccaccatgattataagtttcctgaggcctctccagccatgtggaactttgagtcaattaaacctctttcctttataaattaaccagtctcttttatttcttcatagcagcatgaaaatggactaatacagaccaaaatgcagtaaaaatagaaattaatgctaagaaaatcactcgaaataatacaattaaatggacattaaacaacttgctcctgaatgacttctgggtaaacaataaaattaaatcagaaatcaagaaattatttgaaactaatgagaaaaaaataccacataccagaatctctgagatacatccaaagcagtgataagaggggagtttatagtgctaaacacccatataaaatagttagaaagatttgaaattaaccacccaacatcatatctagaggaaccagagaaataagaggaaatgaaatccaaagctagcaggagacaagaaataaccaaaatcagaactgaaatgaaggcaattgagacacaaaaccctacaaaacataaaccttctttgaaagaattaataagacaaatacactgctagctagactagtaagtttaaaaagagacaagatccaaaaaaaaaaaaaaaaccacattcagaaatgacaaaggggacattacaactggccacacagaaatacaaaccccttagagaaatacttctatgcaaacaagctagaaacctagaaaattattctgaaaacatacaccatcccaagattgaaccaggaagagactgaatacctgaacagaccaataacaaattctgaaattgaatcagtcatagaaagcctatgaaccagaacaagctcaggaacagacaggttcactgccaaattctaccagatatataaggaagagctggtactattctaaaaaattgaggagaaaagattcctccctaactcattctatgaaggcagcatcatcctgcataaaaacttagcagagacacaacaaaaaaataaaacttcaggctaatatcatttatgaatatagatgcaaaattcctcaacaaaatactagcaaaccaaatccagcagtacatcaaaaagtgtatccaccatgatcaagtgggctttatccctaggatgcaagttttgttcaatatacaaatcaataagtgtgattcatcacataaacagaactaaagacagaaaacaacatgattatatcaatagatacagaaaaggcattaaataatattcaacatccattcatttaataaccctctacaaactaggcattgaaggaacatatttcaaaataataaaagctatctatgaaaaacccacagccaacatcataatgaatgggcaaaagctggaagaattctccttgaaaactggaagaagacaaggatgtcctctctcaccactcctatttaacatagtgccgaaaatcctagccagagaaatctggcaagagaaagaaataaaagacattcaaatagaaagagaggaaaccaaactatccctgtttgttgatgatgtgattctatacctcaaaaacctcatagtgtgtgctcaaacgctttttgatcatatacacaatttcagcaaagcttcaggatatacaatcaatgtacaaaaatcagtagcattcctatacaccaacaacatccaagctgagagccaaattgagactgcaattccattcacaatagcaacaaaaagaataaaatacctaggaatacagttaaccaaagtggtgaaatatttctacaatgagaattagaaaacactgctcaaataaatcagagatgacacaaacaaatggaaaaatattccatgctcatggacagtacgaatcaatattgtaaaaatggccatactgcccaaagcaatttacagatttaatactattgctatcaaattaccaaagacattcttcacagaattagaaaaaaaaattttaaattcatatggaaccaaaaaggatctccaatagccaaggcaattgtaagcaaaagaacaaagctggaggcatcacatttcccaatttcaaactatactacaaggctacattcaccaaaacagcatggtactgatacaaaaacagacatagagaccaatggaacaaaatagagagactatgaataattccccacacctacaatcatctgatctttgagaaaatccacaaaaacaagcaatggggaaagtatccctattcaataagtggtgctgggttaaccgacttgccatatgaagaagattgataccggaccccttccttacaccatatacaaaaattaactcaagatggattaaacacataagtctaaaatcaaaaactataaaaaccctgaatgataacctaggaaatactattctggacatagaacccagcaaaggcttcaagacaaagccaccaatagcaattgcaacaaaaacaaaaattgacaaatacaacttaattaaaccaaagagcttctgcatagcaaaacaaaacaaaacaaaacaaaacaaaaaactatcaacaaagtaaagacacaacctaaagaatgggagaaaatatttgcaaactatacaaccaacaaaagtctcatatccagagtctgtaagtagctcaaacaaatttacaagcataaaaacaacaaccccactaatgagggggcaaaggacatgaacagttttcagaagaagacatatgcatggacaacaagcacatgaaaaaaagctcaatatcactaatgattacagaaatgcaaatcaaaccacaatgagataccatctctcactagtcagaatggctgttattaaaaagttaaaaaaaaaacacatgctggcgaggttgtggagaaaagggaacacttatgcattgctgctgggaatataaactagttcaaatattgtgaagggctgtttggtgatttttcaaggaacttaaaatagatctactatttgacccagcaatcccattattcagtatatacccaaagaaatataaactgttctaccataaagagacacatatgcatatgtttatcacagcactattcacaatagcaaagacatggaatcaacataaatgcccatcaatggtagactgaataaagaaaatgtgatacctatataccatggaataccatgcagccataaaaaaatgagatcatatcttttgcagtaccatggatagagtgggaggccattatcctaaacaaactaacacaggaacagaaaaccaaatactgcattttctcatgtataagtggaggctaaacattgagtatgtggacacaaagaagggaacaacacacattgaggcctacttgagggtagaggttgggaaaaggatgaagatcaaaaaactacttattgggtgctatgcttattacctgggtgatgaagtaatttgtaaaccaaactcctgtgacatgcaatttacctatatagaagcctccacatgtacccctgagcctaaaataagtttttttaaaaaggaatagaatgtgtgtttgtgtgcatgcatgcatgggtacatatttgttagtgaagcagctggggatgcacaataaggagtaaaatagctattgggtatgtgtccgtaaaaagaattagaacgttggtagaggaaggaccatgggaagatttctttatcagtcttgtcctaggttgttatcactctcaccactgaaagacaaggtcctgatctgacacagaaaaatgaaaagtggaaactgagttggagagactgatcctataccaacgtcagagatttcagtggaaaacaaaatggcagaaagacctacaagtattgtaaactggaaaagaaagctatttattcctgttgccaagtggctataaaagaagtatatgaggaagtagtatcaagcaggaagtagtaatcaaggactatgacagtgaattatattataattgacttttactgaattataaaatagcatcttccaactagtgttttagggaccacttatacacttaccaggcatactgctctagattggtgcattcaattgtccttacctgaagtctatcagttaaaatttcctgaaaattcacttttagacatctgaggctacattgcctctagaaatacaaggaagactaagccagatatgggaaaaataaagaatacataattaatcaaatatattctctattgcccaattaatcaaatatattctctattgcccccattccctgattacatgcaaagttgtccataatttttaaacctattaaaggatatttgaaggatgcagtcttaagcaactttggctcatcccttcaattacttgcaaggaaagcctattgaaaatatgtctttgatgtaactttcacttttactgaaatattactatttgtacttaagaacaataactttttataaaaaatgtcacgtagaagcaagagtgtggacacacaacacatggattggggggaaatatttgcaagccatatatctgataaggggttaatacacaaaatttatgaggaactcaaacaactcaatagcaagataacaaacaacccaacttaaaaaatgggcaagaagccaggtgtggtggctcatgtctgtaatccagcactttgggaggctgaggcgagcagattgcctgagctcaggagttcgagagcagcctggccaacatgatgaaaccccgtttccactaaaaatacaaaaacttagtccggtgtgttggtgcatgcctgtagtcccagctatttgggggctgaggcatgaaaatcgcttgagccccgagaggcggaggttgcagtaagccaagatcggcaatccagcctgggagacagagcaagactgtctctgaaaaaaaagaaaaaagaaaaaaaaatgggcaggagagctgaatagacatttctcaaaagaagacatacaaatgaccaaaagacatatttaaaaaatgcttaattcactaattattagagaaatgcaaaattaaaaccacaatgaagtatcacttcacatctgtcatcctgacagatgaaagataagtgttggtggggatgtggtgaaaagggaatctttgtacattgttggcagaaatgtaaattagtacagctgttatgaaaaactgtatggagtttctaaaaaaaatagaattaccatatgatctagcaatctcacgtctgggtattactcaaagatttgaaatgagattgtcaaagagccatctatactcccctgttcattgaagcagcattcacaatagccatttcatggaatcaacctaagtgttcatcaacaggtgaatggataaagaaaatattatatatatatttaatatatatattaaatacaataccacccagcctttagaaagaaggaacttctgtcatttgcagcaacatggatgggattggagaacattacgctaagtggaataagctaggcacagaaagacaagtgccacatgttttcgcttgtatgtgaaatctaaaactactgaactcatagaagccaagagtagaatggtggttgggaatgaaaagatgatggtcaaagggtacaaaatctccgtgaaatagaaattttatttttagatatactgcacgatatggtgaatgtacttaacaacagtgtattgtacatttccaaattgctgagagtaaatttcaaatgttctcaaccaaaaaataagtatttgagatggtggatatgataattagcttgatttaattattccatcttgtattaataaatcatagcatcattttgtaatctataaatgtatagaattataagttgtcaatatagaataatttaaaaaaaatcatgtgactacccaagaataattttcaaaatcaataaaaataacggaggctacaaacttcattgtaaatggatttttattgctttggcagcaaggcagagaggacagtaagaaaaacattacagtaaaaaacatatctttgggaggccaaggtgaatggaacaccaggtcaagagatcaagaacatcctggccaacatggtaaaaccccgtctctactaaaaatacaaaaattagctgggcatggtggcatgcgcctgtagtcccaactactcagcaggctgaggcaggagaatcgcttgaacccgggatgcggaggttgcagtgaaccaaaatcgctccactgcactccagcctggtgacaaagcgagactccatctcaaaaaaatatatatatatatgtatgtatatatatatatatatatatatatatatatatgtatgtatgtatatatatatatatgtgtgtatatatatatatatacacacatatatatacatatatatacacacacacacacacacatacacacacacacacatgcatacgcatctacacagatacacatatgatgcataatttcacattttgggatggtgctagagaggcagttgtatttatagtgcagaggtctaaaggaagccgatggttaactacttcctatgggtaggctcaaggagtagaaaatagttttatactgtccaatgacttacctttatacagaacgttactatcttattatgagaatcaggggctagcacaaatactgcttttccacatttgtaacaaaattaattttttgcctaatataatttttatctttaaaactcaattacatccctgcctaattgatgacttaaatgattctctcagtcatgacaaacatttcaaatacatgagtgcaacaatatttgctcggtgctacttttaaaagtccaggaatgctccatgtcataaaagagggctcagacattactatatattttttattttggactgataagctattgtcttggtaatgaaaggggtttttttataaattacctattcatgcaaaaatctcatttgaatgaaatttttactgtcttttgataaataatcaactttatacattaaccaaaatattttgttttttgaaagtaagtataaaaaacacaaatgttatattttaaatagtctatttcatgtttatggaagtatgtggccaagtatccttagaattttctgaggtagcattactatagactgccccagacacctgtttttattctgtactacttaaaatcatactatggcaatgaaaaacaactattctgcataatcatttcagaaaatagtaccatgattgctagcttttagtgagtaatactttcaaggataatatctaattgctgactccgaaaaatctggagaaatgttgtagtttttaatatttttaaaataaactatcctgtattaataaaatctacaaagcagctatcaatttcattaataattatacaaatatttgaagtcattcattaaagaagaaagctgattttagagatgtgattaactaaagatggggtatttaagatagaaaacacctttttaaaataagacccccccaaacccaacctgtaatctttatcagtttcatagctatcattatatttggtgacctgaaatgtttatatttttttattctaccttcaaaccaggcaattctgttttgcaagtgagagaggatatcattttagaactcatttttaacttaagttatttagtgtaaaatgcagaatgtgaggctcagagtagtaaaactaaattatttaaggttttgttcactcagtgttaattaactataataatactgttgccttctctatgtgtaaaatattacctgtttcaaagttttaaaatatttattactgtatttattcaaccagagaactgtaaagggtaaatagggtggtgttctaatttaccaataatcaaacgagtttagagatgaattaactctcctaaactcacacaacagagatgtaatgtttactctggtctcttgattttgttccaagcaatttcttcaccatgctagaaattctcaacaagacagggaagaaggataggcacagaaaagggcatatccccaaaatattaatattacctagtttattttgcatgtggcacattagcctccgcattcaacgcctctgaggataagccacccccactgaggagtatgtcacatcctccatgggtactgggcccaagaccttgaactcctatttcaagtgtaggttctaaccttatatgcaaaaggctgagtttaatgttcgaggaagtgaaacacggtatccaggagttggtgactgaaatggattttgttttggtgagggaagaatcaacaattttgccaagatttctgtgttcacataggcagcacacatagaacactggaatgatacagtgaagatgagcatggcccctgcacaaggatgacacacaaatccatgaagcattccataaaataaaacaaacaaacaattttgccaagatttctaggagagcgattgagaaaatgatggtaacgttgacacagattagattttgggacaaggaggtattttgcttcactttgtttttaagggtgtggcaacctgacagaccacagggacgtagttctccgtttttgtttttgtttgttcctttgttttaacacattgtgaatttgggactaaaaataagaaagcagatgcaaacatgctaaatgcatgaacatagcaggtgtttaagtagacagtgggtggatgaacacaaaagaaggtaacagaagagagaatctactatattaatgggagtggcattatcatggtatatccttctcaaattattgattttatcttccacttaaaatcaggagatactctgaaaatcaaaacagaaatcccagaattattcttgggattagagttcccaaaacttcattttagtatcatgcttttcaattcaaatgacttggattatttatatacagcactgaaggacaatttgtatgcaaattccattgttggcacaagtccataattaaattgcaaaagcttggaatgatatggaacttatcactgattactttcacaagtggctctcaggaacagaatctcaataaatcactgccattcttctatatttttatacatctgaacaactagcaccttatcagcatgctaagagttagatatagcaatcatgttcttcatgagcatgatataaatctaccaagaagctgctacaaatccatcccttactcttgttatcatgtttacaattaccttccctttgccggttttatgtgattcatatctctgctcaaatattactcctcactctatctcccacaactccattctcatcattcaccattcttgtactcatttacatggcatttaccactatctaaaattatatatttacttgtttattgtcatcatcccctacaatgcaaattttgtaggagagacaagcctgacacttagtagttagttattccataggtattgctcaatgacaaatgaaatggatgaaatacaaagcatttttggagagactataaacctctcatatacagaccagtaacagcataacagtaataatatcacattatgtctcaaaatattgaatttttctatattaaatgcttaataagctgcatgacatttatattgagagctcaatctggacaactataaagggcaattagcaagtattctaaattatgccaactctttatagttcagctacaatgactaattgttgatattttgagataattttatgtattgattaaaggtgtctttataaacaaaaagtgtttactgaatttggcttcccgatgtaaaatgtatatttagtttctcctattaataataaaaaattgtccataatcaaagcacatttgttttgtaaaaaaagtttaagtatatgatgatttatgactttactgagttttatttcctgctttaaatgttatataataattgatttagatttatcatccaaataatcatcttatacaatcatcaaatagaaaataagaatataaaaataatccttactattttcagtatattcacatcaggtatgaaactatagagaacataaactattatgcaaacatattatattacaagattgtaccataacatgatggcaccaacttaatatataattttagccctcagttgagctatatttcattacattaagtaaaaatgaaagtttttgacctagtgaatcatcatgaggaaaaatggatggcaaatgcaattaattttaatatgtaaattttatacttcaaagcagtatttgctaaacaaatattctctgtcattcttttggcttcgatcaatataagaccacaggggccaggcacggtggttcacgcctgtaatcccagaactttggaaggccaaggcgggcagatcatttgaggtcaggagtttgagaccagccttaccaacatggtgaaaccccgtctctactaaaaatataaaaaattagatgggtttggtggcaggtgcctgtaatctcagctacttgggaggctgaggcaggaaactcacttgaacccaggaggtggaggttgcagtgagccaagattgcaccattgcactccagcctgggtgacagagcaagactctgactcagaaaaaaaaaaaaaaaagactgcagggcacattacccattatgagagtggaacatcaagtctaggtttagatttattttttaaccatcaacttattatgaaatgttaatttttaaaaatatgtaaaaatctgaagcactctatctgtagctttcagggaatctattattaaaattaagcctgcagcaaaggacattagtaaaaggaaagagtttctaaacaaaatatttaacactcaaagtagtaaacatatggacaagaatgtaggaatttcatcagtttttattagatgtatccagacaagcaacttttaaacttttctaaaatctgaaatcactgtaacatttccagaggtcttttaaagttcttttgagaaggacaggctacagcttcgtggagctattcatttactgtgacaaattattttcccgtgatgaagaatggttgtaatagaagacataaattcattgataagtacatgagttgtccaaaaatggtttcatcaaaaatactaaaagccaggagatttttgaaccacagtccaggtttagaagacctagttgaggtatgctcttggatctgttctatctatggaactcttcttttgcttcttcccaggtctcctttgtttctgtactagtgaaacaaaaatcctggatgtagaactcctccatgtattatctatactggaaatttcagaaggtgatggaccataggcaaatgtgcttcaaaataaagcttaacttgatccaagcaagatatatagctatatgtttcttaaaggttttacaccatttggtcacctatgtgaaggaagtatttctttaaacacaactcaaataaccattttggttttgactttttgtttgttttctttgataatatgtattataattttccttaaaatatttcagaataaacattttatatgtgttttctatgtctatgtctgtgtaagatgtgtaagtaaactttaatctataccttatggacaattagttagcagtggaataccttaaccaagactcaatactccaaaggagattacttagggacttcaaatgtttgcatatctacattggcttgttattaatttgcattaggaatcttggaaattaatttctattgctaaaattaagggtgttcaggatacatagttggttagaaaaattgtagtggattcattgttattacatgaacaaagcataataatttggcccaatggcttaatataataagggcggggcttttggtcttctctgtcagtggtacataaggttcaatccagtggtagtgggtgaagtggttaacactgtaaataaattaagggtaaaaaacatctgtaacaacttatcagagtaattttatatctttgagttctaaatatactaacaaaacaaacacaccaacgaaaactactaggaacttgtattttgtatttaaaaaaaatgttctagtaattaactattaatttttagtatattttttaaaaaattagtcttcaaaagattaagaaaaagatgatatattgagacacactatcctagttccttgctagctttatattcttccatctacgctaaatagaaattgttgggtttgctatcataatgccactgagttctccaaaagagtaatcttttagtgcatggagctgtcacaggactgaaggctgatgatattgcataaatgttggttttttttaccatttcctttccttttgcttttcctttccttgtttattctgcttaataaaaatattgttatgtttgacaaaatttgacctgtcaaatgtaacgtaatgatctttaaatttaaattacatttcagtgcaataccctactggtatccaggttgcgggtgagtatacaaactccaatatttaccaaaataactttccagttgctaaaatgccaaatataggcttagttttgccatttctttcccaagttcaatcagcccttttgccactgctcctattttgaaacccatgtaatttgtatttcctgttgtttttttcaaaggctcagaggtatagactcattactaagaaggtgaatacacaatctttgtgaaggagcagaattatatatgaagttataaaagatactcaaagaactttctccaggggattataactaaatcttcactcccagctgcctcacctgtcaattagccagagtgtgaccaaaatggcagcaggcaaatgtgaaaaatccaatactgaccataagcacataagacgaaaccactcacccttgtccttcgtcaaggtagaaatctgcttcagcagtactttcaaatacaaaggacaataatatggcaataacaactggcagctttcccggatttaactgctctctaattttgtattaacttcaagaaagatgaatttcttaataacgaattagggctttgagttgctgtctagagcagactggcaatttgactgatatcctaaatgtaaaccttaatgattaccacttggatacttaaagttctgcaattgctcctactaggtttattacgagagaaataatcacctctacagatgttttttgacacataataaattgaaaagcatgaaatccttgctataaagtatttgttttggaacatctactttccaaacacatgactatttttgaatcagtgcattcccacaaaaaaaagtgtgtgtgtgtgtgtggtggcggcgggggcagggggggtggtgggcctgtgtgttgctgctctggaagttaaggtgattgaaatattgttctattgttgctctaccagcatcattttagttttgctttatgaaatatttgaaatgaaaagcagtgtaaatctattaagactcaaaagtgattcatactatgtgattgtggaactgggtttatctgtctcacattattagtaaaatagttgccttatgtcacataaacatctgcaacatgacaacactaccctgttagcaaattcaaatacctctttaaaaaaccctcataagtcaccttttatgtagtctttctaaaaataggtaaaggcataattatgtaaattctaaaagagaattgtttcaatcaacatcataaggtgcacagtaatttgactcaaggatgattataagattttaaaatatgtaaaatgggatacatatctgctcacaaaatcaagttctcaatttattctttattagtaaacctattaatttcttatattaagacttttccctacaaataatatagaatttctgattcaatctagactcatggagagcactttgttacttttccaaaaatgaaatcataaatgaagaagattatagaaacccaattcacaatcctgtaaattgagaaagtatacttttcattaattttggctttaaaagttgaatttaaaaccttcataaatgatattccatgttgtcagtacactgaataatttaaaaattgtttgaatagaaatatgtaaggtgagagaacatgacattgataacatacagatatgcgcaaagcactcacaggaagaagtgcccatcagaaatgtgaggagtcagcaaataaatgattcaggatttcttcaccatcaaatgccactttgtaaaatgtgacagcccagtaagttaggatgagctaaattaaactaaagcccacatgtataatccctcacagtttccaaataactttcacggatagcatctcatttcatctaaaaaacattaaaaggtaagcaaagccagcaagtatcttcgtctcttatttgaggaagccaatgtaaaaataggataattgacttgaggattatcacactacttatggatagatgttagattcattggtactttcacccaattcatccccacatcctgtgtgtcaggaaatgggcatgtttcctacatgactgaggattaatgatcctggcccttgacccaccactaaattaatatattccatagaactagggatgtcaggatactagtcaaggaattcaagttggctgtggataaagaggataattttagctttgtctcctctttgtttaaagccgttaagcaagatttaggcagttatagctagatcaaaaatctcaatcttccatccttacaccactacaaactctgtgggagatttgaaacacatgtctgtattttcagggatttttttttcccccgagtatcctcaatgcacaaaagaagcaaaacaacttgataccaagaaatgaagggcatgtgagggtaatggatggataaagaatctaaactcaaagtgaaataataaagtacaaatcaatgaatgaataaaataaccgccagaggtaaattttaacattggtgaatccccctcaaaaactcagatctattgagtcgattttaacaaattgagcagtttcagaaaaccatatgtaaaaattatgttaatcttttatgtcttgctcacttcttaaacaagacgcctgcctttcgttcatgtagggtttcactgtcaagtaaagactaagcattccaaaatccaagataaaactttacattgacactttaaccttttttggacatttggccagagctgaaaatccagccaaccatgattttttgacagaatgacagaaataagcgaagcagtttcctcactcccttcgtttatgtaagcagcaatataataactaaaacagctttcccaaagtatgttccacaagatgttaacagctattatgtggggaaaaaatgttccatggtcaaataaatttgacagtcattgtgtaaaaccaaatttagaagttctctttatttcaggggcccttatgaccataattatacttctggtcataaaacccctgcgtttcatgactacgtactaggaattgttgctttaaggaaaggatctagttattctttctattacaagcacaacccgagtcctggaacttgaccagggctaacacactgaaatagtaacagaggttctctgtatgctgtgggcttcatgtgccaccattgcttaggactacagtcacctaaatttgggaagaattttatgcttgttaatagatcaaggttgcttcttagttccactaagagtaattgttttattaaaaaaaatcacagtaccaacattatactgagaaaatgtgataaagccctaatcatcaaatatctaagtcagagctcaaattttccaaattatggcagaatttttaaacagatgatttgtttgaatgaccatgcaagttccacacattgcatgtgattgatatgtcatgtaaggctactagtaatctacagatatgctcttccttacttcttttttgtcttccaatatttgtcattattcttaaactggaaaatttttcttgtagagtttctcaccttctgaattttaaggattatatcttatgatgccatttaacatgttcctctgtcccttgaaacttctgcagtcttgtggataaatctaaaggcttgacttggttcaggtttaatttttaatttctgtctacttgccaaaaaccttttgtacgttcatcaagagtcatgtaatgtctagaagtttctctttttgtgacattagtagtagccactgatgacaactgtctagattgattattttattaaaggttttcaggtgacagtgatattctaactgtattatttcatcttcattagctggcatatttttataaagaggaactcagtctcatcaactatgtggttagggtttttacaagaaagtcaggtaaaatgttgtctccatttatttagcagattacagatgacagagatggttcaccagtttcctccaaacaagctgagagttttttctttctttttaattcatgtatttttttattatgatgagctcatggattacaaaaaattttgtgttttaatccattgttattattaattttcttgatgataattttgtacccttttttatggccaatagaagcctctttcagttcacttttgaatctttctgttatgagccagtagactttgataactctattgcattcaggttatactttcattttttaaaaagtaaaatagctttgtattcccttacttgtttttagacaaaaggtagcaatcatgcaccattttctctaccttgaattttgttcatcaagaatcatatatagagatatttttcatttctttttacagctatatagtatgtcactgtgtatggaatataatttctttaatgaattccttttttgatgcacacttgggttgttcaaggctttttgcttttctaaaatatactgctgtaatgcagccttgcctgcattgtttttaaattctattcatgttgctgtgtgtgtgtctagtctgttgtttttaaccatgtcatggtactccatgctacacatagaaaaacataattttataaaaaccacagaggcagaatccactaatgattttcatttgcaaagatataaacaatttactccattataagtggatagtttttgcaattacataaattgcttttcaatatctgtatcgtttggctgtgcccccacccactcatcttgaattgtaatctgaattgtaatccccatgtgttggtggaagaaccatgtgggaggtaattagatcatggggctggttccccctgctccccccatgctgttctcgtgatagtgagtgagtttttatgagatctgatggttttataaggggctttccccaccttcgctctgcacttctctctcctgccgccatgtgaaggacatgtttgctcccacttccatcacgattgtaagtttcctgaggtgtccccagctatgcagaattgtgagtcaattaaacctctttttattaaaataaataaataaataaattacccagtgtccggcgtttcttcacagcagcatgagaataggctaatataatgtgtcataattcttttcttttttttaataaaaagttacatagattatttcttctggaagtgttattgctttattcacaggcaacaaacacaaaaacagacaaatggaattacatcaagctaaaaagcttctgtatagctagggaaacaatcaacagagtgaagagacaacctacagaataggagaaaatatgtgcaaactattcatttaacaagggattaataatcaaaatatataaagaactcaagcaactcaaaactaaaaataataataatcccagtaaaaagtgggcaaagaggttgggtgcagtggctcacatctgtaatccgagcactttgggaggccaaggtggtcagatcacttgaggttaggagttcgagacatatatatatacacatatgtatacacatatatacatatatttcattgtatatattatatatacatatatattatatatatataatatatatgtatatataatatatacaatgaaatattattcagccataaaaagaagaaaatcctgtcatttgcagatgtggatgagcctggaggacattatgttaagtgaaataagacaggcatggaaacacaaatagcatgtttcatttatatgttaatatgattaggctttgtttccccacccaaatttcatcttgaattgtaatcttcgcaatccctataggtcaagggagagaccaggtggaggtaattgagtcatgggggtggtttcctgcatgctgttctgatgatagtgagttctcatagtatctgatggtttcataaggggcccttcctccttcactcggcacttctcactcctgccaccttgtgaagaaggtgccatgcttcccctttgccttctgccatgactgtgtttccggaggcctccccagccattctgaactgtgagtcaattaaacctctttctttcataattgtataaattacccagtcttggacagttctttatagaaataggaaaatggactaatacatatgtggaagctaagaaaaaagttggtctcatggagggtggttatcagaggctgggaagggcaagcgggagggagaggatgaagagtcagttaatggatacaaaaatacagttagatagaaggaaacagttggtgttgatatagtttggttctgtgtacctacacaagtctcaccttgaattgtaatccccataatccccacatgtcaagggtaggacccaggtggaggtaattggaccatgggggtggttttcctcatgctgttctcatgatagtgagtgagttctcacaagagctgatggttctcacaagtgtccagcatttcccccgcttgcactcactccactgtcaccctgtgaagaagatgcctgcttctcctttgccttctgccatgattctaagtttcctgaggcctccccagcaatgcagaactgtgagtcaattaaacctctttcctttataaattacccagtctcaggtatttcttcatagcagtgtgagaatgaactaatacagtgtttgatagcacaatatggtaactacagttatcaataatagattatatatttcaaaatagctagaagagacgttctcagcaaaataatgataaatttttgacgtgatgtatatcccaagtactctaatttgatcattacacattctacacatgtatcaaaatatcaaaatatgtatcaaaatcccactacttctaaagtactgggattacaaatgtgagccactgttcctcctccatgatccactattccttagagataaacaatctttttctagtctggaattcaacagcagactccttatatgcactatgaattttttctaacatttatatattcaaagaagttttgcattaaataatgctgaattttggaatcttttctgaaatatgtataaaaatactatgaggacctttgatagaaatgagtcaaaggactggaaaaacaaggcaactgttgagcctttattgcatctcaagctctaattatctttaatgttgttactaatatttgctcatagttataacaagaatcagataaaattctttaataaacataatatgatgatagtaaaaatgtacttatgcttgagtaatagtaaagttcatgttgttttaggaaatgcacaattattattatcacattagtataaaagtaatatctaaatctgaggctttctcatgagctgagaaatgctacttttaaatatgagggcatgcctagatatagatatttcataacaaaaacaaatagataaatgaatataagagtctagaaataggctgacacataatttcaaatgtttctgacatatttctaagatgacttaatagggaaaggataatcttttcaacaaatgtggctggcataattaaatatgtgtatatataacaaaactaaagcctcaactcaatattataccatggacaaataacttgaactgaattttcaatctaaatatggaagttaacatcataaaacttctagaaaaacacatggaagaagatcttcacaaatttaggcaagccaagatttctttgacaagaaacaactaagaattaaaaaaattataaactaggcttcaccaatattaaaatcttttgctcttcgagagataaattaagaaaatgaaaaaaataaggcatagactgggagaaaatattcacaatatacatatctgacaaaggacttgcattcacaattataatgaatatttacaacttaattatcagctgaagagcaagatttttaaaatgaacaagactttgcagtttcttcatcaaaggagataaatgaatggccattaaggacatgaaaatatgctaaacattcttgttaaattataaccttatcattatgtgatacatttctgtgtcttttttgattgttgttggtttaaagtctgtttcgtctgaagttacactagtaattcctgctctttttcattttctgtgtgctttgttgatttttctctatccctttactttgagcctatgagtgtcattacatgtgagatgcatctcttgaagacagcatatagttgggtcttgcttctttatccaacttgccactctgtgactttcaagtagggcatttagcctgtttacattcaaggttactatttatatactaaatatatatgcatgcaacactgaagcacccagattcataaaatagctattagagacttacaaagactttgataaccacacaacaatagtgggagacttcaacaccccactgacagcattagacaaatcattgaggcagaaaaataacaaagatatttgggatctgaatttgatacttggccaaacagacctaacagacatccacagaacactccacccaacaacagaatatacattcttctcacctgcatatggcatatactctaaaatcagccacataattggccataaaacaattcccaacaaagaaaaaaacaaaaccatatcaaccatgctcttggaccacaggaaaataaaaataaaaatcaataccaagaagacccctcaaaactatacaatcatggaaattaaacaacctgctcctgaatgatttttgggtaaatggtgacattaagtcagaaatcaataaattatttgaaactaataaaaacaaggacacaacatagaagaatctctgggacacagctaaaacagtattaagaagaaagtttatagcactgaacacccacatcaaaaagttagaaagatcttaaattaacagcctaacatcgcatctagaggaactagcacaacaagagcaagccaaccccaaagcaagcagaaaaaaagaaataaccaaagtcagagctgaactgaatgaaattgagacacaaggtcgggtgcagtggctcacgcctgtaatcccagcactttgggaggctgaggtgggtggatcacgaggtcaggggtttgagaacagcctgaccaacatggtgaaaccccgtctctactaaaaatacaaaaactagctgagtgtgttggtgggcgcctgtaatcccagctactcaggaggctgagaaaggagaattgcttgaatccgggaggtggaggttgcagtgagccaagatcacactactgcactccagcctgggtgacagagtgagactccatcacaaaaaaaaaaaaaaaaaaaaaagaaattgagacacaaaaaaccatacaaaagatcaacaaaaccaaaagttggtctttgaaagaataagatcgataaactgctaggtagactaataaagaaaaaaggagagaagatccaaataaacacaatcagaaatgataaagaagacatttaccactggccccagagaaagacaaaataacccctcaaatactattatgaatacctctatgcacacaactagaaaatgtagaagaaatggataaattcctggaaacataaacactcccaagattgaaagagcaagaaatagaaactatgaacagaagaatatgagttgtgaatattgagtgtgaataccattagagttgtgaaattgaatcaataataaaaagcttcccaaccagaaaaagccctggactagatggattcacagccaaattctaccagacatacagagaagagatggtatcaatcctactgacactatttcaaaaaattgaggaggtgggactgctccctaactcattccatgaggtaagcctcattctaacataaaaacctgtagagatacaacaacaacaaaaaagaaaacttcaggtcaatatccctaatgaacatagataaaaaatcctcactaaaatattagcatcccaaatacagcagcacataaaaaagataatttaccatgatcaagtgggcttcattcctgggatgcaaggttggtttaacaataaatgtgatcaataaatgtgatacattgcataaacagaactaaaaacaaaaaacacataatcatctcaatagatccagaaatggcttttgataaaatttaacatcctttcaggttaaaaaccctcagtgaatgaggcattgcaggaacatatatcaaaataatgagactcatccataaaaaaccacagccaacatcatattgaatgggcaaaagttgaaagcatttaccttgagaaccagaagacaaggatgcccactctcaccactcctaaaagtactggaattccaagccagatcaattgggcaagagaaagaaataaaaggcactcaaataggaagaaaggaagtcaaactatctattttggcagattatatgattatgactagaaaaccccataatgtctgcccaaaagctcctagatctgataaacaacttcagccaaatttcaggatacaaaatcaatgtacaaaaatcagtagcatttgtatacaccagtattgtttaagctaagagcaaaatcaagaatgcaatcacagtcacagcagccagtataaaatggcataaccacttggaaaagtttgacagtttcctataaatttatacatgcatttaccacatgaccctactacactgcaattctaatccttgttatttacctgaggaaaatcaagagaacaaatgtgcatcaaaagactcttacttgaatgttcttagcaacctaattcatagtatcacaaaattgggaaaacctaaatatgtatccatagaatagtgggttaataaatgaagtacttctcaggaacacatggatgaatttcagaaacattgtactaagaaaatgaaactatactcaagaagtatcaactgtatgatatcatttatataaaagtaaatgtaatctatagtgatagaaagcagatcagtggcttcctaggggtgaggatgaggttttcctgtagcagaagggaacttttggacatgatggaaatattttacatcttaactaggtttgtggttacatgtgtatatacacacgtccaaatccactgaagtgtatgcttaaaatgagtgcattttattatttgtaaattatagctcaatatagttaattttaaacatttacttataatttgttacttcatgatgttatataaatgaaggtacatggtatataatctttgagattgactgttttaactaagtgtatgctgttaagatctatccaagttgtagagatggcaaacaggttagtggttgccaggtgtcactttgggaggcggaggcaggcggatcacgaggtcaggagatcgagaccatcctgcctaacacagtgaaaccccatctctactaaaaatacaaaaaattagccgggcctggtggcgggcacctgtagtcccagctatgccggaggctgaggcaggagaatggcgtgaacccgggaggcagagcttgcagtgagccaagatcacgccactgcactccagcctgggtgaaagagcaagactccatcccccaaaaaaagagtggcagagaagaaagggatggatgtggcaatgaaagggtagcacaagggggatcttcaggacgatgctatagctctggacttgattacggtgtttacatgaatctatacatatgataaaataacataaaacaataatgaccttataccagtgtcaaattgctggttttgacattgtactataatagcgtaagttgtaactactggggaaaaatttgagtgagggatacacatatacacaaggtctctcagtactatctttgcaacttcctgtgtgcatataattatattaaaacaatttcaaagatagcttaatatgtttgatttgttatggagtagggttatgggctgaactgtgtccccttcaaatttctatgatgacgtcctaatccctagtttctcttaatgtgactgtgtttcgaaatacagcctttaaagaggtcattactgttaaatgaggtcataaggtgaggtaatccaatctgactgatgtccttaaaggaagacacacacacagagggaaaaccacaagaagacaccagaaaaagacagctatctacaacaagccaaggaaagaggacttagaagaaaccaaccctacagacatcttgatctcagacatctggactccagaattgtgagaaaatagatttctgctgttgaagtcacccagtttggcgctttgttgtgacagccctagcgaagtaatacacgtgatatctctaaaattaatgctttgaacctaagaaagtctgaaaatattctaaggataagttttatctttcccatattgtagccaaggaagctaaaccttagagagtttacaaaacttgttcaaggtgataaaattagtaagatgtaaagttgaggacagaatcctcctctgcccaacttgctttttctactgcatcatgctggcactgaagtcttgtaaatcaggatttactttaaggaattaggagagacaactaaaggcactgtaaaattctaatcatcatctaaacttagtaccaaatattttctaaaagttaaatactctgaagaagaaatgtgtagtgcctcactaaaatgtcatttataagattcagcatgtttcataatatccaattatgtgtttcatgaaatgcagctgaggtcttgtatctagattctggaaggaaaaagtaatttcattttcttgttaaataaaaccaaaattttacagtttcaagtgttcattttgaatgaatatatttttttaaaaagcagacaaaaattagaatattcttatattctcccttttgggaataggaataaaattatgatgaggctattttattactgactttataacaggatatcagtttttgttatgacaaagttactatattagccagcaagatgtgttattatttgccatataactatataacatattttaagttacatcaatcaaaccattaaaacatgaaagatgtgcactcattttacaataaaataatgtaagttaaggcacaatgtgtataatgtgctaaattactctttattaaattagaaaaatcaaagaagatatataaaatgataaatgaaatatctacacaataggaaatcaatgtttgtaacagtatggacaagtacaaaataataatatggcacagttctttattgacctactattatggaaatataaatgctataagccatggtggtctttaacaaaacgagaaaatgcctatatacaaatatgtgtgtatgtctctgtaacatacaacattcttttatatgtgtgtttcatgaaagaattaaattagggaaaaacctctattgagttgataagcctattgaaaaaatacacagttcttcaatgaaataaatatatatgtatatgaaggtttgatatatgccatttgaacaggactagaattttacattttatattatcacctagtattatgattaattattcaaattccttataatccctgattataagggtctctaatgaagttcattcattaaacaatatcttaataccctttccaaattttaggggacattgtttattcttcactagaatatcctcttatagtgagtagggatggtgattgtatgtgctgtagaccatggaaatagatttttagaagtcaataaatgttaaacttctttccacagtcatctgaactatgaaaatgtaagtttcccactacgatggcctattagtacagctatccaagcatgaaggtgaaacactgtcaaagcatggggctttgcttggcatgtcctttgttttaaagggtagaatacatgtggcactgtaacgcagcttaataaagtctgtattcttagcacttccattgtgatttcataaatcacttgtgggttaatttataaaaaccactatcccaagcttagggtaataattctactagcaactggtcagaatggtaaaagatcagaggaaagaatgcataaaataggtaaaaccttagaaaacacattaaattcctttttactacctaggcatggaaacaattcataaagaaataatgctgaaataatattacacacacacagtttacttgaggaacaaaatgccacgatgttctccaattgaatgttgttgtgtgaatggtatttgactttttatttctgcatgttttaagtcagaaaaaaataaataacttctccctttttactacaagtcttactgctaaaacattttttagtgtgtttcagctgtgcacttatcacattaaatatttagacataaataatgagtaaatgtataaatatttcagataaattagtattctagaaaagctctatgttctaattttgtaccataatattagtataggttctgcttattttatggtcacagaagccattaagcttaagaattatctcagggggcctggcacaatggctcatgcctgtaatcccagcactttgggaagccaaggtgggccgatcacttgaggtcgggagttcgagaccagcctggccaacagtgtgaaatcctatctctactaaaaatacaaaaattagccaggtgtggtgacacatgcctggtggtgcatgcctgtaatcccagctacttggagggctgaggcaggagaatcacttgaacctgggaggcagaggttgcagtgaaatgtagattaccaaaataaaataataacattttgccaaacaaaaacagtttaacaaagaataaactgttctgttgctatggtttttagacaagcaaatgttgccaacttcaagatgatcatgcttttaaggtccataggagtgacatgctccacctctagggaagttattgctttcataatctttaatgttactcatccacaaaggaaaaaatgacatgattaaaagtgtggataaatggaaaatttgagaattcaggttatttcaatgaacattaaatacttagttcaaattgtgtattgtgtcaaatactactaggaaatcaaaaattaattaataagacttttttttccccctgccatcaaagagctcacagttcagcaaggagaaagacatgtaatcaaatttacataataatgtgacaaatgtgataatataagtatgtagatgaaagctggtgaggaaatattcagggaactctaagaattctttatacgtagagaataaaaatgaggctgagaagttatacacaggctagaaaaggatggatccctatgcaaagtactctgcctgtttattacagacttgtatcctaaattccttgattaatccagctttgatgtttgccaacatacatctgtatctatttaataattaatttagattttttctttatataattaattaattttcatctttgtaatttttaattgctaaaagattttctaaaatcggccttgttatttttatgttttttattccttactcatattttactacctctcatatttttatacatactaaatacacatattttgttttatatgtctgataacactcatatgtagaatttctgagactctgattctgtaatttttaattgctaaaagattttctaaaatcggccttgttatttttatgtttttttattccttactcatattttactacttctcatatttttatacacactaaatacacatattttgttttatatgtctgataacactcatatatagaatttctgagactctgattctgtagtctgctgtgttcgctggctgttactcagggagcctcatttccctgcacattttgtttttgaccatgaagctttggttgaaattaagttccttcaaaggtgatttaaatttgcttctttcaggggccctgaaagcattaccaacttagaagcacctcaaactaaagtttcagctagaagtctgttgttttctcatgaatacatgtgaatttgggctccatgcacacgtgggggctggcttgaatttacaaatgatcattagacccttctctcctgttcatttaacatcaacataaagacaaacaggtttactggtcatctccttctggaagggactgtgggagggagacatgaaatatgtggcctctttaatgtcacactatgggtcttatcagtcataaattcttcttttttctgttttgttggtgacagggtcttagtatgtcaccagggctgtattgcagtggtgcaattataactcatctcagtctcaaactgctgggctcaagcgatcctcctgccacatcctccaaattcgctaggagtgcaggtgagtgccaccatgcctggctaatttttttgtttttgtagagactgggtcttgatatgttgccaagactggtctcaaaactcctggcctcaagggatcttcctgcctcagcctcccaaagttttgggaacaaaagcgtgagccattgcacccagcctcaggcataaattctcgaaaaaatttttctcctaccatttttaccccacaagacaatcagaagtttgactcaccaacattcagtgaagtctcctggctgaaagccaactttcttgtgtgcctgactctgaattcctgcttttatttcagttttcgcattgagaaagaaacaaaagagccagcctctgatgtgtggaagctgccctggcactcacatctaaagacttgttattctattgaatataatccgacagaataaaaaactcggaaaagagtactctgagaccatgataaaaggagacaaaacatgctacttaataatttttctaaacgttgacaaaaacaaagtcactgtgccattcacaaaatacaaaacatcccctcttggctaaaatgagtaactgatacttttttaccaagtagtttgatcctcattctaagtctaccctcactctagataaaacatattgagatacctggtcatagaattgcctttgcttttttactctatctaatctaggggaaaatcctattttcttagattcttctccaaatcacccaaccaaagcccaagccctgtaatagattgtcactaataccgtgttaccaagacccctcattgttccctatgcaatgagggtcttttctcaatgcaatgagcaataaatcccaacttgtttaactactgatgtgctcctggtggcctttggctaaaagacattgacagcgtctcagtattctatttctttattataattcttattttgctagctcatagctcagtgcaacatgtgaaactatttgaaaaacaatgtatctgccatttttcatcgttttgcagcaggagcaaagttcaggatatctaaaatctcttattgcacatgtcttttataaattatatttaatctataaaaatcagggaaaaacctaaaaatcagctgagcaccaagtaattatttaataagtatatttactttgttattttgaaacaacaaatatgtttcagaattaatttatacaagaaaaaatgtaatgggcacactggggagcttttaatgtcatgactatgcaaagctaagaatcatgcaaaattatcttcaaatgtcaggaactttttatgaacactaaatttaaccattagtaagttttaaacatattatttaaatatttgttaattttgacattgtagttttctctttctatttggagcctcactctctctctctttctatatatatatatgtatttagttttatgtctcagagatttttttgtaggcctttggaaaactcataagctgtaagatttgttcttataattccaagtagataaaactgtcctttttgggtatagttcctaacactcccaatagcacaccctctctcagggagtgggaatgtgagaagccagaaaaagattaaaaattgtgggaaagtacagaagacacacagagaaacagcagcagaaaccatgctaagtgtgaaccataatgtagagagaagagcagagatgactcagcagggggaggaaaaacaagcaacacacagacacaaaggacattcgacaggagcatggctactatcagggggatcaagtgggatcccaataatcgggactgattacataacttgtgggacctgtgcaaaataaaaatgcagagctccctgttcaaaaattgttaagaattgcaagacagtgaaagcacagcattaagccaagcacagggccattttgagcatggcaccatgtgcacctgcatgggtcgcacacccatgaggctgtccctgcagaaggctttcccactcttcccaagaaatggctctgggatgttggcattgacttggatgctcccatgccactggcctttccacactgcatctcattgcctaagccaacttgaccgcgtcgcttgcttgggaccctgacaaaactatgattccgtgtgtttaatatgaaaacgaattaatattagaaacctaaggtaatttaaataaataataaaagaatttaaataaaccaaaaattggtctatcttttatcaattaacatatttacacattataagactgaaaatcaactgctaatttcttcttataacttgaaggcacataatgaaaatatagcacatgattaatacctggtctaagggtaccaagtgacattggcatattcttaatcttataaaaagtgtgtatgaaagcatctttacatgcttttattatcattaatctttaatatagttgaaatgaaacagtgtgcttgttacacaagacaaggcctcaaatcctctttccataagaggcaacatgaactactctatctcactctgtcgtccaggctggagtgcagggtgcgatctcggctcactgcaacctctgcctcccgggttcacgccattctcctgcctcagcctcccgagtagctgggactacagacgcccaccaccacgcccggctaatttttttgtatttttagtagagatggggtttcaccacattagctaggatggtctcgatctcctgacctcgtgatccacccatcttggcctcccgaagtgctgggattacaggtgtgagccaccccacccggctgctattcttatatactgtgatactatttgatgtattgtgactctcaaataatgttaagacttacataaacaagggagactacacagaaaatatcagttttccaaaaacaaatacatgaaaatgtataaactttatgcccagcaaatactcaaccaaattcttcatctatgaacactctgatctccagtactacatttccactgtccatgtcactagtagtaactccaataattcaattcatttaaagtgaaaaaaaaactttataatatgtatcccatttttaaaaataagtttgagtttattaataaaatacactaatatggaatgtatcctaagtatttataatcaggcttaatattataagctcccacacatgtaatgtaatcattctataaaaatttgatatatggcaaaagaagctgattccacagacttccataataattgaaaaaatatcctgtattagcaactactataacagaataagacaaaattatatttatggtcatctgctaaaagctaattaatgtaaaatgttggaaaataatgatatgaaagcactttcaaatttaaaagaacaaagaagcatgactaaatccttctgaacttgtttgaattttttgtgttataaatataaaatttggctgggagcggtgactcacacctgtaatcccagcactttaggaggctgaggtgggtggatcatttgaggtcgggagttcgagatcagcctggccaacatggtgaaacccgcctctagtaaaaatacaaaaattagccaggcatggtggctggcgcctgtagtcccagctactcaggaggctgaggagggagaatcgcttgaacccgggaggcagaggttgcaatgagccaagattggaccactccactccagcttgggcgacatagcgagactctgtctcaatcaatcaataaaaataaatataaagtttcatgtaagtacatacagtaagttaaactgagaaaaaatagtaaaataagaaaaagtaggaaatcataattcaaatacaataattacaaaattataaaagtcctttcaaaatataaatttatagctccataagattcataaaattgatattttttatttagaaaatccaggtcccagaaaaacaaccctattctctcttcctgacttattcatcactgtaaatgacatcataattctttctgttacctgagttcaaaacaaacttgtttccttttggattgcttgattcaatctgtcactgattcttgtcgattccacagtgaactgtctctcccattctggtctttctttccagccactctcttcataccataaactaggccttgatacctctcgtttgggccatttcaatagtttcctaactaattcctccatctccattctgttcctcccatgtttctgcttttagtctctgaaaaaccaaactttactccctatggtttttgttggagttagttctgactctacctggaatcccttctctgagccactttgtctttgggtcccaatttgtccctttgggacagacggagtcccgctctgtcacccagggtggagtgcagtggtgcaatctcagttcaccataacctccgcctcccaggttcaagtgattctcttgcctcagcctcccaagtagctgggattacaggcacacaccaccatgaccagctaatttttttgcatttttagtaaagacggggtttcaccatattggccaggctgatctcgaactcctgacctcgaggtgatccacccaccttggcctcccaaagtgctgggattacaggcgtgagccaccatgtccggcctccttgcctgtcctatctttatgctccagctgaactggactacacgttgttccgatgtatcttctatctctaactccttgtttctgatgtcctctgaatatagaatgctaattatctttgctaatatagtcacaagttgggaaactgttttaggttaagctcactaaaacataaactttgtaagggcatgcctttttttttttaactgtttactgatatagcacaagaggcagtaactgtgtctggcgcataatatgtactcaattgatagttgtttcatgaatgcataagattccctaagaatttaaaattctgcaattctaaccaatgatgcccaagtatcagatattttatattaagtacgtgcatgtgcaaagctatattatgtgtgcctaatgacatagatgttaacaatatatgcaggaaagtgacaagagcagccaactggtctatagaacacacttttttttttttgcaaataactccagagcacttatttatttattgtatacaatattccagtcagattaattacatatgtaatattctagccagatggctatgtagaaatatgtatattcaaatttaatttaaaagaaactttcaaataattttctagaacactgcatgcaactatgaacttagagcttgtttttatttttctgagtttttgttttcctaggattttacgtccactacatattcttctgtttccctatgtttataaaactccttgtttatctctgcacacaacctcttggtccaggtgttctgaagttactgccacctaatgagagtgacacagtaatgatccctccagttaatcagcaacactgaatctgctctagaaagactaacaagtgagaacaatggtgtctgaggctgatttttagacaaaagaaacaggtaaaacattagcagagagaaaaggccccagtaagttaacctcataaataagttttaaagaatacaacctatccaaagtcttttgattaaatgagagaacccttgcacactggtttcttaaaaattttatggcctgtaaactccagccctttcgggggctgaggcaggaggatggcttgatgccaggagttcaagaccagtctggtgagattccatctcaaaaaacaacaaaaaaaaaattagctgtgcatggttgcgcatgcccgtagtcccagctactcagaaggctgcaggagttcaaggctgcttcaagctatgatcgcatcactgcattccagcctggtagatttttttctaaagaaaaaaaatcacgtatagttattttgtagtgaataagttcataggtcacaatgaactccaaatctctgaaaggaccttagtcttaatttagacaacccaaaatggtcataatgaaaaaaagacttcttaaaaatatctcttcaaggtcatttctgcctgttagaattcattcatgtattcagttcaatacttgcacagagtatcacagagataaaaagttcctcagaggcatttcttccactgtttaacatctctccttctaattgggtagatgagaaaagtgaatgccattgtttaacattttcagcttaattatattggctatggcagctaagctaataactagatatttcaaaggagtcatggtatatgtaattattataaagaataatatgtcacagtattcattagtgtttattaaaatacttcacagacaaaaatacacattcactaaaatactgcatgcaatcactttcaaatccatgcttcccctaggactatatttagtggagaaattatttcccaggtttaaattctgcctcatatttcctgaccattgttttttctagatattttccttcttaagaagtgaaactgtgaacaatacctaaaagagatcatactatttcagaaatctgaagaagtcctcctgtggtggggtcagtattgttgttgtttttcttgttgtttgttgttttaaaatcttacctcatgctattctgaaaacattctttttcaagctcacagaacatcttgtaaatatctgccacttgacattacattcagtgtaagtataaagactatttggattttatatagatagaaacttagaattttaaggcttaaaggtcctttagagatgacatggctcaacctttaccttttatggattaggaaatagagatgtggaaggaccacatgagttagacattttgtgggaagatggttgtttttaaaacactgaccaaggtctccaaaatgctctgaaatctattgaaaaatgcttcccaatttgtatttgtattgctattttaaaggttaaaaaaatctagattaatgtacaaattgagcaaatacattttagaaactgcctttattctgaatatgtgtatttttgtttctaatatgtaagcttataatattcttacaagagaaaagtaattcaaaatattaagcagtctgttgctatccctcaggttgtctcagcctagaagtgcacctgcacacttctctcagcccttctttatgatatcacctcttttaacttttattcattatcttatcggtcttgaggtatttcaatggcaggtgcagcataagtttgtattaatgcttagtacctcctctttatgttccgagaaccgattcacatctttctacctggcctcatgtgtaattcatgttaatgaggcactgaaatctgaagagcatgttaaagtatgagaaggagacacttccataggggtggttgggttatgagaaaggaagaaagatgggagataagatctccacttccattgcattttttgctaatcccaaaatgggcaggtgactgtaagtaactatacaaattgttcctgcccagaaaggggctctattagttttttttttttttagtcacatagacttcatcaaatataaacaggagggaaaagctggtttttgaaaatgttagctcatcatgtatataattcatacttttgagaaaaacaaatgatagaaacagaggaagtggtggagaggggggaagaagaacaaagaaggaactgagagaacaacaaggcaaaagaccagggaaaatgcgatgggatacaaattcaagtcagaaatttattttgtagattagacattgactcccattagttcaatttttttctatgctatttaggaaaaagaatttcactaccttaataatgttgctctcagtagagttactttaaccatgaatcttatgccaagataactaatacacttaatagaaaactctaaagaaatgaggaacataggattctagaaaatacatgtagagaagtgtaggtcctgagaaagtagaaaaacattttatggaagaacatagatagtaagagctggacatgtacctactccacagttgagaaagcatcaaaggtagagcactgcaggcagatcagtgggtaatacttttaccctcatgcccacacgtagttttgtcattttaattttccccatattacacattttaccaaataaaaatatattatagttttgttattacaaggggtgacattagagcagacatcagcaaacactttctgcaaggaacagagagtaaatgcataggaggtaggagaataacagaaataaataaaaggaaggatataaaagttataaatatacactgctggaaaaatgaacgcaaaacacttacacctgaatagaattgcagtggaccattagggtcttgaaatcagacagattaggcagagttaaaataccagtgatgcagggcacccctgggtaaattacttttcctctctaatctttagtgtccttatgagtagataagggacaaataatagcatttacttttcagggttgttgagaagtttgattcaaataagttgtataaagcttaacatggcatactcagtatagtaagtagtcaataaataggagttgttaacataaagatatttttaagcaataaagagtaaaataatgggtattaggttggtgcattacctttaacggcaaaaactgcaattacttttgcaccaatctgatatttttaattatattattttatattacaaataatacagaaaaggattctcaagttacacactctcataatatcctgtgattttttttgtagcacaatttatatttgtatttttaatgattttttaatatatgtttctcccactgggctacaatcccatgggtaacggaccttgtctgtccaaaattgtattcctagtgtcatccacaacctctggcatatcaaaaatgctcagtaaatatttttgctgaggtgaatggactcagaatgagaaagcataggttaaaataaaaattctataatttatagttgtgtggttgtggaaatgccttctcaatcttaatgtctgtataatggggacaatagtaacattcagtttaattgctatgaggagtcagagtgtctaggagatattccgtgcttaaaaaatgctacctgagtcaaatttagttattttgtttaaatttaagttgaccatagcattaagttaatcaaatttctatattatccaagcactttggttattagatctttatgtccatgtttgtaatatacaataatcaaggtagcatatatttaaacttatgagatgcctttacctttcaataaaacttcataaataaaatgtaaagggaaatatattcttcaaaatttcatgctcttgaaagaaaagtcactgatcctagtataaagaacctagttgatcagttctgccaaagcagcatgttgctccttctgcactctgattgtaaattaaaaattaatatgtctacctgtgctcactagtgaatttattagaaaccatcaatatttcatgtgtggcataggtcaatcctatgttgtacatctaatgagtaatgtatgaggtgttgctggggcccaaccagtggctgcagaagctttgccttcagcagaagatggtagtatcagagaacatgatcagctaaggagaagaaatcaatggcctttttttatcttactgcaaaattaatgatgacccctatgaaaccaaaatatctcttactaactataagaaaggaagactcagaaaatctccagtacaaagttgaagtttaaggttttcaaggtagagccattaaaagtcataattttagtaatatttaaagtcattggaaaatgccaatgatacatggctacatgtgcaatgagaatggaaaagtacatacaatatggccccaattttatgcaattatctttttcatgcacatatttttttaaaaaaaaacttggtgtaattatgtaaatgtaataatggtagttacctctaagtattggaatatggatacttacctcttagtatttgactagttaggtcaatcagatagtatcaggaacacaaagatacatgaggggttgatggcagtaggagtcaaaaaatagaatgcagatgattttgaagattctgtaataggccacatgtaggcccaggttatgaggaagcagaaattaagaggaagcgtaagtcaggagtaaacaatatgtgttggagagtgacatagctaatctgcaaagagaccaacaggacatctgactctgggtaatgataaagcacgagaattaaggtcctgtggcctgacttaccccatgagtctttcactttcagggttatggccttgctgtgtttcccacctgatagaaagtgaatgatgtagctattttgggcttcatatgagtacaacaaatcccactacatgaaataacgaagtctcttccttacaacaagaaattgaattaaagaacaattatactaaaagaaagaaaacaacatactctgtggattcaaaagccagtggtggctccagaatttctatctgagatgagttttaagggaggttatattgttgagcctatgcagggattatcttgaagcacagtcctatagcaaatatactgttgactaatcaggaggctttaagtgatatttgcataactaatgtttcttagcttgtattttcatttagggtggatggaagattatgcaagtactaaccttacattttagaattcataaaattagaggtcctgtgccattataaattttcaggaagatgttcctgagcatgatacagaactgagagcaagattaaaatgctctattttattgttaatgcttacctatcaggtgtgctttgaaggttgcttaaaggactgttagaaaaaaaaaaagcctttttttttctcgggcctttcattatatgacactcgtttcctgtattcaagctcaacgaggctgagaagaggaattaattttattcatcacacaagttagggagaagtgctgtcggagatatttagaggcatattttagttacaaatcttctagtgtttaggatagcgtgcacaggccaacaaatatcagaaggttgtagtcttaaataaggacccgctcaggctagctctgaagttttttttgaggcaatactgaaaaagaagaaaaaaagaagatgtgatgaagatagggaattattaaagaaattgaatttataactgggaccaagattaggggtggcaaataagttctactttgtatgccaataacagtagatcgaaaatgactgctactgcagtaaagagaagaaattcatagccaagtctgggatgccaaaatgttctgggaccaattaaggtctgctatcagcctcggatgtcacatagttgccattctgacaagtgaagtcacagatagaaggggtggtggtatggaaagagtaaaggctttgcagttcaaatacctgctccaccttatacatgtggagtttgggaatatttatttaatcttccattttctcatcatagaaatcataatgcctacttcatgtcatttctgtgagaattaaataaaaaacacatgaaatccacaatacatttccaggcacaaggcaggtgtccaataaaatgataagtcctttcttccttcatttttatttgattacaattgccaccctattggcccacaattaatgaaaatacatatctaggccaaactacaggctcatgattcattttaactgtaccactccatactactggcccatgattagttataatttcacagcccatacctacgtccattattgattccaatgccacagctcataccccaagtccacaattgcttacaaatgttcagcccatacttcatgtctacagtagatcacaattgtaccactctatcccctctatctacatattgccatttctgccattggaatgtcataagaagaaaacatatgaacattacagtgaaactgtatagagatgacttgaaaaagacgtggtacttttgtggtagttttttgaagctccgtctggctcctccctgtcatccttgttttctgttcttcttaaaaacctatgcaaaagatactttattttcattgaatggaaatggtgaaattaatccttgttttgaaaaatgcaaaagattaaaactttttgtattttctgctcagttatttgtaaacctaaaactgctttaaacatagtctattcatttttaaaaagagaaaaatatatattttcatgagtctataatttgaaaacaaaacaatccaggtgcatccatgcacctccatgccagcgaggaagctccttccacctcctccctgtcatcgatgtttcctgttcttactcccatccgtgttctgacaagggttgggtgaatgatgagtgcaatgaggaaacagctattctgaaatttgatgatgctaattcctatcttagtaatgggaagcatgtagttcaactctgttcacaaactcctaaaagaaagaaacaaccacccagtgaaagtcaattaggattcaactatttttttgcttgttttagaagggctactgcttatgtatgctttccttatgctgcttgataaactccaatgaaaggtccatgctggatgattctacaaaccctaaatctaaaattcaaaagtaatttgcaaaaatggcaatagggtgtactgagaagactcattttgtcctggcttcattttattcatttttctgtaagactgggctgatgcagcagtgtggctcacctacttactcattgcaatctgctcttccaacagtgtgtttccaacaaatgtgtgactgggtttatgattccttcggattccagttgcctcatattatcatcagccaaatcaaaattgtactgcagctacagaaaacctttttttaaaaaataaaatatgcagtctcatcaaagctgcatagcttcttctatttaaacaaaatatgtattttttatgtcaaaaggattacattacaaagtgtaaatcactctggtatccatggtgaagtttgaaattgacccacagatttttctcctctgggcaaaatcctaacacccctagtggccagctaattgagttactttatcagtacagagtgaatattagaaagcttggagaggcaactaggaaggaggcaaaggcatggttttattaatttactgattttttaagagagaaatgagccaatatatttaagctactctgtatttttcatactttatcgctgaaatcaaacagttgaatttcctttaggatattaccatacctattttcctaagctaaacatatttctacaccaatccatctgcttctcaaattaaaacgttaacacaaaccaagcctctgccaataagcaaccacatttgcaaacagactagatctacttcaaaaaacaaacttgaaatgataaatagtaagtactaaaattcttataaagccacaatttacttatcatatagcccttgtctaaaggaagtttctacattttaaatctagcttaatttttgaattgagttctggcatagagatcacatcaaacttcgtgaacgtgtgctcaagtaaggatattgaagatatctcacgtatatagcttcaaaaatgccagtgttgatacttttgatgagaaattatgtcttttgagccagctgcaaaagcatgagtgtcacagatgatacaataaaaaatatatagtcacatggaatgctttctttgtactacagagaatatttctagctattccatctcactatagaaaaaaaatctgctgaagatctagtggtaaaacactagatcttcaatgtgttgctcactttaatataattaagtagaaagtagtattacaaattgagtcataaaacatttatacagaaagaaaaaacaaggatgtcatgtggttattccctcttcccagtatagagaggagaaatctaaagctcaaagttcaatgacttgcataagaccacagagttggttttagccaagtgcctaaaccggatcccagaatgttgaacacatttatctttttagaagaggaagaagattaggtgttttgcttaaatgtctatataatgattttcagtccgaatcataaagaatcaatctacatatgttcaatattttaaaaacttccatgtattatacacatagaaccctacaagtctgtgcataactacatttgtactcttggtttttgctccacctaggcattcttccaagttgtgtcagagactaattttccttgacaatccattattccttctccctgtgaagtaacagaattgcctcctctgacacatgaattttagcagggtcatttagcttgaaactgcacttctgactttgttggtggctagattcggctgtttcactaggttgtagataattggatatgaacagaagtgatgtgttaaatttgtctgtaatattcttgaaataatgtacttgttcactgcttcctctttgccccactttggtcaggaatgtgtacctacagtccatgtgatctagtgtaataccctaattattggtggaactacaaaacagatgaaacctggtctccaaacaaactatgctgcagagctatttattcacactagattaccttcctatttctgtactgtattgtaggagtcagcttttgtgagtcactgtatttgtgggtctttttgttacatgggctcagccaatacccaatatgaatacactaactctaatctatccatttcaaaaagaaaactgattgccataaactatgcttaggtatccattccattatacagttgttttatgatctctacaggttaaagtagccactagttggtatacactttggagactgtaatagaatatataaaaaacttaattgtacttatttgcttataaacaagctagactgaaaactgctagagggcaggaagaatatcttaatcatatttgtttgcctaatgcttaacatggtagctgacacatggaaggtactcaaattacacatattgaatgaatgcatatttttccttgttggttccaaacagacatcaagaacttgcagtttattgtgttttaatattatttttattataatatggttaattgaaactattctcatatataataccaaaaaagcaatttttcttttttattatactttaagttttcaggtacatgtgcagaatgtgcaggtttgctacataggcatacatgtgccatagtggtttgctgcgcccatcaacctgtcatctacattaagtatttctcctaatgctatccttcccctagccccacaccccatgaaatccccagtgtgtgatgttctcatccatgtgtccatgtgttctcattgctcaactcccacttatgagtgaaaacatgcagtgtttggttttctcttctggtgttagtttgctgagaatgatggtttccagcttcatccatgtccctgcaaaggacaagaactcatccttttttatggctgcatagtattccatggtgtatatgtgccacattttctttatccagtctattattgatgggcatttgagttggttccaagtctttgctactgtgaacagtcccgcagtaaacatacacgtgtatgtgtctttatagtagcatgatttataatcctttgggtatatacccagtaatgggactgctgggacaaatggtgtttctagttctagatccttgaggaatcgccatagtgtctgccacaatggttgaactaatttacactcccaccaacagtgtaaatgcattcccgtttctccacatcctctccagcatctattgtttcctgactttataatggttgccattctaaccagtgtgagatgatatctcagtgtggtgttttttttttttttgcatttctttaatgaccagtgatgatgaacattttttcatatgattgttgactgcataaatgtcttcttttgagaagtgtctgttcatatccttcacccactttttgatggggttatttttttttcttgtaaatttgtttaagttctttgtagattctggatattagccctttttcagatggatagattgcaaacattttctcccattctgtaggttgcctgttcacactgatgatagtttcctttgctgtgcagaagctcctgttcactctgatggtagtttcttttgctgtgcagaagctctttagtttaattagatcccatttgtctcttttgggttttgttgccattgcttttggtgttttagtcattaagtctttgcccatgtgtatgtcctgaatggtattgcctagattttcttctagggtttttatggtttcaggtcttatgtttaaatctttaatctatcttgagttcatttttgtacaaggtgtaaggaagggatccagtttcagctttatgcatatggctagccagttttcccaacaccattcattaaatagggaatcctttccccattgcttgtttttgtcatatttgtcaaaaaacagatggttgtagatgtgtggtgttatttctgaggcccctgttctgttccattggtctatatatctgttttggtgccagtaccatgctgttttggttactgtacacttgtagtatagtttgaaacaggtggcatgatgcctccagctttgttcttttggattaggattgtcttggatatgagggctcttttttgcttccatattaaatataaagtagttttatccaattctgtgaagcaagtcaatgacagcttgttggggagagcattgaaactaaaaattactttgggcagtatggccattttcatgatattgattcttcctatccatgagcatggaatgtttttccatttgtgtcctctcttatttccttgagcagtggtttgtagttctccttgaagaggtcctttacatcccttgtaagttgtattcgtaggtattttattctctttgtagcaattgtgaatgggagttcactcatgatttggctctctgtttgtctgttaatggtgtataggaatgcttgtgatttttgcacattgattttgtatcccgagactttgctgaagttgcttatcagcttagggagattcagggctgagatgatggggttttctaaatatacaatcatgtcaactgcaaacagagacaatttgacttcctcttttcctaattgaataccatttatttctttctcttgcctgatcatcctggccagaacttccaatactatgttgaacatgagtggtgagagaaggcatccttgtcttgtaccagttttcaaagggaatgcttccagcttttgcccattcagtatgatattggttgtgggtttgacctaaatagctcttagtattttgagatacattccatcaatacctagtttattgagattttttagcatgaaatgctgttgaattttgtcaaaggccttttctgcatctattgagataatcatgtggtttttgtcattggttctgtttatgagatggattacatgtattgatttgcatattttgaaccaggcttgcatcctagggatgaagccaacttgatcttggtggataagctttttgatgtgttgctggattcagtttgccagtatttgattgaggattttcacatcgatgttcatcagggatattggcctgaaattttcctttcttgttgtgtctctgccaggttttggtatcaggatgatgctggcctcataaaatgagttgggaggattccctctttttctgttgtttggaatactttcagaaggaatggtactaactcctctttgtacctctggtagaattcggctgtgaatccatctggtcctggacttctttttgttggtaggctattaaatattgccttaatttcagaacttgttattggtctattcagggattcaacgtcttcctggtttagacttgggaggctgtatgtgtccaggaatttatccatttcttctagattttctagtttatttgcatagaggtgtttgatggtagtttgtatttttgtgggatcagtggtgatatcccctttaccattttttattgcatttattagcttcttctcttttttcttctttattagtctggctagtggtctattttgttgatcttttcaaaaaaccaccgcctggattaattgattttttgaagggttttttgtgtgtgtatctctttccattctgctctgatcttagttatttcttgtcttctgctagcttttgaatttgtttgctcttatttctccagttcttttaattgtgatggtagggtgtcgattttagatctttcctgctttctcttgtgggcatttagtgctataaatttccctccacacactgctttaaatttgtcccagagattctggtacgttgtgtctttgttttcattggtttcaaataacatctttatttctgctttcatttcgttatttacccagtagttattcagaagcaggttgtacagtttccatgtagatgtgcagttttgagtgagtttcttaatcctgagttctaatttgattacactgtggtctgagagactgtttgttatgatttccattcttttgcattggctgagttttttttttttttacttccaattacgtggtcaatgttagaataagtgtggtgtggtgtagtgctgagaagaatgtatattctgttgatttggggtagagagttctgtagatgtctattaggtctgcttgatccagagctgagttcaagtcctgcatatctttgttaattttctgtctcgttgacctgtccagtgtggacagtggggtgttaaattctcctactagtattgtgtgggagtctaagcctctttgtacgtctctaagaacttgctttatgaatctgggtgctcctgtattgggcgcatatatatttaggacagttagctcttcttgttgcattgatccctttgccattatataattcccttctttgtctcttggatctttgttggtttaaagtctgttttatcagagactaggattgtaacccctgctttttttgctttccatttgcttggtaaatattcctccatccttttattttgagcttatttgtgtctttgcatgtgaaatgggtctcctgaatacaacacaccgatgggtcttgactctatccaatttgcctgtctgtgtcttttaattggggcaattaccccatttacatttacaaacattacatttgatattgttatgtgtgaatttgatcctgtcattatgatgctagcttgttattttgcctgttaattgatgcagtttcttcatagcattgatggtctttacaatttggtatgtttttgcagtggctgctactgcttgttcctttcgatgtttactgcttccttcaggagctcttgaaaggcaggcctggtggtgacaaaatctctcagcatttgcttgtctgtaaaggattttatttctcctttgcttatgaagcttagtttggatggatatgtaattctgggttgaaaattcttttctttaagaatgttaaatattggcccccactctcttctggcttgtagggtttctgacaagagatctgctgttagtctgatgggcttctatttgtgggtaacccaacctttctctctgcctacccttaacttttttccttcatttcaacctttgtgaatctaatgattatgtgtcttggggtttgctcttctcaaggagtatctttgtcgtgttctctgtatttcctgaatttgaatgttggcctgccttgctaggctgtggaagttctcctggataatatcctgaagagtgttttccaacttggttccattctccccatcactttcaggtacatcaatcaaacgtacattttgccttttcacatagtcccatgtttcttggagtctttgttcatttcttttcattcttttttctctaatcttgtcttctcactttatttcattaagttgctcttcaatctctgatatcctttcttctgcttgatcgattcagctattgatacttgtatatgcttcacaaagttctcgtgttgtgttttcagctccatcaggtcatttttttattttttattatttttatttttattatttatttatttatttgagacagaatcttgctctgtcacccaggctggagtgcagtggcacgatctcggctcactgcaagctccacctcccgggtttacaccattctcttgcatcagccttctgaatagctgggactacaggcgcccaccaccacacccagccaattttttgtatttttagtagagacggggtttcactgtgttagccaggatggtctcgagctcctgaccttgtgatccacccacctcagcctcccaaagtgctgggattacaggtgtgagccaccgcgcccagcccatcaggtcatttatgctcttctctatactggttattctagttagcaatcgtctaaccttttttcaaggttcttagcttccttgcattgggttagaacatgctcctctagctcagaagagtttgttattacccaccttctgaagcctacttctgtcaattcatcaaactcattctccatccagtcttgttcctttgctggcgaggagttgtgatccttcgaaggagaagaggcgttctggtttttggagttttcagccttattgcactggtttcgccccatcttcgtggatttatctacctttggtctttgatgttggtgacctttggatggggtctgtgagtggatgtcctttattgttgatgttgctactattcctttctgtttgctagttttccttctaaaataaggctgctgttctgcaggtctgctggattttgctggagctttgctccagaccctgtttgcctgggtatcactggtggaggctgcagaacagcaaagattgctggatgttccttactctggaagcttcgtcctagaggggcacccccccagatgccagccatagctctcctgtatgaggtgtctgttggcccctgctgggaggtgtctcctagtcaggatacacgggggtcagggacccacttgaggaagcagcctgtcccttatcagagctcgaacgctgtgctgggagatctgctactctcttcagagctgtcaggcagggatgtgtaagtctgctgaagctatgcccacagccgccccttcccccaggtgctctgtcccagggaaatgggggttttatctataagtccctgactgggcttcctgcaattttttttttttttttccagagatgccctgcccagagaggaggaaatctagagaggcagtctggctgccgcggccttacggagctgtggtgggctccacccagttcaaacttcctggtggctttgtttacactgtgaggggaaaaccacctactcaagcctcagcaatggcagacacccctccccaccatgttggagcctcccagttcaacttcagactgctgtgctagtagcgaaaatttcaagcctgtggatcttagcttactgggctccgtgggggtgggacccactgagccaggtactggagggaatctcttgttctgtcagttgtgaagactgtgtgaaaagtgcagtatctgggctagagtgcactgttcctgctagtacagtctctcatggcttcccttggccaggaaagggaaatccccctaccccttgtgcttccagggtgatgcgatgccccactctgcttcagcttgccctccatgggctgcacccactgtccaaccagtctcaatgaaatgaacctggtacctcagttggaaatgcagaaatcactcgccttctgtgccaatcttgctgggacctgcagactggagctgttcctatttggccatcttgccaacaagtccaaaaaggcaatttttctatataaacctgggaaaacatgactcttccaaagtaatcaagatactaaatcacctgctatttaattggagatcttgtatagtatatcagatttagtaccttctttggtaaattgaaggctgttattgccacattcttcctaaagcagaactacccttcaatttattttcagttaattggttataattattttgtaatattgtcttcttaaaatgaattttcctttctaatttctggtaggaagactactatgtggttgatgtatgagaaaggtaaatcataggaactgatgatatcaacaatcagaaaatattgctagaagacactattcaaaaaatctgagcataaaaataaaactagttattaaaaaacaaattatttacctggaaagagaggagcaaataagaacagtattttttagtgcaattagcaaagtatgattatgcatagaccaggcagaagtaagatgaaatattcggcatagcagcaaagtttttgcatgacatgtagaacacatttaatcctggacagtatataaagcagaaatgctttgtaaaactatataatgaagtgcaactcttagcagctgcccttgtaaatctctagagaggaggctgactaaaggctaggttcagtagttgtccctgttccagttgaatgatctttaaatttgatccctaaatcacagtagcacctaggaaaaagtatgcatttgacacagatttcttttctgtaggagagtcaaaaagacaaaaacaaaaacaaacaacaacaacaacaaaaaaaacaaaggctaagagagatgctgtataaaaaaagagcttgcttatgtcatctaaaatcttataagcaccatgcatttgtcttcaagaattaaacccttggggccaagtctatgcaggagatgcctaatatcaagaaaactagctattggagtataccaataaattcataaattaacataagaatttaagtgactcctgagattggccagtggaaaaggtaattactgccagaaatttatatgttgaaaaggggattaggtgttgaatttggttcttccttgttctccactaactcttaggcccatagtgaccatacgttctgttttttcacaggacagtctttatttaactgagacttgattgttaatttttattctcaaaatcatttcagtttggataacgagttatatatgttcattcccttgaagactaagtctcttaattctatttcctaaacatctcttgaacctgtccacttctgccaactccattctcctcacacttttatcttttacaaggactactgcagaaatcttatatcttctattcttgctcctctcaagttcattttgcacaatactgcagggagtcttttaaaaacagaattatgatacttcccttcttaaaatctttcccatgttctcctttgtgtctaggcggataaagacctgcatgatctgggcacccccctgcccctccaaccccatcttatgccatcctctcttttctcttttcttttctaatttcttgaccatactagatttcgtagagtcctctcagctatctcagagctttcacatatgttctttctagcacagacttcttcttcctaacttctttcttccagtcttattcttattaatctttttgatgtcagtttaaatgccacttctttcagagacaacctcatagattttcaaagactaggcaagtctgctcctacaataatgacaataatgcacaattcttcataatacccagacagagaatttcaaaatgtaaatttatatgccccactaggttacaagtttcagaaaaaaagggactatattttatctcgcttgtcacttgtttgtcattttaccttgttgccaccttatcatacactgaacgttcaacagctttttgttgaaataataaccaaaaagagagttaccatcttaggcatctaaatatgatcaaatgtgcctatgtagccctgactttaaacaccatctttaaatacatgctgcaaatattttataataaacataatattctattttattcttcttcataattgaacccacagtgaattaactttagtccaataggcatcagataaaggtaaaggatacatgcttttttacacatctaattatttcatttttatctcaattatgttgaccttatgcaattgacatttcattcaaaagttattcttaatgttttctcttctctgctttctattcatttgtaagatgaggagaaatgtaataaaatactcaagtatttaagcaaaaattgatgtgtaaagatgtttactcagctcaaatggttggctgaaaggaagtactatgatacaatagctagaaatatttgtcaactgaagcatgaaaagttgaattaagtatgtgaaaatcaatgtgaggatatttgctcttacatacattacacactttctgatcaatacatgttgtcggaaagtcaaacatgcatgatgggaaagccaaacaggaaatctgaggactatttgcagtataattcagttaatatttaggatctatctctgttagggtgaattcagctacgatatagagacatccaactaactgtggcttaattaatgaagatatttaattatcttacataacaagaactctgaaggttggtacttccagagtttggtataatggttcaaatatttcatgagaaactaaatctttctgtcttgttctttcattctaatatttttctataggtttttaccttatggatgtaagatggctgcttcagctccaattgtcaaatcctcccacaaccacactcatggaaagaactatgtagcaggggaaaaacaaccttctcttctcgatcttctctctttttattcagtaaatcagtctttttcagaagccactcagatgatttcccattatgtcttattgaccagagctggatcacatgttcactcctggatgtattactaacagaggggaatgaaatttccatgaatgccttagagcaatcatgatttgtctcccaggatgaaggaactcttaccttccatgagaacaaagaatctcatgttaccacatgagttggagtcagcttgtgggtaggcaacactatttgccatagaaacctgtcagtcaggattgtatcagattcctctgatttagaaaaacaaaataatagtagtgaatataattatatcattaggctgggagtggtggctcacatctgtaatcccaacactttgggaggctgatgtgggcagatcgtttgagcccaggagttcaagaccagcctgggcaacatggcaagaccccatctctacaaaaaatatataaaaattagccatgcatggtggtgtgtgcctgtagtcccagctactcaggatgctgaggtggggagtatgacttgaacccaggaagtggaggttgcagtgagctgagatcacgccactgcactccagccttggtggagccagactctctttcaataataatatcattaaaaatcttgcctctaaacattctaataaaaaggagtttcagggaaaacacaactatttctaaaacaggaagggataagttgtaaacaacaccacataaattgttaaaatatcaattccattttggaaaatacaaatatctgggcagttttagagactcaaataatatgatactttaaaaaaaatctgtatccagagccacttacatcaatgcttacagcaaatacatactaattggctaaagattttatttagctccatggtttttataatctcgttatacttaagggtggacaaaagacaagcaaaaatatggagcaacctttcatactcaaactttggcttccactccacctgcaattatattctcaactttatggtgcatcaaactcactgacataaaagccatctcaaatcacttcaaactttccattgcatcctagagatatattggctctgaaccaagtacctaggtactaactagtttagttttaatttagagcagatggactggggttctcaaggttgcattgagaggatctacttggaggacacctcgtggtctctgtaacacagcagatggtgaaaatattttaaggctattttcaaatgatgttagcaaaactacatttccatcaattgtcttatatggctttcataaatatgatttttcttccaaatcaagaatgacaatgatagagcttagcagggttcttttgagatgtcattatcaacaatgacacacagaggatttatattcaaagttcaaagatgaactgaaagcaagaaaacattgtatctcatgagataaatagatattgataaatgatgttataatgcatatcccgttttcctgtatgagaggaaataatttctatctcctgttatagtagacttttcaactgatgtttctttttggaagataagcaaaatataattcttttcgacccctaaagaactaacaatgtagacatactgtagatgtcccataagttattctttcttctttttaatgtaaattttatttttaaaggtaaaatattgtggtggacatttgccatttggagcaataccaggcatctacttcttccattctaaatttctctggggaaattaatttattcctattgcctgatatctgttagaagggcaattcctggttactacatcccaaaatgaaaagcagaaaatggaaaattctcagattctttacttttcctaaaatgccagggactgggatatggtataagctgggctaataataccatttatttggggattttgaatcttgagtgacacaagggtgagaagaaatataaagctcatttgttacagcagcagaggcagaagaggtgattctgtccaaattaaaacatttactgaaggtgattttgtcctaatttttgtactgtggttcctatttcctagcccccatctgattcttggttctgaacaaatcccaagctagctttcactattcttttaagaaattcccttttttgggccggcgcggtggctcacgcctgtaatcccagcactttggaaggccgaggcgggcggatcacgaggtcaggaaatcgataccatcctggctaacatggtgaaaccccgtctctaataaaatacaaaaaaaaaaattagccaggcgtggtggcgggcgcctgtagtcccagctaagtagtcccagctactcaggaggcggaggcaggagaatggtgtgaacctggccggtggagcttgcagtgagccgagattgtgccactgcactccagcctgggcaacagagcgagactgcctctcaaaaaaaaaaaaaaaaaaaaataaataaataaataaattcccttttgcttaactagagttggcttggattatttataataaaaatggaaaaatacagagaagcaaaattagataatggaagtatccataatatattttgtagccttgttttcattattattttccgtgattaataaataatatatgttgcagaaaataaattttaatggttacctagcatatatttacatggatgtactgtatagtacactatagtctaatcagtgctagatatttacgtttcttactattgtaaataattatctattagcatcttatgtgaacgtcattgcatatagtttttatttttttcccttagaatacatttctaaaagtgaaattgttgggacaaaatgtagtatcaattttgaagctttgaattatacagaatttaccccacaaggaagactgcacctacttatactccagcagcaatgtatgaagatgtattctgataagaccttatctataagttccattgtaagacggaggatgggagaacataaatctattcaactttacttgcccaaatagacagtttagaaagcaatcagcctttcatgtgaagaggcccatggaataaaggggaagagttacaacagcactcaatgcatgtctcaggctatttaagtgttctccacagagttcttagtacaactgaatacaaaccgattccataggtggttttttttttaggtgaatggatactgcctaggttctcatagtgagttaggaagaaaaaatggaaagaatcaaataaatcccagctagctttcataacagctactcctcagttaactgaccctacactccaggctcaggaatgaaaggatttcttatctaccaaaggtatatttacacaaaaggcactgctaaaatccattctaaagttggaatgtctagaaagagactgaaaatcacaaagtctactcttggctcacaatactttctctaggttgttgtataaaaataacatggcattttccttagttacctgacatttattttaactcatatgcaatgcaataaaagaggctatctagctaggtctgtgctccaacaacagtatcttggtaattggaagtcaatgagagccaatttttataatttaactactataaaccaaggaaatacaccaataaacacatttttaaaaacttattgtatttgtcatcaactcaatgggtacgttagcccatgtgtatgtgtgagtttgcgtgcatataaatgtgtgtatgtgcgtgtagtctgaataaatccaagggccccaagtggtccaagctcagtgaggttttaaattcatggaatcacagttaatgcaggaagaaaataattaaaatacttccattctttactcaatctttcatagataaatacatttttaatgcacagctagtatcttgagaattcttttctccctaccctaattttctttacatagcagctgttccctaattcatttctcccaatctcaattccccattgtccaaaattcagcttttcttcctctctcaccccctcctcatttctcagctgtttataatataaaatcactcagtacctctaacatctcaaatatttcctctgcttaaaatattatctgattgtgcataactaatgtgcatccaagtgctgtcatggtaagcacctagaatctgggggaagaaggtgaatattgtaacaattcaaatattcattgttttaattctaatgatactttcatatttttctgtgacatattcatatacagtttaagaggaaacagcttcacaagtggtcgataaggtgttctatgtcaatattaaaggtttctggtctaattgctacacatgtattctccaagggaagaggaacatttaaacaaggccttaaaaacagaaaatttgattttgtatttgaagagaagacaaaagaagatagtgctttcaggctctaatagatttattagttagtgccttaagtagctatggctatttctatttttttcaaaaaggaaacttaccctggcaagatagaaatggttgaggtactcacatatctagacatgaaactagaaaacctgactatcaatagaattctcatagattcaaaaatttctaaatagccctaagaattcctctagtaacataactatagatactgacactttttgactataaatttacattactttatttctaaagtcattatctgtgttgtacagaacacagaaatgtatgctcgttaaaaaaatggtgcaatcctctgggtaaaataatttcacaatgtattattggtatattattggtacctaaggctttagtcttctcctttaaaaatagtgaggtactaacataattatgttttggaaggagaaaagagtaagagattgccagcactaatgatttatcaacagagttcatttttttgcaatttaatgttagctgtagactgagatctcagacactatttcatttctctcataattacttaacctatttgactgcttcaaatgttcacagtgacccttccttaatgttcatttctattatatgaggcatctgtttagatgcatacgctgaattaatgtttttatacattccaaatttatattgatatcataaaagactcggtattaatgaaattcatttttcgacagtccaaaatgaaatgtacaatcaatgacacaatgtttctctagggagcaataaaactaaatgtagttaaagtatactgggcagctcactgtgtttttgaataagggtcaataaattatatatattctctgcatccaactgctggcctcagtagctgcttaacgaccaggtaaaataaataattacttagtcctactcagacataataatatctgctagaagcaccaaattattggttgtgaagaaaaatgttttaaatagtgtttaaaggctttcttttggcttttaattcaaactaatatatcatcaagtatgtacagaatatcttctctgtgcaatatgcctcattatacagaaaagataggagtgctcctatcttcaaagctcttatattctaatgggtgtggagagtaaggagttgatgcatatagtgcaaaacgtcgctattacataagacaggtacaaagcactctagagtcatttctttcactcttaatatctaacccttcaaaagtcaaaagtccttttgattttctcctaaatctctcaaatctgtcaactgctctctatcagttaccacactggtccacgctgtgtcatctcctatttggtctctagagtagtctcctaatgatcattcccacattcactatcactccactaaaatccattgtccacagcagccgaagaaacttttccaaactgcatctgatcctgtccccagcccatcctccccaaaacacacagttcctatatggtttcccattgttcttaggatagaaatcaaggtcctaaacccggccgcacagatatgaccctgcctactctatcacccacccaacccctgacttacatgcccaatttgacagtgtacacaagggccttctcacagtgctcttatgtatcaatctccttctaatcattggatggggccaccagcctgggacactcttactcctaccctgtctctgcttaaattaactaatgtctatttatctccatctcagttcaaaggtcatttcctaagaacccatggcacgcaagaattcaaccaggttcctttgtcacaaattctcctaggagggattttatttgctcactttgcagtgtttatttatgccttcatatatttaaatactcaattattgtctatctcccttgccaaagtgtatgctccataaagcaagaacagtattggctttggttacctatacatcatcactagcatatgcattgcacatggaaatttctcagttagtacttgttgaataaatgaacaaataagcttggggagggaaacaccagttgtaaatgtggggctcagtaataaaaataaaattcttgctagtctatgttaactaacaattatcttggatatgaactgttaagaaaataaacaagctaagagtgcaattaacaaatattctcaaaatagtcgtttagggtgctgtttcttcctctcctgtccccagtatcaagaggggataatattcttatgtaactcatatcagaactttttccatatgggatgacactggtttatgaaaggaaaaaatggagctttcagacatagacccttcataaaagccactttaaaacactgaaacaattacatttgatgcctcaaaagtaacactattttagctgttggtcctactttttggctattatgaataacgttgctatgaacattcatgtgtaagttttctgttgacatacattttcatttctctctaggagtggaattaccgagtcatagggtaactttccttggtaaaatgactatccaaatgtttgctcatttgttaattgagttacatgtctttttattgttgagttgtatgaagtctttatatattctgaataccactccattaccagatatatgatttgcacatattttcttccatcacatgagttccctctttaccttcttgataatgttctttaaggcacaatagttttaattttgatgaaatcatgtatatctatcttttctttagtcacttgtgcttttggtgtgatatctaagaaagcattgcctaatccaaggtcataaagatttacacctatgtttccatttaagtgttttagagttttagctcttccatttaagatttatgatacatttttagtttatatttgtacatggctggaggaagggatctaacttcattctctggcatgtggatacacagttgtcccagaaccacttgttgagaaggttattcatttccccattgaattatcttggcattcttgtcaaaaatcaattgaccacatgtgtatgcatttatttctggaccccaaattctgtttaactgttctatatgtctgtccttttgccattgccacagtgtttaaataagttatgaaattggaatttataagctctgctactttatttttacttttcaagttggttttggttattcagggacccctgagattccatgtgtatcttaggatcagtttttacaattctgcataaaagactgttgagattttgatagtgattttattgaatctgtagatcccttgggggttggggggtattgcctcttaacaatataagtcttctaatccatgctcacaggctgtctttctagttatttaggtcttcttttactttttttcagcaatgttttgttttgtacattttggttaaatttactcaagtatttttacctgatgctattataaataaaattgttttaatttgctttttcaattgttcattgattatatataaaaatacaaatgattttttgtatattgatcttctgcttgctgaattcacttgttatttctaatcatgtgtttgtgtgtgtgtattcctcaggattttcaagataaaagttcatgtaatctgttaatagagagagatttacttctttctttccaacctagatgctatttatttttcatttagcttaaatgctcttgctgggctctccagtataatgtaaaatagaagtggtatgagcatacatatttgtcttgttactgatttaaggggaaaacactagtttttcaccaataagtatgatgttattttttttttttttttcatagatgggctttattaggttgagggtattctcttctatttctactttgtttacagttgggacattagatggtgttagattttgtgcaatgctttttctacatatattgaaaatattatcttgtgttttgttttttattaatgtagggcattccatggatttgattaattttcctgtgttaaaccaaccttgtattcttgggataaatcccacttggtcatgatgctttttatatgttgtgggattaaatttgctagtattttctgagatgttttgttcatattcataagggatatttatctgtaattttctttattttttatgtatttgttgggttattataccagagtaatagcctcagaaaataacttggacagttttgcctcctcttccatttttaagaagaatttgtgaatgactggtgttaattcttctttaaaagcttggtggaatttatctgtggaaacatctgggcctgcaattctctttttggggagttttgtgatttttaataattcagtctatttactcattaatagtattcatattttctatgttttcttgagtgattctgggaagatatgtctttctagaaatgtgtccattttatttgattatataattcattaacacactattgttcattcccttataatctttttatatctttgagtttggtaatgacactccctttttaactcttgattttattaatttgagtcttctttcttagtcagtttacttaaaagttagcaaatttggttaatcttttcaaagaatcaattttttggtgtacttgatctctattgtttttctattatccattttacttatttgcactctaatgttcattagttcctttcttatgattgctttgagttcaatttgttcctttttctagttttataaggtagaagattaggttattgatttgagttctattttattttcaaatatgtttatagctacagatttctctctattcaccactttagctgaatctcatgcatttcagtatgttctgttttcaatttaactgtttttgaaggattttataatttcctttctgatttcttttttgactcactaattgtttaggtttgtgttgtttaattgccattgcatagttgtagattttccaaattttcctctattaatcatttataattttattccattgtatttaagaaaatatgttaaatgacttcagtttttcaatgtttactgatacttgttttgtggcctaacttcacaaagaaggttccatgtgccctgcaaagaatgtggattctagtgctattttctgacatgtttatagatgtctgttaggtttatttgatttataatgatagtgagtcattctgtatccttgctgatcttctactaagttatgtccatttttgaaaatgaatatttgagtctccaactaatactgttgaattcttattctgatttttgtttatctgaaatatcttaatttatcctctattttgaaaagatagtgttgaattttttaatttaaattttgaattcttgatagaatttttctttcagaacactaaacatttcttctcattacctcttgagcttcatgattttcgataagactcatctgttgatgttatcgagaactcacattgtttgtatgtgatgagtttcttcactcttgctgctttcaaattatttatatttggctttaaacagtttgggaatttttagttcattatttcttcaaatattttttctgttcttttctcctttctctctttttgaattttcattgtgagtacattgctatgcttgatgattttccacagttttctaagtctctgtacagtttttcattattttctctttctgttgctcagactgaaaattctcaatgtatctgtcttgaagttaactagttctttcttctgctagttcaaatctgctactgagcccctctctaaactttgtattatggttattgtatttttgatcttgagaatatatttttgactcttttttctaaaattcatatatttttattattatcttctgtttgtcaagacattatttttgtaatttctttaattctttagatatggtttcctttggttctttggacatatttataacagctggtttaaagctgttgtctagtaagtccaatatctgtgcttcatcaggaacagtttctgttgactgaattttactctgtttgggccatgctttcctatttttttgcataaataataatttattgttgaaaattggatattcaaaataatataatgcaccaactctagaagtcattcttcctcctctgcagagtttgttcttgtttggtgttgttgttagttcattgagtatctttcctggactagtttgtttagtatctttcttggacttatttaaagtctttatgctttgttgtgtatggctgctaacgactctgatcagtcagcctaattgtcggccaatgcttggacacagatttccttacattctttgaatcactaagtttcccagccttccatgagggcctttttgtataaactgtgcacacattaaatgatatggcaggcagtttacaactgccttagccttcatgtgctacttacacagagcctaaggtgtagcaagagatgagaaattagggttttctcacatcttttctgggcacatgcacaattcttcatatgcatgtggcttccaagactcccatttatatattggagtattcgaaaacctcctacaaatatcacattccaaagtttttccttttagattgtttttagcctgtctctcattatctctatttggtgatgccccctcaggcagctgtgatactaaacaattgttagtgattgttttcagcaaatttccctaaggatgggacagactgaactccaagtcaggtcaaattttaaaagtcctgacaatggagttttttaggaagcttcctgataggtcaaattatgacagttctctgaggacaaggttttgggaaagctccaaaccaattctgtccctctaccatgaatgctaagatgctcattttcacagttactatagttgtgaagctgataatattcaagcatatcatgcagatctcagaaaacagatataggaagaattagggaatgttaaaatggcacaaaactcactgttctctctggaattcagccatgtttcctggataaatactcctcaaattgctgtaagttttactagttctgaaaaagttgattttgacatttttatttatttatttttttgccagtgttctcatagtttaatggaggattggatttttggtggttcttactctgccattctgaaaatgtgatctcgctttcttattgttgttgttttctaaatttattctcattttggtgaacaaaatgaaaaaatcttcccaattgaaaacactgagaataaaaatatttctttaaaatgtaggtaattataaaactttttatgaaacaataagagtatgcatttttaagtatgtaaaagattctattagcaagtttatttagctgctgctagataaggggaagggtgtgggaatttctaagaggtgcagacattttagtccacatttctcttagttgaactcctccattatataaatattaatatttattaaggcacttgacaagtatctgaggactagaaataaaagagttatttgttaataaagaaaattaatcagatatactctaccatttccctcagagttctttgttaataaagaaaattaatcagatatactctaccatttcccttcataaataaaaagaaaagaaaaataattacttgattccaaggaatttgcaatttcagaatagtttcctcaatagacagcagttcaataaaaaatctaagaactttgacagaatattcaagagtgaaaggctgcattcaaattaaatatattcatttagagtcaaattctgagacatccttactgataaaatggaaggttgctttccttctgtctgcatagataaatattggatgagttctgattgttcatccatgaaggaataagatgtttttaagatttcttaaaatcattcctgtagtcaccattcaccattaacatagattcagtgttatacattgaaggctttgcaatgtttacataagtattttataatgaatataaaattataaacataagtttatggagcatttaacaaatgtttagttgaggcttttataatgagtcagtgtaaggcagttaatagatactcatgtgttatatgttactcaagtgattaaaagtggaagattctaggaattttatggttttaggtcctacgtttaagtatttaattcatcttgagttaatttttgtataaggtgtaaggaaggggtccagtttcagttttctgcaaacagctagccagttttcccaacaccatttattaaatagggaatcctttccccattgcttgtttttgtcaggtttgtcaaagatcagatggttgtagatgtgtggtgttatttctgaggcctctgttatgttccattggtctatatatctgttttggtaccagtgccatgctgttttggttactgtacacttgtagtatagtttgaagtccagtagcgtgatgcctccagctttgttcttttggattaggattatttttactatgcagccttattggttccatactaaatgtaaagtagttttctccagttctgtgaagaaagtcattggtagcttgatagggatagcattgaaactataaattactttgggcagtatggccattttcatgatattgattcttcctatccatgagcatggaatgtttttccatttgtttgtatcctctcttatttccttgagcaatagttagtagttctccttgacgaactacaaccccttgaagaggaccttcatatcccttgtaagttgtattcctaggtattttattctctttgtagtaattgtgaatgggaattcactcatgatttggccctctgtttgtctgttaatggtgtataggaatgcttgtgatttttgcacattgattttgtatcctgagaatttactgaagttgcttatcagcatagggagatttggggctgagattatgggattttctaaatatacaatcatgtcatctgcaaacagagacaatttgacttcctcttttcctatttgaatactttatttctttctcttgcctgattgccctggccagaacgtccaataatatgttgaataggagtgatgagagagggcatccttgtcttgtgctggttttcaaagagaatacttccagcttttgcctattcagtatgatattggctgtgggtttgtcataaatagctcttattattttgagatatgttccatcagtacctagtttattgagagttttcagcatgaagtggtgttaaattttgttgaaggccttttctgcatgtattgagataatcatgtgttttttgtcattggtcctgtttatgtgatggattatgtttattgatttgtgtatattgaaccagccttgcatttctgggaaaactcaagcaataccattcaggacataggcatgggcaaagacttcatgactgaaacatcaaaagcaatggcaacaaaagccaaagttgacaaaggggatataattaaactaaagagtttctctaaagaaaaagaaactcgcatcagagtgagcaggcaacctacagaatgggagaaaaaaattttccaatctatccatctgacagaatctaatgtatccagaatctacaaagaacttaaacaagtttacaagaaaaagacaaacaaccccatcaaaaaaatgggcaaaggatatgaacagacacttctcagaagacgacatttatgcagccaacaaacatatgaaaaaaagctcataatcactggtaattagagaaatgcaaatcaaaaccacaatgaggtaccatctcacaccagttaaaatggtgatcattagaaagtcaggaaacaacagatgctggagaggatggagagaaatatgaacgtttttacactggtagtaggagtgcaaattagttcaaccattgtggaagacagtgtggtgattcctcaaggatctagaaccagaaataccatttgacctagcaatcccattactgggtatatacccaaaagattataaatcatgctactataaagacacatgcacacgtatctttattgcagcactgtttacaatagcaaagactttgaaccgacccaaatgtccatcaaaaaaaaagactggataaagaaaatgtggcacatatacaccatggaatactatgcaaccaaataaaaggatgagttcatgtcttttgcaggaacatggatgaagctggaaaccctcattctcagcaaactaaccctcattctcagcaaactaaaccctcattctcagcaaacgaacacagaaaaacaaccactccatgttctcatacataagtgggagctgaacaatgagaacacatggtcacagggaagggaacatcacacactggggcctgtcagaaggtgaggggctagaggagggacagcattaggagaaatacctaatgtagatgatgggttgatgtgtgcaggaaaccaccatggcacgtgtatacctatgtaaggtatacctatacatgtgcacattctgcacatgtatcccagaacttaaagtataataaaaaaaaagaaaattacatctacataaaaaaattaaaaaatagaagatttttatgccagagaatcaattgcattttcccctttaagaaaactgtatttatttaatattacttaaaacaactcaaatttatagctgatatttttcatgttcaatctattcagtattttgtctattatgcaaaaggaataattaattatgtaattgcataggtaatacctacagctgttaataatattctattattaataatagataactattttctttctcctcacaaaattatttaacctggatttatattcttttatttcatctgtattttacttgatttttataaaaatgtctctccataatataatataccataatttgtaactggaaataatgggtagtgacactattcttcaaccatttaagaaaagatggatcctgaggaatgtcatatagttagtttataatgtaataatttcttgactgatgaaacatcccacagaatattagctgatttgcttagaacattttcttaaagctttcatagacatgagacaaggaaatctgaattcgtagctcatgcgacatgtatacacaaaggaatgaattaaattaagtacacgcaacctaaatttaaaatcatttgtggttagacaggaaattacagctatcatttgtggttagacaggaaattacagctgatagatgacaatgccataattgtgtgtttaagccttctgtcacagaaataaaaactttcttctttatttgagaaagaatttaaacctacatagtgagttatatccatggtatctgtggaccacatcaaaattgtattgaaggtgaattctgatagtgtattaaatattgggtgaatttcatccctcacactatgaccacttccgtgatttatcacacactgttcccacaacagtgtacagctcagcacctagtttgtcttcttactgcagttccattatggtattaagatttaagagcctttttttttcctttataaaactcttagatcttcctttttcattacaccttagtgctgcgaagtttaaaagatattattacctcttatcttcttctcctaggttctcttattcagcatttattcacagtggaccacatttgctaactcttatccttggttctcagagtttccaagatttttcagtgttgattacgttgtctctcaagctccttatgactgaaagtaaattcctcttgaagcttgttgccctcccaccccaccaacagaaagaataaagcagtcttcccctaaaagaaatctcacatttcaatagtctatgaaacgtcacaccaagcatcataactctttcagagaaatattttcgatacaaacacaattcatctaaaacagaatttttgtattggcaagattttaaccattgatgcatattatttctgaggctaagcaaactgaacaatcaggaattattatactgttactaatgcataacatagaattgatttcttactataagcagttgtgataacaggaattagcctttaaaagatactagatttaataggttaaatagataatgggatattatgttttaaatactattttacacatctttctttaaaaaaagtctcttagaatcctgtaaactagaggtaggaaaatgttttctgccaagggctaaacagtaagtccttcaggttttgagagccatatggtctctgtggtagccactgaactctgccactgtagcagccatggacgatacacagatgaatggacatggctatgttccaataaaactttatttatgaacaccaaatttgaatgttacgtaattttttatgtcacaatacagtattcttcttttgaaattttccaaccatttaaaaatgtgaaaaccacagtcagtgcatgggccacagaaaaacaagcagaaggccatatttgactcatggaccatagtttgctgattctgttgtaaaccatggtactaaattttatttccttagtagcctttgatacatgctatacactatgctaaccagaagaaaaagaagctcattcatgattcactaggaggaatgaaattttactggatttttcagaagttccacattttttgttaacatacattgcatttctctcagtaataaaagaggaaagaaaaagtcagattctaagctattatgaaattcagctaagcgtttaatctaataatgcaagttaaaatttttagtgtagttaaataattgaggtttggctccaacagggctttgttggattgatttactaattggtatgccctgtgaagttcctaaaacatattcattttcagaacatctgacataactataatgtatctgtcatcagttccaaggataaagttcttgaataatcctatgattttgatattaaaaaccttgagttccaatgggaaaaataggtttgaaagaccaaacaaacctatagaaatgattaagtttttaacttggccccagataaatcaatagcaatatcaacaacaacaaaagacataccaatgctatttaggcatcttaaatgggttgttatgaattgagggctattaacttccatatacaatttatttctaggaaatctttcagaatttccccaatctctaattttaaccagatgcttatgaacaaattttaggttgctacagatagtacataaaccaataattattttctttttggctttgtatacaaattctcagtgcatttctgattttaaatcagaaggtcatgtctgattcctaaggcctatgtatacccagccttatttttatctcttttcaggctaggcatcactacatcaacccctaatgtcttcagccactcctcttacctccttttctaaccttttccagtctctttttgtagttttctgtatcaagtgtgacccacaatttacttacattaaaaacaaaactttcacagttgacttcaagttacatagaaataaatttatgaatacagaaaactcatagttggcaaaagattattatgtctttagatcaggtattataaataatttttttagttaaatgtttgaggtgctctaaccctaagattttataaatgaggcaactaaggccctgttccttcaatggcttattctggaattgacataaaatatacagagctgattatcagctctattaaaaaaaaaaaaagaatgactcatgctgggagaagctcagttctgagaaactgagtcctaggctcagagtaactagcagtaatacccagaggcacaatgtcagaagcattcaaaaagaagacctatctgatgcagaacccaaaataaagagtgaaattctttagcatatatacaggtatacctcagagatattgtgggttcagatccagaccaccacaataaagcaaatattgcaataaagtaagtcacataacttttttgtttcccagtgtatataaaagttatatctacaccacattgtagtttattaagtgtgcaatagcatcatgtctttaaaatgtacttactttaattagaaatactttattgctaaaaaatgcaatcatctgagccttcagcaagccacaatcttcttgctggttagagagtcttgcctcaacttccatggctgataagggtggtggttgctcaaggtttgggtgctgtggcaatttctttttctttctctttctctttctctttctttttcttttcttttcttttttttttttttttttagatggagttttgttcttgttgcccaggctggagtgcaatggcatggtctcagctcactgcaacctctgccttctgggttcaagtgattctcccacctcagcttcccaaatagctgggactacaggtgcctgccaacacacccagctaatttttgtatttttagtagagacgaggtttcaccaagttggccaggatggtctcaaactcctgacctcaggtgacccgcctgcctcagcctcccaaagtgctggagttacaggtgtgagccacctcacctggcccagcaatttcttaaaataagaaacaaatttagcatatcaatggactctttctttcacaagatttctctgtagcatgtgatgaaatttgatagttcccacagaacttctttcaaaattgaagtaaatcctttcaaaccctgctgctgctttatcaactaagtttttgaaatattctaaatcctttgctgtcatttcaaaaatgttcacagcatcttcagcagtagaatccatctcaagaagccactttctttgcttttcaataagaagcaactcttccttcattgaagttttatcatgagattgcagcaagcagtcacatcttcagtctccacttctaattctagttattttgctatttctaccccatttgcagttatttatttcactgaagtcttaaaccattcaaagccatccatgagggttggaatcaacttcttctgaactgttaatgtcaatatttggagctcctcccatgaattatgaatgttgttaataacatttagagtggtgaaacctctccagaaggttttcaatttactttgcccaggtccattaatggaaacagtgtctatggaagctatagccttatgagatgtatttcttaaataacaagatgtggaagttaatattactccttgatccatgggctacagaatagatgttatgttagctggcatgaaaacccattaatctccttgtacatctctacaagaggttttgggtgacaaggtgtattgtcaatgagcaataatattttgaaaggaatctttttctgaacagtgggtctcaacagtgggcttcaaatattcagtacccatgttgtaaacaggtgtgttgtcatctaggctttgtttttcaatttatggaacatgggtagaatagatttagcatgattcttaagggccccagaatttttggaatggcagatgagcactagcttcaatttgaagtcatcagctgcattagcccctaataagacagtcagtctggccttagaatctttgaagccaggcattgaattccctctagataggaaagtcctagacggcatcctgttcaaatagaaagctattttgcctacattaaaaatctgttgtttgggtagctaccctcatcaattatcttagctagatcttctggatagcctctgcgaacttccaacttttcatctgcagcttccttacctctctcagccttcatagaattgaagagagttagggtttgctctggattaacctttgacacaagacagtgcggtggcttgtttgacaatctgtccagatcattccaaatttctctatatcagcaataaggttgtgttgctttatcattcctatgttcactggagtcgcacttttaattagcttcaataacttttcctttgcatccacaacttggctaactgtttgatgcaagcggactagcttttggcctaccttggcttttgacaagccttcctcactaagcctaatcatttctagtttttgatttaaagtaagagacatgtgactcttcctttcacttgaaaattacaggctattgtaggcttacttattggcctagtttcaatattattgtgtctcagggactaggagggcccaacaagagtgagataaagatggagaagagccagtctgtggaacagtcagaacacacaacatttattgattaaatttaccatctttatatgactgtggtttgtggcactccaaaacaattacaacagtaacaccaaaggttactgataatagatcatcataatcgatatgaaaataataaaaaagtttgaaatattgtgataattaccaaaatgtgacacagagacatgaagtgagtgagcacatgctgttggaaaaatggcactaataattttgctcaaggcagggttgccacaaaccttcaatctgtaaaaacgacagtatctgggaagtgcaacagagttaactacaataaaataaggcatgattgtaccttttcaggatgttgaaaaggtccagagcagggggcagggctgtgcctgaggatggaagtgtgctatttatgcactgaggcctccccataaccattatccttttcctggccctgcactgtgctgtaggagcctgacctctgaatatggtgttgctgggaggcattgctgggaagcattgctgggattctcgtgtcctgtagcttcaattaaattagaccaatgggaagtaggcaatgagaatgagggaagaaagaggtcagggtagttattccccagtgccctcccagtaagaaggaagttttggcagtaggtgtgttcttctacctatagccacaaatccagccaagaagccacactacgatgaccattcctagctctgctccctgccatgccccttcaagtgccttgtgtacagcttccttctattgctagtccctgggtgcatcaccagcctgagttcattgtcatatgcacacatcatggcctaatcctgcctacaactttacaaagagcatttccttcttttaactctaaattactcctttgggtgcatcatctgcttcctctgaagttctgatgaatacacagaacaaacatttagacctgccaatgttataatgttttcaagaatttaaaaccttcaagatcctgatagtatctaatattcatgtgattcatgccttccttaaaaacgagaatgagttactattaatatgattcatcaaaatcattttacctctaaaaaaccctaaataaacacagcaactcaactgtatctatgcatcacttctgctaccccttcctccagagtcccaagtttactacactagcaaccaaaattgctttagaattccctgacagccagaaactccagatgatcccaaactagggagaacataattctctaaaagagacttattaattaagggtaaaatattgctgtgaattttctgtaaatgttattcgttatctccccaatgatcctcccaaggtagtaagatttctttttgtctgatagtcactaaataaaggccataaaatgacaaagtaatctaaaacataaaaatgtgttattattagtatatttaaaattacacttattattattagctaatcctcactgaaggctttcaatatgccagttactgttttctatgaattgattcagtgaatcctcaaagtctccttatgatataggtattacagttatccctattatacagatgaggaaactgagacatagacatatcaagtaatatgcccaaagtcacaattcagtacaaagagaaactggcacatttatttctcagttgtttccttatcataaaacagaaaatatcattgaaatttgtacaatttaaagtaatgcctacatttactgtgccattttttgctgttactgaaaccaacagagctggtgctataatgggggatctgttatgttgagatgtggatcagaatgagaaagcttcctgctggaggatcacataaatccacagagttaggacaggcagccaagaaaaaggcagagagtggggaacccaggaagactctcacccacaaggcagagatagaacctcaggggtactaaatcaaagcagataacagaggctaagagaaataaggtgtatctactgaaagggctgtggtgaaggccaagagaagtactgcatataggaaaaacctgcaccagtaatcacttagtaaaaactctcaatttctaactagttgcagggatgcctaaaatccacactatgatgtattatgttttccaggtttgggacattttatctacataagcagaaatgttacatgaccactttcagaaaaattccttaaaaatagctgatgtgggccaggcgtggtggcttatgcatgtaatcccagcaccttgggaggcagaggtgggcagatcacttgaggtcaggagttcgagaccagcctgaccaacattgtgaaaccccatctctaccaaaaatacaaaacttagccggacatggtggcacacgcctgtactcccagctacttgggaggctgaggcatgagaatcacttgaatccgggaggcggaggctgcagtgagccaagatggcacctctgcactccagcctgggtgacagagagagaccctgtttcaaaaaaaaatagcagatgcgcaatttttattctttccttcctccttcctgcagtctggaatgtgtgtgtaatagttggagcttaagcagcttccttggaccacacgttgggaggactttgctgaaggtaaatggggaaaggagccagttttcctggtatcttagtggtagccctatcagccctgaactgctcctctcacatgggagataattgtatttacaatactgttattttacatttcctgtcatttatagtcgatctcatagtcctaactggtacaatgcatacagcacttaacacattgacactacccatagtatgctacattaatgttagctcttattattttgccattattagggctgagataaaaagcattcataaaagctcagttttgccagtggagtgtgtgagtttggataacatgagaagaaaacttcggagtgctgaggagctggttaggctacttaaatagacctttacttaggactgcaatactaatctttgttcctgtctaaatctttgcaattaatttttgtatattgttccaaatgctgtcaagaatgcttgggccagtcaaaaaacatctaagcaatatatttgacatacaccataattaagatttctcaaaaatctgtctggcagccagagccctgtctgtgtttgagacatgaaataaatggacccataaccttagggtgttcccaggagaggagagagaaaggggagggttattgttctcccacagttatgcacaatgttgtgaacaaacaaggaatgcgcaaagttgctggcttctaataaccatttgtttatattttcacttcacatttcacattttcagtataaaatgtaagagaacatatttttaaaaagacctttacttttgagcctccagagggtaatgtcagcatgccagacgtgtctatgaaaggagactttagggaatggttagactgaaataatgatttgaacattaaataaatttaaattcaagctttccctttagcgatttcagttatttaaaagttaaaattagtgctattttatggaaaatagtttcaaaaatctgagttccagagagtacattaagttcaatttcaggatgagagcaaagtacaatgacttatctattatccaaaagaatacaaatattgagtatcatacaaagttctaggattaaaaaaacaaagaaatgaaataaaaaacaccaaagggaaattattagagatcttaaattcacctataagattttattcattagtctagaagtaataacatcaaattccactgaaatttaatattttcagtaacttttcaaattttattgttattacattattttaattttttatttttaacttttattttagcttcaggggtacacatgaaggtctgttatataggtaaattgcttgtcataagggatggatgtacagattatttcaccactcaggtaataaacatagtacccaatgggtagttttttcttctcaccctcctctctcccttcacccttaagtaggtcccattgtctatttttcccctcttttttccatgtgtacttaatgtttagctcccacttataagtgagaatatgcagtatttgctttcctgttcccgtgttagttcgcttaggataatggcctccagctccatccatgttgatgcaaaggatgtgatcttgtccttttttttggctgcatagcattccataccataacttttaaaattctttatcaaatggtaatatatgttcattttggagaacttagaaactattgtttagccaaacaaagaaagatcacgaattagctattataaataattgtgtatatgtccttctacacttttctctttgcatatatgtgtgtgaacattttttagaagaatcttatagtgtatgtgctgtttttctctgttttgtaattgatccttctcctaaaacatcactttgaatgactgcatattattccattttatgcttgtatcacaacttatttaaacccttttgttataaattaaagttgctacttttttttaggtttatctgtgcttctttattattattttagtattagccatagaagtagaatggtgtggtcaaagacaatgcaaaatcctaagcatctgattagcataaccaaactgcctacataaatatgcctactaacatcaggccagtagtatgagagaatgtctgtttcattccactttccaaacactgatatatctgtgatagacagacaaagaggtaggaaaaaatagacatatatatattttagccaatataatagtgaaaaatatgtcattgtttccattcatattttttagatttttcaatcaggttaatgtacattatataatatataaatataattttcttagccatttctattttgtaacgtgtatatctctttattcattttctactttttaaaaccttaaaattgattcataacagtgatttatgtatcaataatatgctagaatattttttcctgattatggtttaagttaaaattttttaaaaaattatgtatattatattatttgtaagtttacttttctttgtaattaaatatatagctatttttcttttgagctgttcatgttaatttaagaatgctatttccattgactttatagtcataggtattttttctaacttttagtgtcttagttatttccaaaatattttaatccattaaattttattctgtctatggtaagaggaggtaaaaatctacctttatttcattaaaataaaagattatccagttgtttcagtaacacttttccaatgcctcatctttttcctactgagataaaaatgccattttatcatatattaattatgttacattgattttatgtctaaccctgcaaccacagttttaatgggggttattggggctttagaatatagttaatatctgacaaagcaaaagctctttcattaattttacattattttaattaatatttttctttacaaaaacattatacttatttttcaaatttagaaaatgaatataagtaaaataaaatgaaataactaccacctagagataactatggttaaaactcaagtatatgccttaccagtgatttgtcaatgcaaaggtacttatcctacctgatttacatttaacataatcagttacttactgaacatcattatattaagcttgaagaccagaactaggtgggctgtgcagctggttgctttgtttatcctgactatgtgatatcacagtgataaaagtaagaagggctctactaaagttaatgctgatggttttagaaaaaggaaaatggggccgggcgcagtgtctcaggcctgtaattccagcactttgggaggccgaggtgggcggatcacgaggtcaggagatcgagaccattctggctaacacggtgaaaccccgtctccactaaaaatacaaaaaattaggcaggcgtggtggcgggcgcccgtagtcccagctactcgggaggctgaggcaggagaatggcgggaacccgggaggtggagcttgtagtgagccgagatcgcgccaccgcactccagcaggtgctacagagcaagactctgtcacaaaaaaaaaaaaaaaaagaaaaaagaaaaaggaaaatggactaatgttaaacacaggctgaatctgctcaatgtttagttttattcccagccaaacacttaatagctatttaaaattcacttttattatcaaaattctgtctataacatatatatcatatatttcataatttatatcatacattttcagaaacatatacaccatatattttaggaaatatatgatatatatttcttatcacagtagactatggcatgtgtttttgctttataccttacatttgttcatacaaaaatctatcttaaacacaggtatatgacataaatattttctacaacatgattgtagaaattatacaaattttaatgacttcattttattttgttttgttttattttatttattttttattttactttaagttctgggatacatgtgcagaacgtacaggtttgttacataggtatatgtgccatggtggtttgcacgtatgccccaaaattcatttaatcatttgattttttttactttcagatgttgccaactttttttgctcttaaaaataagatcacaattaatatacctaagctaaatctccgcatatatatttgattgcttccttaaaagaatggatctttagctgctgcctaaatcaaacggtaagcaaattctagatcttttatttcactaagctcagttacactttctttccttccatctctttcttaccaaaatccataacactttgcctgcctttattcctcctgctgaactttagcatcatttagagaattgtaacaattacctagtagatgttttgattaaaatcatgttaaatttattagttcattaagaaagagcttatttctataaattttgcctttctacccaaaaagtatcttcctcacccacccaaaggcactatattctagtgacattttaaaaacctgatcatttgtaagtagggtggaacatgaatattcagtcaatttaaagacattttagttgatttaattactttagaaagaaagagagaaaaggatattgcgatgatcttttgatgtgtcggcttggctaggctacagtcccattattcagtcaaatactaatctaggtgttgctgcgaagatagtttgcagatgtaattaaagtctataatcagttgatttttaagtaagggaggtgatcccatataatctgggtgttctgattcaatcagttgaagggccttttaagcagggttgaggcttccctgtgggcagcagtttcagtccacgcctgagaggcccagtctgcccttcttgtcctgccacatagacatcaggcttgccttcccaggccccacaatctcttaaattgattccttacaatcaagctcttaaactacatacctcctactgattctgtttcttttgttgaatcctgacacacagaaaaagatttactttttagaacttagaaaatatccataatccaagacaattaagccaatttaaaatattagtctggcatttaaaaatgaagaagcacttttgtgagactcttatccaactagaggcatctctttcacctgagttcctgtcctagcctgctccctgttttttatactgttctttcattcttgtagcacacttcctccagggtaatccatacactgggctttccactgagctctggggtgtacagatgagtaaagcatagggttgattgtacagaagccacagactaataggagcaaactgaaatatgaacagataaattttaatccagcataataataaaaattattattgaaaaaggggtcataaggtgatgaagatacatatagattttaagaacaggcaaacttagttcttagtgttagaaattaggaatgtggttatatttataaaaacagagaggacagtgactgcaaagaggcacaccaggactttctagaaagctggcagcattttatttatttatttatttattttttattttttattttttttgagacagagtctcagtctgtcgcccagcctggagtgcagtggcgcaatcttggctcactgcaagctccgcctcccgggttcacgccattctactgcctcagcctcccgagtagctgggactacaggcgcccgccaccacacctggctaattttttttatatttttagtagagacggggtttcaccacgttagccaggatggtctcgatctcctgacctcatgatccacccacctcggcctcctaaggtgctgggattacaggcctgagccactgcaccagcattttatttcttgattaagtggtggctacatggttgtattcactttgttatagttcatcaagctgtgcacttaagattttagttcatattgtgtatgtgtgttataagtgaacaaagggatttttttcataaagcaaaaccattctaaacaacaaaatgtaagtaatcacacctcaagtaaggagccccctgtcatacttaagccaaattaaatacttcttccttcagagcatcagccactgttctagaattatgtgctaacattctggggtctgtggctagactgtgagcttcggagggatggggaccatatctcatttaattctctagtgcttcaaacatgacatggaaaatgattacttattgtttaaataaaaaacaatttttaggccgggcgccgtggctcttacctgtaatcccagcactttgggaggcaaacgcaggcagatcatgaggtcaagagatcgagaccatcctagcaaacatggtaaagccccatctctactaaaaatacaaaaattagctgggcgtggtgggacgcgcctgtagtcccagctactcaggaggctgaggcaggagaatcgcttgaacctgggaggtggaggttgcagtgagcagagaacgtgccaccgcactttagcctggcaacagagcgagactccatctcaaaaataaataaataaataaataacaatgtttaaaatacaaaaagaaaagaaaagaaaaaaaggctagggaataaccaagcagccatgaggttatgagagaatgaggaaaggaccttctcctgtttctttggtgaggttcattgcaatctcaaaaaaagactactattcctaaacctgtcagtgacactgctgggtgtctaccagaagctctcacgcctgtttggtaagcacagctaaacatacaaagttttatcctgtaccactatatcctacctcctgtcttttaaatccttgaaggattttcattcattggtgaacttctttatgcaaatattcctctttggaaaattctattcattgttgttgaaaaataaacaacatgttttgctctccactgatttctgcatgtcaagcatcaagtgtgagtgacaggttttagatttaacaaatcgttctgagtgcatcagcctttgctgcagttatgcgagtttcatattcatcacacatctccaaaatacttccctgcttagtaaaacactctgaggtatagtatatgaaaagcactatataatccccagcagagtgcagaatgaaaaatcctgtatttaaagattaatgattcttttagctgcacaactgacttatggaactgtctattttttaagtatggagctatgactgagatgcttatattaaacagatagaaaaggtcttaactgagatcgctactgagcaggaaaagcatccagtttcctgctcagtagcgatttacttgcaccatataggacttggaatcatgaattctaatgagaacaaattcacatctggtcaaatctcaattatctgaatgtggcttatccactctgctgagtatctatagaagcacaaaatttaaactgttattttctctgccatcctacttgcttctcagctgcctctgtcctaccaccagctgttatacagttaggaattaaaaataatcttaatgttagcataaccaaaatgttaactatcacagagcaaaattcatatataatgcaacaaacccgactaaccattttttttagactatctaggactggttttctccattgtagttgactattgagatttaaccatatctctaagtctagttcttatcttcaaaatactgcaatgttcacctggttttttttttcaacattaaaaacttgcattaagcagactttcagagtcacaggtggcttaaacacattaataaatccatgtttttctcaaaataagttttgtatatgactcacacacaaaatttacaagaaggaaaacaaaacaaaacaaaaattcagacttttagcattataacaaaaactatgctggaatgtgcctgttgaaaggaaaccactgtgggtaatttattaggaaaaacaattggagtctaatatagcatgaatctcagccaaaaatttaggaattatatacaggaactaactattgatacatgcagcaaattggatgaatctcaaatgtattatgccaagtgaaagaagccagactcaaaaggctatacactgtctgattacatttattgtgacattctggaaagagaaggacaatagagataaggaacaaatcagtgtttgccaggattagggctgggaataaaaattgattgcaaagatgaagcatgaaggaatttttgtgcatgtatgtttgtgatggaaaggtaacaggattgtcattgtggttacagtattttatgcatttttcaaacttatgaaactgtataccaaaaagggtaaattttatataaattttaaaataaaatgttaaagtttgtgattgaatcaggaagaaaaatatgataaaatattattatcacaacgaaatcactcaaaagttcagctcagtcaaatcatattgttgaatggaaacaattcctactaagagtcttacaaacagtagcaatcccaacagtccctgaaacaattctaaacttagtcaaatatagatgtgagcacaggaagataatttctatacactgagctatgtcaagtatattttctcaaccaggtgaaaataaatacatcccaaataaactcaagtgttctctaagtgtttaagaaagaaatatcactgttcttgcttatgccatgtctacactttttggtttcatgtaatctctgatctctttctttctagcttcatactcttctagacttccacttaagaagagcgaatcaatatatcttctatcatgtctgaaatcttagttcccaagttttatgcctctgtaccagcatttctcaaaatgtggtccaaagcagagaaattagagtaatttactctggtagaccaaataatggctcttcaaagagattaatgtcctgattccctggaacccatgaataggttccattatttggcaaaaggtattttgcagatgtaactagggttacagatcccaaaataaagagattagcctcaaatatccaggtgggcccagtctaaccacatgaataagtggagagctttctccaggtaagagcaggatagttgaggtagaagtcaaagagataggaagcatgaaatgaactcaaatctccattgctggctttgaagaagaaggaggccatgagccaagaaatgaaagatgcttctagcctctaagaatgacctccagccaacagccagcaaggaaacatagacttggtcctatagacacatggaagtgaattctgcaaatgacctgaatgaacctgaaagtggattctcccctagaagccccagagaggatcccaggtggtaggcatcttaatctcagtcttgtgacattctaagcaaaagaatcagttgaggagatagatctgtgatgcacaaaaattatgagataataaatttgtgttgttgaaaactgctaaatctgtggtaatttgctacagtggcaacagaagactaatacacctcatgaatcataattgttaagggtgatacctgagagtttatatggaaattcttatgcatactccatttggtaatctcttttcttcatcttcctcctcaaatgcatttcatattaacaagtcagacccaaaccatcatcctctctatctggaaagtctaatgtcattggtcatctagtctttgattgctctttaactgggcaccctcttaacacttacataattaaactgtagaatattaattgcattagttattatattctattataaaaattcattgtaattatttacatttgtagtatatacccacagattctaattctatggtttaaacttctggaagataaaagttgttttctatttctcctgagaactattacaaagtacttgatttaatgatagaattttatggaaaaggtaaaatacctgatatgactaagaagtttcaaagaaatagagcaattctcaacatcagagagtgtttagggaaggatgtgaatgactcctgagatgcaacatgagctggaggtgaccttggtgattctaccacagaccaggtgctggccctcatctttgcaaatgaaaactgaattttgtcagtatgctgagtgtctcatttcttaaaagaatgggctagtcctatcaagctcacaaaggctgaggtagaagaccagatgttaatgtattattttggaatggtatcaatgtcaaacagaaaatggtcttgatcctttgataagctacacagaacaactatttggtgagctcatactcaaaacaggaggattttagtatattactgaaatgtgtattctggttttgataaattgatttattcatctctacaacagacatgtagaaatatctgatggaaatacctagttggaaagttaatagttttgccagtttgatttttttctcaatcctgattgtgattaatacatactatcactatgaatgttaatactacccatcaagttttgcccaaaggctactttgtctcatgttaactttgtatatccctgctctattcattttgtctagattttaccatataactgtcagtggaagattttatttataatttcatgggaaaagtgacttgatatagttttgggtgtcccctccaaatctcatgttgagaggtgatccccagtgttggaggtggggcttggtgggaggtgtttagatcataggggtggatcccttgtggcttcttgctgtccttgcaatagtgaatgagttactcacaagatctggttgtttaaaagtgtgcggcacttctatgccccctattctctctttggctcctgctttagtcatgtgacatgctggctccctctttgcctgctgctatgagtaaaaactccctgaggcctccctagaagctgagcagatgctagtaccatgcttcctgtacagcctgcagaaccatgagccaattaagcctcttctctttatagactatccagtctcagttattttgttacagcaatgcaagaatggcctaatacagaaaattggtaccaggagtaagatattgctataaagatacttgaaaatctggaagcagctttggaactgagtggcaggcagaggttggaagggtttggagggctcgaaggacaggaagatgagggaagccttgaaactttttagagactagttaaatgcttgtgactgaattctgatagttatttggacaataaaatccaggctgccaaggtctcagatggaaatgaggaacttattgggaactagaggaaaggccacccatgttatgccttagcagagggcttggctgcattgtgttcatgtcctatggatctgtggaagtttaaacttcagagtaataatttaaggtatctggcggaagaaatgtctaaggagcaaagcattcaagctgtagcctgactgcttttaaaagcccaacttcgatacaggagcaaatatataacttaaagttggaatttatatttaaacaggaagcagagcaaaatatttgtaaaatttgcagcctggccatgtgacagagaaagaaaaagcttttttgaaataggaatacaagcaggctgtggagcaatcacttgttagagagatttgcataattaagaaggagctgagtgccaatagccaagaatatggaaaaagtgcctcaaaggcatttcagagatcttctaggcaggcttctgcctgggcacccaggcttttccatacatcctctgaaatctaggtggaggccaccaagccttcttcactcttgcactctgtgtgcctactaccagtatgatcacaaaggtccaggacgattgattggtttcaggggccagtcccaagtcacaactgccctgtgccaccctaggaggttgctcctcacatcctggcagatctggccccagtcttggctcaaagggctccagatacagcttaggccgctgcttcagagggtgcgagccataaaccttcatggtttccacatggttttaagtctgtaggagagcaagagtgaagaaggcttggtagtctccacctagacatcagaggatgcatggaaaagcctgggtgcccaggcagaagcttgctacagaaaaagagccctcacagagatattctactaaggcagtgtgaaaggaaaatatgaggttggaggccccacacagagtccccactggtgtactaacagagttgtgagaagagggtggtggggctgaaccctacaaagccacagaggcagagttgcccaaggccttgggagcctacccttgctgcagtgtgccctaaatatgggacatggagtcaaaggagattattttggagccttaagatttaatgactgccttgatgggtttcaaacttgcatggggcctatagccccattcttttggctgatttctctcttttggaatgggaatgtttacccaatgcctgtacccacattgcatcttggaaggaaataacttgttttgattttacagctcataggtgaaaggaactcatttcagttgagattttggaattcagacttgggacttttgagttaatgttggaatgagttaaggctttaggggactattgagatgattatattttgcagtgtgagaaggatttgggatttggggagccaggggtgtaataatatagtttggatatcacccccaaatctcatgttgagatgtagttctccagtgttggaggtgaggactggtgggaggtatttgggtcataggggcagatccctcattgcttggtactatcctcatgataatgaatgagttctcacaagatctggttgcttaaaaatgtgtggtaccccccataccctcttgttcctgctttcaccatgtgatgtgctggctcccgctttgcctcctgccatcagtaaaatctccctgatgcctccccagaagccaagcagatgccagcagcctccagtatttctcaggtatttctttatagcagtgcaagaatggtctaatacatgacctaattgtcaataccatgtattctctgatgtattaaacagacaaacaaaaatcacaaggaattgaaccaaaaaataatttgatttataagacaatttaaaaatatggtcttattattaactcagactttttgttgttgtagttttggttcaaaatatctatctcttattattttaacttgatttgaaacgttgtactcatttcaaaattacttttgcttatccaaattgtgttctcttgacaagcctgatgattttgaacctttcactttcatagagatattacaaatgtctgttatgcatatctcatacctaaagacacaaataccttggcaatatagaaaaggaaagaataaattatcatttttggtattttagaaaattcttctttctccaaaatctacctgaattctttatttttttgagacaacaataattaggataaacaaacatcaggtaggtatgttatttgtaatactcggaaaaaatataagcaagcattttacagaagataaaatggaagctcggagatagtaactttcccaagggtacacagttgtccaaatagagacttttgtttgtttgtttgtttgtttttgagatggagtctcactctgtcgcccaggctggagtgtagtggcacgatctcggctcactgcaagctccgcctcccaggttcatgccattctcctgcctcagcctcccaagtagctgggactacaggcgcccgccaccatgcctggctaattttttgtattttttagtacagacggggtttcatcgtgttagccaggatggtcttgatctcctgacctcgtgatccgcccctctcggcctccgaaagtgctgggattacaggtgtgagccactgcgcccagcccatatagagattttaactccagtgtttctgacctaaaatctccctgtctttggccagtagtactccatgctgtgtcagaattccaagaacctcttaatacacaacaccgagaggtatagtaacttgtaatctatgattacagattgtagtaactatcattctataattatacatttttttttagttgaaaggggcctcaggcatcaccttcccgcctacatctctgaaagacatctctgtaagcgaatagttatctggaaaaaaaatctcatcagcacagcaatatgattccattgctctggtttcattttggggcaagtctattcgcaaatatatatattcaaccaagtgaaagtctgtctctggaacatccacctgttagtctcctggtttgccctcaggagttacacagactaaattggctccctctttctttatatcaatagttttaattagatacacctcaatttctctatctcttcaactataatgaatatgaaattattttccttctctgcagtcttatttaaatgtgagatccactatggaacattccactgctaggatagtctgctaagtgcagatgtcaatgaaaaaactactccaagactattgttataatccaaatcacaccactcttcttaccatctatgtcacacaatttgcccatattaaatttgtgctcaatatatgactctaaatgcatacctttatgtttctctcttaaatgccattttttttgtacttgtcagcccacaattaaggcccttaaaaattataggagttatttgcatgatagtgcaggattacaaaaatgactgcatgatgaaactgtgcaaagtagtcttaataatcagtggaaaaaatgcaattgttccatgacctttacatttttttgtcaaaacattaaaatcttcatattgttagatataaataggaatgtataagaaaatgtaagatagttaaactaatatttatttagtacatgaactttaaacattgggaacattgagaattaaaaaaataatttttagtaaaaactttaacagatcttgccttcttattgtataatttacaatgcagagttattgtctatgctttggcagattgtcatatagactaagtttggatctgcttccaacactttatcttttgtgctttcaatgttgtgaaatatctgagagttcctttaaaatgaagtatttgtcagtatcacttcctcagggctgtcatcctttttgtcacttcccttaattgtcagtaagttcaccttcattaaatttccatggctgcgtgctagagtctccaacagtggcagtgccaaccttcccatggtgagctatttctttcataactccatttatgtttgatttaaatttcacttctagcactattattcatcatttatttggtgcactttcatttttgttggttataccgtctgattacccattttcataaattgtcacacgggtttgtcatggagagaccagaaggcaacacaactctaagttttgctgtctgtacttaaactgaataacagatgcaaagtgatcagtcactgacagactttgaaagatgtgatatgattggtcactgatcaagatgttcatctgttacttatttagtgatctgtgaactcaagagctactagcaaagtttttactttgtgcaattagtcacatcttatagagcatgataaaatgaactgtgttcttgagcaactagttctatttaactaaaccatggtaactgaaatttgtgcacattgtgccaagtgaagattgcgtgtattctgctacccagggcagtgctaataataatctcctcctattacacacgcttacacacacacacacacacacacacactcctttcaaccttcattcatcagggaacttaccttaatgtcagacttgactatttctatcttgaattatattacctttcagaggccctgaccatggaacagtatatgtctttttctgaatcatttgagcaatttcattttctaatgtgtaatgttcaggtgttatgtgcattccctgcttttacatacagtttgttcacatgtagttgtatttattttattagcaagcatgtagagtcatccaaactgggattgccattctagatttcctacttcagtaaaaatggggtctaaaatcaagcctgctgagacttctccaggttaagtgttactaaagactctaatatcctgcatttcaccctgtatttaatagagccacctagggattccttccttgtccttccttattgtcttagattagaacactttcctccttactctatgaaggatattgtcttgcaggttgatctctttaatggatattggaccagactccaaaataccagctgaatgttacaggcttaccaagagtcagggtggtagatgtctcatgatcaatatctctgaactataaggcaaagttacagtgcctcctggttttaacagaggatgttttcagaggctgaaattggaagggatttgtgaattgtggcaagcttcaatttaatcattttgtctgctcagaaaatacccccatttgagagagaaagaacagttagctgccatagcttctaccgtgatcaagtgaatgtcatagtatcaatcaaatctaccaacattctgtaagcatgcttgactgtcactttaagttattacaggacacacagagcccccccattaccaagaaaggaatccaggtactcatgatacataccatttggatttttatcatccattgcaagtgaccacagaaaatactctcactttgagctaagtaattattctcaccaccacactgcttgttagtggcaaagtggagtctgaagccaagatctgctacctcccattccaataatctcttctcattattctaaataatgctttcaggtttgttgacagtagctacttggtctaaattgttgttttgttgatatatgggtcttttcttccccgaaggcatcttaattgcttcccgtttttattaacttggtgtatatgactttcatcaaagcacttaactatgtaaaccatcgtcctgctctcctgaaagccaggaggagggcagctctactttgaatctgccttagcaatgctgaatgtgcaagaggatcgggggaggaaggataggtttgcatctgctcctgaaatgttcatgacctttgcaatagaattcctgggccagaaaacctgtctaccttaagagaaaaccttagaaatacatttcacagatagatgctttgggaccagagaaagggaaaggaatattcacaggtagaattcaaactggtgacagacaagataaactctaaagtcatattcacattaccaaaggaaaaatttaaaacagaaattcaatatttagcattatttttatatatgccttaattattgtctgaaatagaaggtgctctgttctttagtcacaagcctatcaattaactgtcttaaattaattgttagaagatatagttataattttacttataaaataacaggatcttgtcactagtttcattatgctcagaaaaatctgctcctatctggtggcagcatttcctgagggtattcagttggcaaacttagccagacttaataaactggctgggaattgtcaggtaatttccttaaaattaagcatgatgaataaccatttcatgtatggtctgttctgagctctttagctggtgaaataaaaatagactcctaatagattttttttaatccaaattttaccaaactcatttagagtgaattttataaaatgtggaataaattttatgaggattctaagcagtatagccattttggttattaaaattaatttaaaatgtctctgaattattctaaatgttttaaagttttttttttttttttttttttttttttaaagaaacaacattactggaaaatgaagaaggatctacttgcaggtcttaacataaaacaccattttccagattgtctttcagactctcctatcccaaattattctgcatcccatcagcaagggacattttctacagaaccactcagcagcgaggcagacaagaggttgaggctaaaagaatccaagacaaaaaccagctgctgcagacaaggtagaggaagagaacagactaggtgagctaaagattgaagggacactcatcttttccgtcagtgttttagtaatcatttgattctcctcaactatttggaaatagatattcagcttctcttttctttcttacaagattcccttagttaaaagtggctaaggctcccataacatctcatccccttagcagaatatccaaggtccatcacattattggaccctctagcacatgttgcttatacttgttatggtgaagcctgtgcatcagcaagtcagggaatgtactatccccatttcctatttgataggctattactcacaactcaagtgtcaggaaacttttctgttaaactttcaggatccttcctgggaggcctattgctcctttctctagggtacaacagcctgttgttcacacagctctgctaggacttatcaccttgccataattacctacagctccattagactgtgcacaccttcaccttggtattccagggatgtggtttggatatgcgtccctccaaaactcatgttgaaagatgactgccaatattggaggtgaggctggtgggagggtattggatcatgggggcaaatccctcatgaatggtttagcaacatcaccttgatgataaataagttcttgctcagttcctccacccaacatctggttgtttaagaacctgtttctgcccccttctctctctcttgctccccctgtcaccatatgatacactggctccctcttcagcctccaccatgattgtaagcttcctgaggccctcaccagaaagacactagcactatgctgcctgtgcagcctgcagagccatgagccaattaaagcttttttctttataaattacccagcctcagggagttacaacaacagaaaaatgggctaatacacccaggcaccagagtaatgactgtcttgcagtaagaaactaactcaaagcacatttgctgaatgaaagagcaagtgcacatatgacttgaagaataacaaaggtgtttaaatcaaataatttaaatatatataatgccttaattgcttctatcttagagtgtttaatggaaatttaaattttccttcaactaatagatagttgttaaattctgcagagtagaaacccactaagaaaatcaataaactgaactatttttgctgcaatattttaacatgaagctaaagattagagtcagaccaaaacttttcaatagaatatttacctctcaagagcacatgtatataattcacttttaaataaattacattaggtgttaatttgtaggaaaaaaaatctgacactgtaggcatgtgatcaaaatcataatatgatttttaattagggaccactgcaaaggtaatactaaacagtttgaaatcataaatagttttgaaacttcttatttcatttttggtatttatttcacaaatggtacgaagtcttctggaaactatatttttagatgttattattcattataattgctagaaacagcatctttcccagaaaacaaagttcagcttttatctgtatgcagaaattattactacacaatacttttcctcttattaatttcctctttcaaatggctagtgctaacttacacaggtactttgaaaagaaaaaacaaatgattctgttcttatgaatatatagctaaaaagcttctctgaattcctttcctggcacatttaacaatactataatgtacagagagtagttagcggggtgtacacacatgactgtaaaaccctgaaatacatgtgataaatttctaaacatgagccataactcttacttagagtcagtaatgtctcatggccatattcaactattcactgctttatgcaggtgataggtgttctctattgtaaacttacagaaacctgttgtctctaaatttgaaaatactgatgccaaataaggaaacaggaacttagctttattaaatgcgatgcaagtccatacaatgaaataaagtaggacatagccatgagtaccaaactcagttatctgtgtaactttggctgagaaaaatggtccctctgtgttctcacttccttgggctacccaggacagtcctgatttatgcctcttgttctggtgtcattattaatagaactcctttgcacttgcaaacatgctactatttgggtgtacactttatggtcacctagtcatcttccttgtaaatggagcactcgactctagaaataatgtagtacaagaggaggaaggaaatactagcttagtcatttctatcaagtatatatttttgctgaatgtcatagccacattcattcctacttgcaggaagctagtttgcaatcaacatagagctaaacattattgcatctagtagaaagctagacattattttaaccttagctttacttaaacttccaatacatggctactatacctttcaacttaatcagcatatttggggagaataaataatttatagatctctgagtacttcaaagcagaaaactctggtgatagctttcagctgtttatataacattccaaattgtgctgtttaaaatgaaaattcactttgtaagttctgtctcagaaatccaaggccttttcttggttcctttcctagaagtgctacatttcattttgcactacccatatccctcatgacctcctccctgattccactggcccatgactactcccccaagcagcttctgaattggcttcaggatatcattgcttctttatatatatcaattaagaaagaaacttgaggactggtggatatcaaaggaagacgatttattcttcttcaaagattgttttacatgttgaattgtctcacaaattagaagcagtagattcaattaagtagaagtctttagatagaagttgaaatgatgtattctcctggcagtgagtgtaatttcaagtggtcacagagtttcagttctaaatgtttctacttgctttattttccctataaaaatacataaatatatagattcactgtgcataaatttaattgacataaatttactcagggagaaatcagcgaagtaatttctctgtctggttcacataataatttgcatagttaaccagtagtgacctcttccttttaacaaataagttgtagttcataacctgaatttattatttgtagggaatgtgagtttataattattttccaggacacgtttcaaagcaacagcatttcaaagcaacggtatgaatcaagtgtttttaaacaatatacgtgcagagcagaaataacaaatacatggttgtgtgccatcaaccatgctcttgagaaaggggaatgaataccatttgcctgaacaatctggccgagattgtaaatttgttcagatgaatcaatccaagctaaaaaactgaaaatcacatcaaatggatgaaaagtaaaacatatgaaattcataaaaactgaagttttcaagctttctttttgttaagtgacagaacgttttcagtaaatgaaatattagttggaaacctagattttatctccatataaaggaggagatgctttagaaagaaaaggaggagaagagcaggaccttcaatcccaacgctcatccctccctctcattccttaatactgtactgctttttacagggttaatctaacatcgaagggaagggcaagaaagaagagaacttggctcagctatctacagtatgttatttataatgtattatggtgtgaggaaaaaaatgcttcctttacaaggctagggtttcaaaaaataaaatctgcagctgctaaacatagaaactaaaagaaactctctgattaagagcattaacgataaggtaagtgttgccctgagtcatttttttctgatttatatgtttaaattcaaatgagttcaaattaggcattaactgatagcaagtttgtttgttactaaatatagtgactcaactaattttgagtagatcttacattatctgtgctaacaggtgcatagaagagaaaatgaaatggattgagcaacactttaggaacatctggagaagatatttaacttgtattcctcacaaagtagtctgattgcctttttatcttcatttacaatttttattatgatcttttggtataaaagtcatgtatgcaacacacctgtttaaagctatgttacatatggaatatttaaaattggcaacttccagtaatgatattcattgcatacattacacatattgaagagggttcattgggaatttgcaaatacattttcaatgggaatgatatgcaagatggaagtactgaagttactataagagggccttaatgatgctttttcccttttaatattattaatattgattcacacaatgtaaacattcctaaatcaactaaaaaaccctttacatatacacacacataaactagtccttgtactacaaatatgtggtctgattggcaaatattttaaataagccactataattctggaaatagatctctcataagctaggtcctaatctatttacagaagcatggtgagtttagcagatgtttgaagagtctaacaagtagaagatgagagaaaggaccactataagtaggaacttagtgtttttgttacttgaatgactcatttagtggttgttacaaattttatttaaatactagggttctatatacggtattgtaatgtttatattatgtaattgtgggggactccaatgatgccgcacttttctcaccaaagtataaaaaccgaaactacttctctcccatttatatatacttctctggattttatactacaaaataaaggctaccaacattctccagatgaattgcttctgaatatataagtttagggttgccagaagaatggcaggatactgaaatatgttagttatagctgacagcatttctgccaagaaaatcagaaacctcctaatcagagtaaatactaggatacttcccccacatttcttctataacttttgcttttaatgtcaattagtaaagcaaaaaacacaggctaataagggagtaaaagaaccaataaaatagtttattaaatactagctaataagctaatttacctccagaacatgacttatacaagttatcaatgaaattagaatgaaaaacagatccctaacatggagaaaagcttacattaattatgacttcaaaagcaacccattcagtgaacttttgagagcccatccttctaatagacttctccctttaggctcttgtatgctttacttggttctacatcctttctgctttccagcaggaggtgaattcaatgtttggaacctttcttttgtttcttttttctaaaaaaaaaaatttttacttaattctttggagacatttccatcatttccttaggcgctaggtagcatttcagagccaataatctccacattcaactttctgccttatgtatcatcccatggtaaattccagtgggatgacccccagctactgtatcgcaaatgcattcacatcaactcatcttgccttagaaacacctcctttatccaacattcttctctgtcaatgccatgtttttaggttaaagatcttgcaataatctttgacagttctctcttttaatactcataaattttctttatattaaaaatactaatgaaagttttttctttctttttcattctagtcaccatgacctctaagccctcattagtgaccctttgattctggtttctccttatgctaattaatcctactgaaagaaaatgacataatgaccctataacttacttattccagaaacttcaattgttttctaacatctttcatcagtatttcacattcgataatataaagtcatcctactttctctttcatactttcaaaagttggtattcagtagctatatcactttgtattcccacagtacttaaaaagagatcactgtatataattgatttctgcatataaatgtagatgttcaattaatcgttattgcttttcatcttgctggaaggggtctcattgctccagcctatcagggtcattttgaatctatactaaattctctgaggcattatttatacccctctgctttactatcattatatcagataaacacagaagatacgtcttcctttaagtttgcaaggaaaatatggaacgacccagagccaaggcaaaaaatctcagccatacctctacacatgtctctccaactatcagtcattcattaagacaatgaccaagttttaaaccaaccaactaggttcacataactatgactatgcaggacaaaactgtctcgggaaacactgtcaactcttgaaaattaaggcacatagatgtatagggttatagtgatccacagacccagaaatgtattaaaaaggaaatgagtcattacccattacgcttttcagttgatacatagagtttatcacattatcttctgcatgcaaataaaccaactatataaatgatttcgttatatctggagttgatacaactttgtttcatattttctagtgagaaacaaaattattaaagattttaatatattactttttttttttttgagatggagttttgctcttgttgcccaggctggagtacaatggtgtgatcttgactcactgcaacctccgcctcctgagttcaagcgattcttccacctcagccactgcaacctccacctcccaggttcaagtaattctcctgcctcaccctctcaagtagctgggattataggcacctgccaccatgcccagctaatttttgtaattttagtagggtcagggtttccccatgttggccaggctggttttgaactcctgacctcaggtgatccaatatctttataaaatagagattagtatgtttaaaaaagagataggagagagaatagagccatttaactttcttcctgagctgaaatgttcattaagagaaacagagaatgaaggaaacaaccaccaaccaaacaaaacttacctatttgctcctaaagaatttgtggaatgctactgcaaactattgtcttctgaaataatataaaatagtgccacaactaataaatattcaagaaatgaaatcctttaataacaacgttcaatgtatgaatgaaaacagaacatcctttatagactatgataagtacaaatatgggttttgaaactttacctcaataaacagcttctctttttctctttcttttttgaagggaaacagggctaatatgaggtaaaatttaaaggatgaatcagatagatatcggtttaaattttggctccgtcatttaccagctgcatgaacttggtcaaaccatttttacttctctatgcctcagttttctcttttgtaatgaggatgataatacctaccctattggcttgctgtgaatattaaaagagataatgcagccaggtgtgattcctcatgcctgtaatcccagcactttgggaggctgaggcaggtggatcacctgagatcaggagtttgagaccagcctgaccaacatggtgaaacctcatctctactaaaaatacaaaaattagccaggcgtggtggggtgtgcctgtaatcccagcaactcaggagactgaggcaggagaatcgcttgaacccgggaggcagaggttgcagtgagctgagatcgcaccactgcattccagcctgggcgacagagtgagactccatctcaaaaaaaaaaaaaaaaaaaaaagagataacgcacatcaagtgcttatttcatcatctgtaacgtggtatctatttattgagcagtcactattttactcgttcttttagttgtcttatttgttgtccactcacaactcactccactttttttttcaactttctttttcacctgtgaccccctcaccttttcactgtcctgttgttcttccctctaaatcttgaaaatggagaagcagtagatatgctgctcaatttagtagattattttattaacagtacgttagcatgagggcatttgttacaatgaaatatttgatttaacaccttcatttctaaaattggaatgaaaagatttatctctaaagaaattctaaacaccagaaagtgagtgagactatattattttagccaaaatatagaaaggccaagataacctaaaacaccattgtttagtgtttttaagaacattggtttgaaggaggaaaacaagttaatcattaaaatgcctaccaattattgaacagctattatgtgcctgggatatgctttaacatacaacattaaaatttcattgctcatgtactcaaatatattataaaagttatcctcattttatacaggagaaaactaaggatttgaaaaggtagttattttgtctaaagtcacagagccagaagaggaaaacaggacttgaacttaggtctactgactcccaagtttgcgctgtcaatcatggagttatatagtactttgatctgtacctcccacagaaactgtttcactgagcaaaagaaagcagaaactaacactgactgagtggctactgtcccagatattatgcctatgaaaatatctgctaatgcctattgtcacaagttacggagataatgttccttagcttactgctttctgcatcattaaagtctctctgcctactaccatcaagtgcaagtcagtctcctaaagagcctgaaaacctgtagaagctcttcattgggttgggggagttgagctttgaaacaacccatgagaatctgaggatccattttgagcaatggggaatgctcatgggttgtgtggtaacaagaaatccaaacaccaaaccctccaggggctttgggtttgtcacaaatgccactgtagaggaggtggatgcagccctgaattaaaagccacgaaaggtggagggaagagttgtggaagcaaagagggccaactcaagagaagattctcaaaaccaggtacccacccaactgtgaaaaagatatttgtaggcgccattaaagaacacacagaagaacattacctaagagactatttggaacagtgtgggaaaatcaaactgattaaaatcattactgacagaggcagtggtaagaaaaggggctttggttttgtaaacactgactatggtgattctgtggataagactgtcattcagaaatataccatactgtgaatggctacaactgtgaagtaaggaaagccctgccaaaacaagagatggctagtgcttcatctagccagaggttggcatggttctggaaactttggtggtggttgtcaaagtggtttcagtgggaatgacaactttggtcatggaggaaacctcaggggtcatggtgtctttgatggggatagctataatggatttgataacgatggtagttatgttggaggcagtcctagttactccagaggaagcagacgctatggaagtggtggacagggttatagaaaccagggcagtggctatggtgggagtggcagctataacagctgtatcagtggaggaggtggaagtgactctggtggtggtagtgaaagcaattttggaggtagtggaactatgataattttggaaattacaacaatcaatctttaaattttggagccatgaagggaggaaactttggaggcagaagctctggcccctatgatggccaaggccaatactttgccaagccacaaaatcaagatggctggggtggttccagtggcagcagtagctatggcagtggcagaaggttttaattcctgccaggaaacaaagcttagcagaagaggagagccagagagtgacagggaagttacaggttacaaaggatttatggggtcaaccaagcatagtggtggcagtgcctagctgctacaaagaagacatgttttagaaaacactcatatgcgtaggcaaaaaaacttaagggctgtatttgtggctaattgtataacaggttattttagtttctgttctgtgaaaagtgtaaagcattccaacaaagggttttaatgtagttttgttttttcctttttgcacccatgcagttgattgctaaacataatagtctgatcataatgctggataaatgtacctttaaaaaaatagaggaagatgaagtaatggggacgaaagcttcactgatcacagagctctccacacttgtagtaggcagacactatttcgtttcctcctagaatgcttcccagactcctggttgtattcctttgggaattctttcccatttatatggttatggtgggactgtgaatcaaggtgtgtgtcccatccaagcctcaaatgagtgtgcatataagatagttggggtaatcagtctttcccaaggctgcttggtgtgaacaagagctaaagttctcttactcatttacgctaatggaggcaatgtgatgggagaataaagccaacaaagtaagagaagtagagaaaagtcgagctgaaagaggagagatacagtgacagagccatgacacagtatcagtcctggatctagatatgcctgaagccagagacttacaaattcctttttaaatttttaatagtctactttgagttgggtttcattcataggtgcctgaaagagttctaactgaatcacttcttttttgaaaaaatgttcttatctttctcatctcccttttttggctaaacaccagttgtgcccatttacaatgtcccccagacttttttttaaaaaatgttttgtacatattaaataatttattattattattatactttaagttttaggatacatgtgcacaacgtgaaggtttgttacatatgtatacatgtgccatgttggtgtgctgcacccattaactcgtcatttagcattaggtatatctcctaatgctaaccctccctcctccccccaccccacaacagtccccagagtgtgatgttccccttcctgtgtccatgtgttctcattgttcaattcccacctatgagtgagaacacatggtgtttggttttttgtccttgtgatagtttgctgagaatgatggtttccagcttcatccatgtccctacaaaggacatgaactcatccttttttatggctgcatagtattccatggtgtatatgtgccgcattttcttaatctggtctatcattgttggacatttggctcattttcaagtctttgctattgtgaatggtgccacaataaacatacgtgtgcatgtgtctttatagcacatgatttataatcttttggatatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaattggtgtgagatggtatctcattgtggttttgatttgcatttctctgatggccagtgatgatgagcattttttcatgtgtttttggctgcataaatgtcttcttttgagaagtgtctattcatatcctttgcccactttttgatggggttgtttgtctttttcttgtaaatttgtttgagttcattgtagattctggttattagccctttgtcagatgagtaggttgcaaaaattttctcccattctgtaggttgcctgttcactttgatggtagtttcttttgctgtgcagaagctctttactttaattagatcccatttgtcaattttggcttgtgttgccattgcttttggtgttttagacacgaagtccttgcccatgcctatgtcctgaatggtattgcctaggttttcttctagggttttcatggttttaggtctaacatgaaagtctttaattcatcttgaattaatttttgtataaggtgtaaggaagggatccagtttcagctttctacatatggctagccagttttcccagcaccatttattaaatagggaatcctttccccgttgcttgtttttgtcaggtttgtcaaagatcagatagttgtagatatgcagcattatttctgagggctctgttctgttccattggtctatatctctgaaacttaaccaatctctctccttttttttttgacccagaaactccaggattcacatattatatggttttcagcatatttagtgttggtttagtttttactggtaactttcttggggtgtaatcttccttaccagacatgtcaaaaagtacccctaagtatgctatactatttatagttcagataataacattacaaacaaagtagtgtgtttttgccacaagatatactgcttcaactcatttgaatgttaaacttttgaaaacattttattttgaaataaaaactctaagttgtaagacacagtgtcactgtcactgtgatcctgcttttcttttatattaactaacttgtatcatcatccttatctaatatgaattgaattacaaatatgctacaggggaactccctgatcaggaacaagctgaaatagtaccttgttttcaacattatactattctgctccatctctgaaaatgcaaggacacattcattaaacaggcttgtgagaaaacagtcatacatggtaaaggtaaatttattcaatttgatttgtaattatatttaaaattaatactctgtgttagtccagattctcctaacttatgatggggttacatccccataaacctatcatcgtaagttgaaaatttccttagttgaaaatgcattaatacatctaacatactaaacaccatagcttagcctaggctactttattttttgagatgaattctcactctgtctcccaggctggagtgcagtggcatgatctcggctcactgcaacctccatctctcgagttccagcgcttcttccacctcagcctcccgagtagctgggattacaggcaggcaccaccacgctcagctaatttttgtatttttagcagaaacggggtttcaccatgttggccaggctggtctcgaactcctgacctcaagtgatccacctgtggcctccaaagtgctgggattacaggcgtgagccaccatgagcctaggtcacctcaaatgtgctcagaacacttacattagcctacagttgggtgaaatcatataacacgaagcctattttataataaaatgttgaataccttatgtaatttattgactaatgtactgaaagtgaaaaacactttctactgagtgtgtatcacgtttgcaccatcatgccatccaaaaatcttaagttgaatcctcataaattgggaactgtctttaaattcatgcataatatcaaatctagtactccaaatgtgattaacaaataatgttttttagcactttggttagcaacgtaatgcaactttcaggattattaaatccatctccatttattctccatctctattcacacaacagagtaacctgtcatgaattgcaattatatttattacaactgaccctcagaaagaactagtttaagtttgcttagtggtgacagaaggcaattataatgatagccatttcaatagggatgctttaaatacgatgcttgcagaaaataagtctcactgctttaacagaataggccacagaactttaaagatgcaaaatgacaaaaagaccaaagatattatagtattaaatgaaaaattcagaaggcaatattaatgtgaacttagtcataataatgaaagaggtttcagagcaagaagataaaggtgtgaaatgaaaatcttgctgggtgtcagcaatgaaatgctgcacatttcttgtaaaacatcactgggctagtttgccaaattagctgacaaatgtctgccataatcatgcaatttacacatttgtactcattttagaattagtctcacggttatttatttttggagttctgttaggttatgaaaatgggctaggcatggtggctcacacttgtaatctcagcacttcgggaggccaagatgcgaggatcagttgaagccaggaggtcaaggccagcctgagtaaaaaagtgagacccccctcactttgttagactctctctacaaaaaaaaaaaaaaaaattagctggccatggtggtgggcacctgtgatcctagctactctggaggctaaggcgggagtgtaacttgagcccaggcttcagtgagctatgacagcgccattgtatagtctagcctgagtgacagagtgagaccctgtctctaaaataaggaagaaaagaagagaaaatacttggattttttatttctttttatttttgccttttcctggtaattaaccatattttctaagaaacctgaagaatgaagattattcggcttttcttttgcaggtgcaatgctgccgcaactgattatgtcatttgtgcactgcataaggatgccgcggctaagaagcacccacgcattcacatcacatgcatcacatatttgcatcctgataatttgccaacattgagagtctagtgtctacttcatctcacaatacatcagtctcctcatttgtaagatgagatcaataacagtgccctacatcattgaattgtggtgaggattaaatgagttaatgaatataaaaatttcaaatgttgttaactattattattaaccaattttcactcatgaccttcatgtgccatgtgctagagactgtactaagtgctttcgatgatattttgaaaacaataaaaggtaaaggaaacagaagctcacagaagttaattaaccaagccaaaaggtagcttggttatctgttggattatggaacactagtcttgaagaaagtcaccaattcattcattcattcattcattcattcattcatttattcattcactcactcattcattcattcattcattccagataaatttatagaaggaacagggatgaggatcatggagcaggtactaggctagttacaatgcaaggtgttaagtgatcatttagctctctaggaaaggtgctgtgaaaggaagaattcagtcagtatagcaaagggaacacaaagtcttcatagaggaggtaatttaggggaaagtaaggttggaggatctcccaaaagcagggtccaacatctcctggtttttaaaatcagtgctgttcatactgttctttctcccaattcatcggttctgggctgagtggccaacatggctagtgagtgttaagagattgaatgataacatcaagattaaatcaacacaggtttcatctatactgtaaacacttactactgctccaagaaggagtaggtaggaagctgtgaataatggcacacaaaccttctccacttttgatagagaaacccagaggacgtgataaatactaatatgtatctgaagagtgctggattccttattaagtactttgacattcattattttgtgggatcgtccttacaattatttctgataaagttaaatgttgttacctgcattttacagatgaggaaactgaagctctgtcaagctgagaaatgttagagcctgaatttgaacttgggtttgctaactctaaatttgatgttgttttcattgtatcttattgctttcctttcaaggaagttatgcaaccaggactaagaaaaaactacttcaattacaatagtattgtagcatgtctttcgtttttgaattttttaatttttaaactttcttgaatttaaattggatatgtaactgatgaaaatctagttaaaatcatttatttctattacgatgtctatttcaatgtttcgcaaatttgaatgatagccgtaccctttcaaataaaaaaattgattacaggtctctagtgctctcttaaattatatttagtataatattacttaaatacgtgtaaacacaaaaccagatattaattcatttttcctctagcttttataaaacattttatgactgcaaaccacaacaaagttacaaaataaatacaaataatactttaaaacccaatacaattcaaattaagaatattaatttaatgtgataaatggtaatatcttgctgaaggtagatcactcgcactggctttttaaaaattttttgtttcaatagtttttgaggtataagtgattttatcatacatgggtgaattatatagcgatgaattctgagattttagtgtacccttcacctaagtagtatacattgtacctaatgtgtaattttttattcctagtcctcctcccactctcccccttctgagtccttaaagtccattatatcactctgtgtgactttgcttactcacagcttagctcccacttataaatgagaacatatagtttttggttttcctgtactacttcacttagaataatggcctccagatccatccaagatgctgcaatagacattatttcatttattttaataggtgagtagtactccatggtgtatacatactacattttctttatccactcattagtcaatgggcacttaggttggttccacatctttgcaattatgaattttgcttctataaacatatgggtgtaagtgtcttttttgtataataacttcttttcctttgcgtagatacccaggagtgggattgctagattgaatagtggatctacttttagctctatgaggtaaaagtttaaactgtattgtttttcagagaggttttactaattaacattcccaaccaacagtgtataagcattcccttttcttcacattcacgccaacatgtattgttttttaactttttaataatggccattatttcaggagtacggtggtatctcattctggttttagattgcatttctctgatgattagtgatgctgagcattttttcctatgtttgttggccatttgtatatattcttttgcgaaatgttcattcatgtccgttgtccactttttgatgggatatttgttttttcttgatgattcactggagttccttgtagattctgcttaccagtccttgttggatgtgtagtttgcaaatattttcttcctttctgtgggttgtctgtttactctgattattatttctttttctgtacaaaagctttgtagtttaattcagtcccatttatttatttttgtttttgttgtgtttgcttttggtgtcttagtcatgaattctttgcctatgccgatgtctagaagagtttttccaacattatcttctagaatttttatagtttcaggttttatatttcagtctttgatccatcatgagctgacttttttttataaggtaagagacaggaatccaattacattcttctgcatgtggcttgccacttttcccagcatcacttattaaatagtgtgtcctttccctaatttatgtttttgtttgctttgccaaagatcagttgactatatgtatttggctttatttctgggatctctgttctgttccattgtcccatatccttattttttataccagtatcatgctgttttggtaactacagcctagaaacatgtatttatatattctatatcaatatgttctgcaaatcattgtcattagtagtattatttttctaacttttaacttattttaaccaatactttaccaaaatccattatatcccataatataataccaaaaataaagataaaaagcatgcaacagaaaatttttcaattatagaattactactatacttagtgctaaaacccaaaatggtgcatcttcagatagaatgcaggcaagatacccgctcaaagtgagcatcaaactaactgcttacaggaaggttcctttgtatgccccatgcctagtactccaggggtaccactgggacccatgtaataactaaagtgtctatcacttttcaaaatacgttggaaacctttgtctttatagagcctcacaatttcatctcttctgttgcatcaattgtataatacatacacatatcttcattgtttttcttattagcctaagacaaagcaatacaaattcttctgtactgtaggatattaataatgttaaaccaaaatctcaaatgattaaagttaaaatcttagtctattaagatgtttttgaattgcaaaccaaattaaaattgcaatactgactttttaggggtcctctaggtacctactttatcttgaatctaattacagaaagtgaactgaagatatagtggaatactcagttattagttgatataataatcaaaagagaaaaatttgttaaaaacgctcacaggcatctgttttgtccacagatttctcatcaaaccctctttagtactgacaaatcaaattttcacttttcagtagaagttttttactcctaaatcttcaactctctaattccatgtagaagcttaaagatggtgtggttgttgcttgctgacccctcccacttagatgagtttcaggaggttggtataatgtatctcagctgaaagcctcatagtccatcatctcaactggaaattctatataaaactttcaaacaatctcttaccttctctatatcgcacatacttaagtagagaaaaataaactttctttcccttccaattattttaaaattcaattatggcaaccaaattgaaaataaccaatgaattctatgttctaatattgtcaaattgctttgcaatcatcaatattaagatttaagaaaagcaaacaagtagagagtattagaatacctgaagttgagtataattagatgccaagtatgaaggaatgtttgtaaacaaaatgctgctaacagcataaaataattggcattttcaatagaaggctttgacattggctggttttcagataatagatatgattccctgtttgtgtattaatagagggttagattagccaggacttgctaatgggaaaataaaacacacaacacaaatattttgagatggatagtgttatggggttggctgggtaagaatagatgacaaagagtggaataattttcctttaatataatttagagacatcctatatttggagaatgagtctgtctgcacagtgtctaaaagtccaccatcactatggtatcaggtggtgtgactatggatatgatttatatgtaaagtggctgaagggaacaggactaagaatggtggtcagcacaattttaggtaaagttgagtgagatagtaaaaactgtaggaaaaaaaacagtatcagggaaatggatcaagttattgaagagatattccaatattattttgaagtaaatatcaatgatcagattatttataatattgcagaaggtgtgttacaaaaggaaattacatagatttttgtttgcttcttgtagccatcttatcaaaggaagaaactctcagagacatataaccctctggatatatagaaacaacacaaactcttgtataacactccagtgaaatatttatagcacatacatgtcaaaaaatagggcaatttatgggatagaggaagagtagcttttagactaaatggtgaattcggccccagaatcctcctctgcttcccctgcctgttgctagccccttgacatcttccttttctgtttcttcctccatctgaaaaacaatctttacaaaaaggctttgggcagggcactgtggccgacagatgtaatctcagcattttgggaggctgaggtgggatgagagatagcttgaggtcgggagtccgagatgagcctgggcaacatagcaatactctgtctctacaaaaatttaaaaaattagctgggtgtggtggcatactcctgtagtcccaactccttgggaggctgaggcaggagaatcatttgagcccaggagtttgaggctacagggagctgtaacgatgccactgaactccatcttgagtgacagagtaaaatcctctcgaaagaaagaaagaaagaaagaaagaaagaaagaaagaaagaaagaaagaaagaaagaaagaaagagaaagaaagaaagaaagaaagaaggaaagaaagaaagaaagaaggaaagaaagaaagaaagaaggaaagaaagaaagaaagaaagaaagaaagaaagaaagaaagaaagaaagaaagaaagaaagacacaaaaggcactgtatacagtcttacttttaacatttaaatttaccagagggagatgaaaatagtaacataattccaaatgtcttatatttgtctttcctatttccatccaacactatgtacaaggtaaaaggttttcagtcagatgtctacttacctagggccaagaaagctaagttctaatctagattctgtctttgatacactgggagcttatttccaatagcctcatttgccataattttgccttggttatgaagagagtgaaggcattaagaaagacatgcaaatctgcagtgaacattcaaggactagcaccttgtctcccatatgttcagcctaattccgcctctcatcagctgctgaaataacctcatatttgcctcttttcagacactagtcaatgtgttcttttagcccagggaagaaattcttctaaataaatcctgacacctattcagacctattgatggcaaatattacctcttctaggataccctcaaatagactgaactcttctcctttggatttttgaaaattatttgagtgaacaattctaagtgctctggttacattttgttatataaggctactcattttacttttttcacactaaggtttatgatggaagtaattgagttttttaagcttagtgtttgtgtcattcacagggcatgaaatgttgccttacacatatatgtgcacaaggcaggagtaataacttgaacagggaggaggacgagaatgagaaggttggagatgaaacacttgcccggcctgatagctccctgatgcctcccattggtcccaggggtccaccagtaggaaaatctgttactgtatttacatcaaatacagattcttttttttttgagatggagtttgagttttgctcttgttgcccaggctggtgcgatcttggctcactgtaacctctgcctcccaggttcaaactgaggctaaactgaggcttgactgaggctggggtggctgttttctctggcttatgtggtgggaaaggacttccctgctagaagaaacctccaaacccgtaagacccttctctgagaggggagaaaagagtgggctcagtttacctaaagttaatcactgtgtgcccttcacagtcagtgctaacatataaacactaacaattttcataggatttattgttttcatcaggcatgtaactctctaatggccattctgagggatgccatgggagctcttaatcctgctggttctattccacaccctggactaccatgagatgttgaggggacataacaaggtacttcttccacttctgggtgttttttgtttttttttttttttgagacaaagtttcattctgtcgcctagtttgtagtgtagtgtagtggtgtgatctcagctcactgcaacctccatctcccaggttcaagtgattctcctgcctcagcctcccgtgcagctgggattacaggtaggtgccaccacacccagctaatttttgtattttcagtagagacggggtttcactatgttggccaggctggtctcgaactcctgaccagcctgccaacatggtgatccactcacctcggcctcccaaagtgctgggattacgggcataagccaccatgaccagcccaaatacagatttttacaccctgtggtagacagaatagtaccccccaccccacaacatatgtctatgtcttcatctcaggaacctgtgaatatgttaccatacgtggcacacaggacattgcagttattgttaaattgagactctttaaatgggatgatgatcatggattatcctagtgggcgtaatgtaatcacaagcacacttacaagagacaggtaccaggttgaaatgatgagctttgaagatggtggaagggactgcaggccaagtaatgtaggtggcctctggaagctagaaaaggcaagaaatggattcttccctagagtctccagaaagaatgcagctctgctgactcttgattttagcccatatgactcatttccgacttctgacctccagaactgtaagatcgtaaatttgcatcattttaagccattccatttgtggtaattttttttcatagtagccataggaaacaaatacagaccaggctcaagaactcatattctctggatggaacctacagctgccttttaagtaagctacagctacacagttgactattatgctcaacatttgagaccctcttctttaaaactgtattccctttctgtgcaatggaatttaactacccaatgttccagtccctaagtccaagtaaaattgagaccattattttcataaaatttatcatgtatgaatacaagagtgattaggaaagtagtataggcttctctcaaggccctccttccatattcaaatgtaaaactatgtttgaacaatggctttctatttcagactgaagggaattcccctaaaattcacaggttgaagccataacccccaatgtgactggtcttggagacagggcctttaaataagtaatgagggttaaatgatgccctaagggtggggccataatccaatatgactggtgtagttataaaaagagtcaaagatggccaggcgcggtggctcaagccacctaacccagcactgtgggaggccaaggcgggcggatcacgaggtcaggagatcgagaccatcctggctaacatggtgaaaccctgtctctactaaaaatacaaaaaaattagccgggtgtggtggttggcccctgtagaatggcgtgaacccgggaggcggagcttgcagtgagccaagatcacagcactgcattccagcctggatgacagagacagactcttgtctcaaaaaaaaaaaaaaaaaaaaaaagagtcaaagacacctggcatgtgtgtgtacagagaaaaggccatctgggaacacagaaagaagacaatcatttacaagctaaggggagaggccttagaagaaaccaaacctcctgacagcttgatcttgaacttccagcctccagaaccacaagaatataaatttcaattatttcaaccacccagtctgtgctcttttgttatggcagtcctaggaaacaaatacatgtttgtaacccaagttcctattatttctatttacctaaaagggttaatctaatagttaggatttccattacctgacactcatttaccactcattaagtaccacctaccatgctaaggtcttttcttctataatcctcccaacaattctacaaaggtgatattattttctctgttttacagattataacactgggactcagggaggttacacttggatacagaacatgtgcagacacacaagggagctacgactcaagccaatgtctgaaggatcccactctgatacacggcttccctcattactgccacttactgaactccagctatgtgccaggtatcatgagacaaatgggaggttgtattttgtctcaggagtattacccgtagctaaggaaggctgtcaggaagcaaggggtaaatttggtaactgggagtactatacacgaattgagtggatgaagatacatgtctacttctttattataattctagatcactaagcaacagtcacattattacctggattcaaaggctgtttccacagcaataacagtttaaacaaatgaaccaaaaaaaccataatgtggagcctaatggttaatctcaatgactacaagatgcctgcagtcatagtaagcatgtttcttatttacaatcctttcagaaagtaaatggaaaccatgtgaagatgggagtaagcctagaatttcagtaatatgtgtgaacctgtagcagggcatggcttccttaaatgctgctctgataccctgccacttgggagccagcagctttataaaggtaaacacagctgattggctttaactttcctggaatacatctgacatcccctttagccttcgagaccattaagattttggccaggtctttaaataggtcatttgatttcccccaggttttgacttctgatcatgaaagcccatcacatttgctagcttaaagcaatttttatttgtcactgtggagaaatggtatggtccagattttatgctgaatgtaggattctaaaaattgggtgtttatttcttgttttctcattgattcactatatttttgcaagtaatttaatctctgcatatctatttatcaattattagtctgggaaacataattttttgaaattcacaagctcctcaaaagaatatgaattcctctctgccccattattaataggcctcagaaatgttgtttctctcctctgagaccatactaattattactgtatcttgtttatgtaaataagactgtgtagtgctttaaaaaataataactagatacaagaagtcatttgaaaccttgaaatatggaaaggacgatgaaaaacagtaaatctgaccccacgattaatgatttgagcatcaaaaagtcaaaatagcacaatgattgtaggtttcttccagagtcttcaatctaaacatcagattatgaaccataatcaatattataaaatgttatttccaaattctagggtatattttcaaattactcttaatatggctttgatctatttggtatatcgttgttctcccactatcctagtgcctaaagttcaaagaaatgacacagtatgtaatcacaatgtaaaaaattacgagattattttaagatattttaaatgtaaattgtttcctttattgtttttggcaatagcaacattgttaagaatattaagtcctttggtttggttatagcatcaatacgaatccaagtgtgtagtgccttaatcagtttctaaatacttctaggttttcaaataaaaagcaatttgtataaatgaattgtcaaactgtctaatcctttcagttgtttataagtacttggacagttcaccatcaccacaaatcctacatttatcaaattaaaacacctttcttctaggcaagctattttctcctcatgaccccagtatctgccgctcttgacagtttttcaaaaacctggattgttttctcaactccttccttttcctgtcttgtattatcttcatcaggtgcaacatttaccaaatgatttctttgttccagatgatgtgctggatactaaaaatacagagaaaggaaaatacttggctcttggatttttcatatatttcactatacagaaagttactgagtcctcccagttttccctttcaaatgtctgtatcatgctgccatttcaacttgtctaaatcctcaccacctcatacatgtattaatgtaacatctacttcagagccaaatttattctttgccacttctatttctgtcccctatctctcattacttctaaaaataatgatgcacaccattgttattctaactttcctttgggcctttgtttttttatttctttgctcaaaagtcaataattattaatgtactatatcttacttcaataatcaatgcaaatggccaaataacgttgtgttcaataatacccaaaacgtcaattccagactttctagcttcttggtaccccattattcaccatcacaaagttgaattctcgttggctttgttcgtgttttttttttcgcagatctggaagagttgccatgctcttttgaatttacataaattcttaacatctccttagctgaggctcaagcttcaatatctaactagttccagcttcataggatacctatgtcttgaatatcaattaaatttctgggttttaatgcataatacaatacttttatgtagactaatattagtctttttcattttgcctatattatctcgatggaagaatccagtgaactgtccttccaggttatttaccatacacaaatgttggttgggtacaataggtacaaaacaaatagatacaaaataaatactttcccataatcatgaatcactgagtgaggttatacatgtttccgggtcttacacattgtggctataattacaggcaatatagatcactgaggcttaactagaaatgaaatttcatgtggtaaattcacaacattttccttttctaatttcccacttattttatctattctgttatttggatatcttgattggttcatgtttttacaccagtgactgttacaatatcccctctaattaaagtgtacattctcaaaaactttctttactccaccaacacctgagtttggttcacattaaacataaatttatgttgttaaaatgattgagacagagtttaactccacagcttttctttaacaggaaaaaatgcttctaaactgaacctacaaccttatggctgcatgccttggtttcggggttaccgttctagaaagaggacctgaagatgggtgtattgaaaaactggaacatggagaatgttttgctgtgagtgtgcatgtgtgtgcatgtggatgtgtgaataatgacaattacatattgtaatgatgatgtcaacatgtagtttaatcttaaaagatatataggcatttaccagaacataaaatgagagcaagtccagagacctgaagagtctgttattttacttgcctgacactctaccgttaagcatgttggatctagctcctcagttttacctgccatccagcatctgttaaattgttcccacccttttagtgttttgattatccccagtcatggtccctgttccaccagcagagaagctggaaagtttccatgcgataaataggcagcatgtcagccagggagcccaccctttttgctctttgacaagtgacacatgtcatctttctgacactactatcagctgcatttccatatgccatgcttcacatgacatttcaggcaacgccatgtcttcttttataaaagccttttgcagttttgttctgataaatgaacaaagagtgaaaataaaagatcagtaaaatagatggcttttaaactctcttcatttattataatccagaaaaatgtttgtggtaagttgtgtttaatcagtatacatagttttcactctctagataaaaacattcaacacaattttacatagtgctgccaataattttggttttgacttaggcatagagtaacttagatgcaaacagcagacggatgtggaaaaaaggtgaataattatttgtgcttcatatcaggctctaggagaatagctagggataacttggcaatactctgtttcagtattaagtgatgtgaagagatgaaactatgcaaacacaggtttgttgtaacatctgttaagctaaaaacacatcctaaagaattgtgttgattaaattacacattttcacagttctaaatgagcacctgttctgtccaattttagatgaccatgctccatttgctgtggtaataaaactcaaataataataaatacagtgtaaaactctgaccacaatatcccaatgctgatgtagatgattaagattgaacttcaaatcctacaacacttcaggataaatggcctaaagcaggaaccagtgtataattgcttttaagagttttgttagatatagaacaaatgtgagcttctatttttcagcacagattacaattaattctagtaattttaaaagcttttgaacaatagttaaaacattactttacaattatatgatatttaaatatcccttaaaatttcaatattactatcatgcaaagcatataacattaaaatgtaaaataaagtatatattttatatgaaactattaagtcatgtaataaataccattttagttaagatttatcttccaaactggagtaggaagaaaggaattatataattacaggcacagaagatagataattaatacctaaaaataacaaaattaggtacttatatagaacacttcacagcattaccaaacatacagtatcctacttgctttttgccatttcctcatctgtaaagtgggacaatcattgtacttacctcattgttttcacaaatgaaatgtgttcataaatgtaggcaaagtacccacagcagtgctaggcacataagaggcatcatgtaattgttagttattaatgttacctacataatatgtataacagggagaactgagtaagttcatataaagcactgatatggtttggatttgtgtctccaaatctcacgtggaattgtaatccccagtggttggaagaggggcctggtgggatcatggggacagatttcccctttgctgttctcataatagtgagccagttctcacaagatctgattgtttacaagtgtgtatgtagcacctcccccttctgtcttattcctgctccagccaggtaagacaagacatgtctgccttcccttccaccatgattggaagtttcctgaggcctccccagccatgctatctgtaaagtcggcagaattgtgagtcgattaaacctcttttctttataaattacccagtttcagctatttctttatagcagtgcaagaatggactaatataagcactttatgccttttacatagtaagagttcactgtgagtgctaactacctaagaagcaggtgacaggcattattactctcatttcccacatgaagaaactgatgattaaagatacaagcaaagcttccaaaggtcaaatgtcagtgctccaaagagagaagttaaaacttcacagtttgccgtttaaaatttctatggaatcttccatttttaacatgccttccccaacccctctatttatctttcctatttgtttctgtgaatattacgggtgacaatttatcttagtcaggaaatgtgctgctgctccaactgtggctctgcactcacattaaagagattgtttcatttttggtttctatggaaatgaaatttctgactttattgctgggtttggaaatgtttttctaggggttgacaaggttcttcttcacaaaaatgaaggagctgacctgggctttaggattgggaagttgttatttaacataatttgggtataaggaagggtctactacttcctagaaaattgatgtgctgcctctgaacattgcttgatttaagaaacaattttttcctactttatttttctgttagaaatatacatttaaaacatgttcctgtcttccatttcacctttcttccaaagagactttattttataaaaatcttccacatatttcatagcctattcatttctctaatacatcatgtattacctaggtaaggcatgatgttcgatagagcacaggagtccctaaaataatagtctgttgatttggtctcaatagaggaatattataatgtcatccttgagctgggaaacaagaaaccacctacaactaaacaaaatgtgtttttgagcaagcatctgcaaaaaaagagcaaatgaattagggagagcaaacaggaagacctaatctattcctgctgtgaaaatacaagttagaaaaaaaaaagccaataaaatacatactagttgcactatcagtcctcagagaaccaatgctcgtgttcacattgtctgtttttaaaagcctacagagcatctggcttctgaatctctgccactccagaactgaaatctccagggattttaatttctgaatttatttttaggtaatcagaagtacattatgtctagcacatttgttttctctaaccaaggctgatgctagttgaagtagaaaaattcaattcatgattaaggaatttggtcactggacactaatagagtgtcatgcatccaaaatcatgctcatgcagagccctgcttcacagaaggcgtttcttcttgattcagctatcttgatttggggcatggaagaaggatgcattttcaaggactaataaacccagttaccatgccctcatttttgttattcccaattttattagtaggaactgaagagagtgatgtaagagatttttttttttccttaaagaaactcaaagctgcactaaacctctgttcatgctctacaatccaaaatgtgtgtgctggcttaccatttgagaaaagtgcttattgtgtaagctttaaaccaaggtatgcaaaattggactcagttgtgatgtggaagagggagagcaaaattagctttcagcaaacacagaagaagattaagtttggattttttcaggcaaccacacctttttgtgctttgtaccactcatgatcttgtttgtctcttgctgttctcacgagttcatgtgttgaaattcagctttcttattttggaagttgcctcttatgatctggacatttttggtttcctactgcctatcctgtgtcctttgcctcctgtagggtccaatctttgacagatatgacttaatggatggtgtgattttgttgtgtccccacccaaatctcaccttgaattgtaataatccctacttgtcaagggtggagccaggtgaagataactgaatcatgtaggtggtttcccccatactcttcttgtggtaatgaataagtgtcacaagatctaatggttttataaatgggagttcccctgcacaagctctcttgcttgccatcatgtaagacgtgactttgctcctcattcaccttccatcatgattgtgaggcctccccatccatgtggaactgtgagtgcattaaacctatttcctttttaaattacccagtcttaggtgtgcctttattggcagtgtgagaacaggctaacacaatggataatgtcttttccatctaataggggaattttgctattccagtgtaactctgccctgatggagtaagatatttcgtctttctgtcctaatagactgtgctttatttagctggctcaacctcttacccgaagcaagagtctcttctagattacttgagagatatcaaagtgttaagaatgcaggatctgcgattagaccacctgagttcatatctcaggtctaacagttactacccatcatggggtgctcatttgaactgtctatgcttcacttttctcatctgtaaaactagaatcgcagtgtcaactgcataggattttgacgaggattcagtaagttaatacatgcaaagaatcattccagacaatgtgcagcccatagaaaaaatattcaataaatgttactttttaaaaaagagcttttccaggatttagtaaaccaaaccaagagtcaggaacaggaaaataatatatgaagtaatcatcatggagtaaatgacatttatccccaaataaagcccaagcttgctttactctttcttttcccacaagtcatgcccacccttgggccgtagtggatcctcctctagcctttaaaagaagtaagcaagctctgcaggttgagaaagtggcttgggctgcttagcttgggaaccaatgctgcctctcttcaactccaaagagcacctgcacagatgacacaggagggtcggtgcctcaaagaccatcccctaacaaaagatgtcagtgaaccctttgatgtccaccccagggcccagataaacagtttaacactgtgactgcaaacctgatctcatcttgcattctctctccttcactttccctcacttcacatcttctctctctgcccctctccagaaacagactctgtggaggtgcatgttctcttgccccagggaatggagcaggagggacaggagaatggagcagggagaatgcaaagcatgagggtggcagcagctctgggtgggtcaggtgccaggccctgggtgcagatcacctccttgtcctccggccaggtatgtccagctctagccgcagcttgtatgttctgaggggtcagaacctggctttaaggtatcgtatccactgacataaattatgaaacattggcttgcttgctactgtacatagataaagggtttctagttgagagatggaatggaggctttctggagcacacggaagtgttggctttggataaacagaacttttcttatggaagaagaccttgtcagtggcccatcgaagcccagctcccacatatttttatcagaaggaaattttcagaacagctcttcatgactgctccatgggcaaaagctatcaatccatttattgctgggctggattggagcgaggtgggaggtgacagagagaatgtgggatgttcaccctttggtgaaccttgttaggatgctttgcttctcactgtttagaaagacctacaggaatgccaattcctgtcattgaatctgtgtcttgagtgatgttgggtagaaattctgtctcacttcccaggcccacctaagtgtcagtcactggccttcactgggtgatctgcctaactatttcccctgaagggtgaaattacggtggtctctcagcatttaaccattctgtgtggttctgcttcttccattttactatgttctctattgtaaacctcatatatcttcttgtttgggtttattccaagtttgctagacttggaagtttctaactggttctttattggtctgtgtaatcctttgtcccattttttgtcttcattcagaggtaactcactctggccatggatgtgtttgtgcttgaggtctctctcaggctctctatgataccaggaaaaaagagggtgtgtgaagaaaatgtgggcagcagattgggacccagagtttcttgaattggttacaaagccctggctctctctggccctttctctgtattgtatactatttggtggttatccatatatatatatacacatatatgtatgttttatatatatatatgtatgttttatatacatatatatgttttatatatatatgtaattatttgctccctctgaattcaggagagtgtggaaggaaggaaataccatgtttgcattgctcatcctcccctgtctattttctgggacattagtgctccaatgttatttttaaatagcactagattttaggaagtatatatatatataatataatataatatattatatatatggatatatatttttatatgtaatataatatattatattatatataatataatatatatacttcctaaaattatatatatatattatatatatagacagagaaccacaatatgcttatatatatagagcgagagagaaccacggtatacttctgggcatcttcctgacactgatcttacctctggtttctatcacccaatcaaataagtccacattacaatttcacatgacaggttttcacgccctcaatgctgattaccacacgccactgctaactctactggctaaatggctcctctcataacatgattttggatgcgtaacctttgcagacaccttctttggtggagctctggtcactgatgggctcattttctttcaaaggggatgaaccacgcagatatgcaatggagcagcattaacccaaacctgagaaggtttcaccggaggaggaagccatgattttcatttccttcaaagactgagcattgaaggaaattgaatcatacaatgagttagtcctttccaattcttttgattatatcaagaagcaaccttcagtttagtgctatctttctactactggcaaacacatttccagccaagatccagggaacctcaggctcagagccttaggtaggaatatctggcaggaatttagggtcattgcctcatttcaatttacagtaaggacacaaggtttcttttaaaaataaatatattcaagatatttgaaaagtcagtaacttaacaaaaaaagtattatttagcagagtctcaaattttttaaaaatggcatttaaatgcctgaaattaggaaagactttagtaggaaattccagaaacattcttttcctatcaatattaagcaataggagagctgcaagtgttgatatgcaggggaggatttgttaacctatgtgagatcaggagataaagtgtaagaggaagggggaaagatgagctgaagttaactagccacatgtttgtgtggcagaaagatggcatgaaagtcagctggcaggaggaaggaatgcagggagatgagccagaccacaatcacggtggggacaggtaagaaggcaaatccatggagcagccctagagccaagagatttcctttctgaatctaaacatctgtgtacattttcttttcctaaataaaatggtaaatttacggttaaaaaaaaaaacccttaaggcacacattaaacattagatctttcataactccaacatcccaaaatagccaatgttaacattttgtacatttctttttggtttcttaatgaagatggtggtaacaccaataaatatcttccctccatagacgtattgcagattttcttttgatgataaagttaaaatatttttctagacatttctccctaaaataaatctgaagttaagaaacacttggcagaaatttatacttgtcaaatgactcatttgtctctgtataaaagagaactttatcaatatatttaatcacataaataatgtgttctaaaagtactatttttcttcattttgatatttttgcagaatgttgattgtggaataaatgtttaataatataacttcccagaatgtttacatgatatttcatatcaggtgggccataattcaatttttccttctttttcatcaattcaaatatttcaggatgtcaagcttgaaataaatttgtgggactatacagttttttcaatgagaagactacagaacctatagtaactaaaccctactagatagttatatggaaaaattcaggttttctataaagtagtgggttcttcttttaaaagttgactaataaaatatcttaaaataagttatctagttaaaggcattttaaaaatgtttcacacttatttatcttattcacttaaactgggctcacagcgtttttgtttgtttgttttgttttgtttttgtttttgtttttgtttttctgagatgaccaggcagactttttaaaaaaacatgttagcttcctcagtgctgcttctgttattgaaattaccagttattatcattttgttgcagacgaagatggctatgtactttcttgcatattttcaggaatagatcattcaagaaatatatcattcaagaaatgcttttttattacataactttttggaatttcatgtaacttctatcttgttaccttgaaacctactaaattgtttttgtagcatacaaaatgtgctttacaaaaaaattagtatttaattatatcaaaagatgaacaatctaacatttggcatatctaacgatggagccctatctagctaagttaggcactacaatactagaatgtaaatgatttatttgcaactaaattttgttacgaaagctccttattcttcattttctccttttctccagtttacattaaatattctcagaatccctgagggcacacagggagaactggatgcctgaactactatcattaaaattaggtcctgatatcaagtatagtgtgactgagtatacattagaaataccccctggacattgaacaatttttaaccactaatttttacatacagtcattttctgaaattattctgaagggaaaaataagctgaattctggacttcagcagaacataacacagggcaggtaaatttgatagaaaagtaataagaaaaataagatgagaacaaggtgtttgtggagagacaagtctatgtgtggcttccctgtggatttataaaaatgaaaactacttcagctggaaaaaacctctaagggagaaagacacaaactccccttttagatgccttaccagtacttcaggtgtctaaagtccagaaattatggtgtgacagtagattgtgatagaacatgaatcaaaacctgtcctcattttgaaattcaaggacaccacttcaggatgatgggagacaatcaaaaagggataaattaagatacgttgggaggaatggtaaagtagcacttcaactccctttcttctatgtaaataatggaaataatgtgtggtttatcattcagcagtaaagagaaaaggaattatagggaaaagagaatgttcaactgccagtgtgtagaagagtatctaagtgtaagtaaaatactcctaaccaacaaagcaacagattgaaacatcactagagaaagaaatatcattcgaaactgaatttgaaaagcagaattatattttttcattgactaaaaacatttcatctacttgacagtgtttttgtcaagactcctgtttctcctgtggttaatatttgcaaagcaccttgtgctttttggtaggaaggattgataagtgaaaactaaatctatgtctgaataaataactttaaaaagtacaagcttcaattttaagacctagcttcgttaagaaaaagtattcttgcttttgagatttaaattatgcaagtaagtgctatttggctacaattcatcactagcacaaaacacagaagtttttttttactgagccaggcaacactgtctgctggtttccaaacatggatgggtatcagagctccagggaggcgggaagtgcttttaaaatacatatattttcaggttccactccaaatgaatttctataagattctggaaactgtcaggtttacaaagttctccaggtgtttaggtggagcagacaggttggggatttagaggtggagtccatccttaactttgaatacccacatcatacctgttctctatgcatgaggtagcagtagagcttattgtagagaactttcatctctatctccagttgtaggataaactgagtacagacttaaggtatcaatttcaacctcaaattatcctctgagacaaaacaatgatttgtaatttttaaaatctccaattatattatgaacttctttatataacaatttctattttattaattttggtatcataagcctttagaacaagctttggataaatccagacaaatatagtatcacttattcatagaacaagtatacaatggtaaataaagtgataagaaccctttcctggtagagcctagattctagtgaaagggacatcaataaactcagaagcaaataaatacccaggatagttgagaatgctttcaattttgatatgattaaaattcttagttcttctaaatttagtcagctctacaagccatttatttcatgtcttcaagaacttcatttagttacatgcttggcaactgttcattgaatgcccaccaggctctgagcaccactggcgagcagcagacctatagcctgccctcatggagcgcacagttaatctagcagggtgcaggcaataataaaatagttttacaaatagataactacaaattgtgagaagtgctttgaaggcaaacctactggagtcatgaaatcacatagcagactgggcagggtctagtcacagagagagcaggaaaggcctctgtgcaatcaactctgaaatgagacctaagcataagagtaactacgtgaaaatgaagtaaaaatgcattcctctgaaggtgagttacggctggaggactaggaaggcattgaagtgggcaaaagtatggctaggagtgaggtcagggatgggctgaccctaagcatagtggaagccatggctgggtttttatcacaagagttacaggaccagatttgcatttgatgtcaatggaggacaggctgaagagcaaagcaaggacagattcagatgggtttatgcaaagcatcacattaatggataaagcctcattacttccaaggccacctttcactgtgatctagtgtataaaattaaagtcctggcattttccacaccaaaatggaataattaagaaacaggaaagttaaattaaaggaagaaatataaaagagtaatttatatgccatcacttgggccaatggcttctatcaattacttttaaatatattttccattttgaattttaatttctagctgtatattccttttttggaacctttaacatttcatttttctgacttaagaaagaaatagacttataaaggaccatttacaactgtaagggttgtagataatgtttctttggctatctttcaacaggtgaaagttagtttcagcttatcccaatcagataaaatttctatttgtacctttcaaatgcaatttcaaaagtattcaataaagtagtcattgaatatcagtgattcaagaagtcttgccttcagcatttgacaaaagagcaaagaaaacctaaaataccaactttgctggatgacatttacatgtcaagcttccttttcttgactgttgaaaaatgttattttattacaaatttgattacatttgatcttgttttgactgtctacaaagaatgtctctctgctaatgccagtaaaagcacaaataaattggaagggcatcacctcctagaattactaacaaatgccaagccaatccatattatcaccagtgttggtttcaagaaaagaagtacttcaatggctgcctttaatttcattttcttgtgcttttagaggaggagagatttaaatgccagaccatcatttacatagaagagttttaagctggcaataacattacctcaagcaggaaggaacctggagacagactacaaactattctctggctacctcaaatcttgttgaatatttagcctggctgacattacttttgtctttcaatttcctctgtcatttgtgcttttttctaacatggtacctgtctgcctggaatggtctgctgctcttttactcctttaaatgacttctgaaaactaaactcttgcaaacaaacaaaacaaaacagcaacaacaacaaaaacacctgttttgcccatttgaatctattttgcgcatggcttgcacaattcccttcacactatattctccttttccttacgtttgttccacttgtggaaaggatagtaacagtgttgacagtccataatatgttcaggtcacagtctgtcttcattattttgggtttattaaaattttcacaaggcacatcccatggcatcaaagtaatagcaataatgccagctggtttgcaggcaggggtctatgaggagggcttactgttaatgggtatagcagtggctttgttctatgctttgctttgcttatttacaggtgtagcttttaattgagatgatcaatgttttaaagtcatgaataatcaatttcacttatatattcatttattcactcattcatgtactcatccaagtatttgctcagtatattttacaatcagcactgtgctagactcttaagataaaatgctaggcacataagacaaggttcctaactgcctagagtttgctctagtggggaggggggccatggtaggtattaattaaacaatctcactgataaatatataattacacattgagagaagtatttggaaagatgggaacaccatggttccataagcccaggtaacaaaaaaatttaagtaggctgctgggaaggtgaggagaaagaatccagagaaggatattttcctcaggaaatgacaaaggtgagatctaagaaaaaggcaaagggggaccagagagttggaagtgtgttttagacagagggtatagcatgtgcaaaggtcatcttgcagggaatacacctctctcaaggaactaaaagaaggccaatgccaaagtgactgcagtcagcagtaagagagatgatggtgtgagatcatcactagactgaggcaggcatggggtcaagtcagaaggcccagtgggccttgttgaagactgggtcttcatccgactacaaaacattaaaaaaatgttatactgatggaagtataagtgaagaagcatcaaactgactttttgaaaagaaccttttggctagagtatgcagattggagtcaccctgaatgctaacatttggtataactcatttagaatgaggaatggaatgttgcttcttttcatgcctgaactctttcaaaatcagactgtgatgttaatggggactaagctctgattttttttatcttccccaaattcctatctaaggggtctggggattcatgccctacaaaatataacttcttgttagatgggttttatttaactctatgtatcgtgacttgctttccaatctgattctgccataacattatgtaacaaagaagaaaatcaaaatattttaccccaaaacatgtttctttgccatattttgagataaccctataaaactgtcttttgtgggggaaaatttgcatctgtaaagaatcagtatgctgttaaagaactagatctttttcttccaggccctcccaatcctgaacagattatctgaaaatctagcaccttttaaaaggtctgaataggaaacctttgtcacctattgtctctaagggcagccactagaagacttcaatagaaccttggtctccacaatcttttatcttaacctgaacatttcctttcttttgatcccaggtctttagacaaactcaaccaattgtcaaccagaaaatgtttaaatttacctataacctggaagctcctgcttcaaattgccccacctttctggaccaaatatgtatctctcaaacatatttgattgatgtctcatgcctccctaaaatgtataaaaccaagctgtaccctgaccaccttaggcacatgttttcaggacctcttgatggctgtgtccctggtaatggtcactcatatttggctcagaataaatatcttcaaatattttacagagtttgattattttcattgacaataatttggcatccaacatagggcctcagagaagtctcagaaccccaaagaagttgcccaaactcagagctaaggtaccagcaggggcccattgaagcctacccaacttaatgcttctcttctggtagaactgctaagtcctcctgagtcctggaactcccttcggttgacagtccttgatttattctgagctggtttttctcctaggaagttgttgctaaaggatcctaattctagttcaaagatgcattctaaagggtcttctctgttgctttttctccaaaaattaatctcaattggcttgtctgtgcgcatttgcatgagaaactgaactgttgttttcatatgtaaataagagactaagtttcctcagctctgaagagaaaggacatttttctcctcccagccaaaaggcacccttaggtgactggggaccttatggcagtgtctgggggattgacacctcacaacatgcagtggccctaccgggaaattcccaacaaaaattaatttaaaaaaaagtcttgtctaggaaacgcatataagggctgatcacccagtgttttgagccctctcagaggtaacagaccactggagagagaaactgagacatgtaagagggtggaaatgactcaatggtgacacactatggagtcttgcctgtaagcagcacacattgatccaccagacaaaattcctaggccacatctcagatcctccttttaagaaaaaaaaaaaaaaagtaggaaacaaataatcaacaaataaggcaagaacaagcagaatgaccccctttcaagcattctgtatgttttatggcacatctccttgccagagtttgtataaaatggaagtaatatggtctttgtgcacatttacattaaggtaaagagccctaagtttgacttgccaactatagggatcctaagtattctttttctctattttcttttctgactgcttcaaatctactgttgcttttctactgagataaaaaccactgtgtgtatctaacaagtttttttttttttttttttttgcaagctagttaatttgtatttatgtcatggctaaagttctgaagtaaatgctacagaatctttgtgtgagtgtgtgtgtgtgtgtgtgtgtgtgtgtgtgtgtgtatttaaaagacctttataaattctataattttatgtttaattggcagttaaattggttttaatttccccttggcacgccagactttttctctccataccatatgatataaattttgctatttgattttcacctgaggtagtttcctttaaatacaaatttagggctatttagctgacaattgcctaggatggtgaaacaggttattaagaatttagaagtctaagaaagaaaagaagttttaaaaatcataacatgtacttctatcagcatgcctaatacatctatgtatttatgtgttgtgtacacaacgtttcactactaaaaatacataaaagagctctaattaattggcttaaaaaataaaagtgcttaaatcagatactttaaaaaaagactagtcaaatgctttttccaagttcacgtgacttaagaaaaatctttaataaataattggctttaaagttattggtaaaatgatattaaaaatgtcctaagaattgtttgcatttttttgcatttattggtcatgtggttttatgtattcctgcagaatactataagattgaccataagggttataaaactagaaagcccatccgaaaacagaataatcttagctttcgtatgcttatgaaatattgttggcttaatgaaaatagtcaaatcctgagctattggtataaataccctaaatttaaccataagttttattacttaatacttgaaattcacagctataaaaatggttaatagaaaaataaatttaaatatttgctatcattgtttttgtaaataatctaggtaaactattaaagcaatcaggtaaatggaataaatgcttgaaacaaatgtcataatttagaatctaattttattaattgatattaagtatctagataatttccaatttaaaagttataggaaaatattttttaatgttcttattaaatatctttgtctaattcaaagtttatttaaggttttataccttttaccttgtttatacatgttatacaaggttatacaggttatacaaggtatacacaagttaaaaggaaccaggaaataaaagatgtaaagaaagttaaatctataaagaagtatgttggtgaagaagataaaaaggaaagtaattttatataagaaaggatctcatgcggtaaatttctgtcctaaaataaaatgactagattgttaaagagagagggatatttaggacaaaacagaaagtctaagcatgttgcgaatggtctatgtaagtcatcataaggaattttttaaggggttgtataattcatttggctatgggaggatcacctgaggtcaggagtttgagaccagcctggccaacatggtgaaaccttgtctctactaaaaatacaaaaaaaattagcctggcatggtggtgtatgcctgtagtctcagctactcgggaggctgaggcagaagaatgtcttgaacccaggagacagaggttgcgggtgagctgagatcacatcactgtgcttcaacctgcatgacagagtgagactcagtctcaaaaaaaaaaaaaaaaagaagaagaagaaattataatagcctttatacagatgggtcttttatattaaaaatacacactaatacaaaactaactaattggtttaaacaagattttattacaaatattaacttatttttaatgcgagaagtttttaaatttttaaattctataatctgtctctttaacattcttcagactgatatttcagaagttctgttctttctctttcgaaaaggccttggagcatagctctctcccttcactttttgttggctcctataatgtttactaattatctaaagtaacagaattttctttcaaaaacaggcaaataaagtatcttttggacatgtctttttattctgcatgctgttatatctctatctttatatgtgtcatgtgaaagtgatatttcactaccaaactaaattaaaggtctctaatcaagtaacttacttaagaaggtacttatcagattggtagaagctagctcagatgccttttaattcacatgaccttggtaatctttggtaaaattaatttggtaaatttcatctcaaaaccctccagtaatttaaaatcttatagtcatgttaaaccctctggttccccatcccccaccactggaaatttatgttactgaaaagttaaaatagtaggaaaataaaatatgttttcggtaaagtttataaaactcaaggatgttgatttttctttaaaaaagtgaatctaggttttttcctctagttaaaaaactacttaagtgttgctttaaaataaagaaaaaatcatacagataaaacaaaataaaagaaacaattaagcttgggcaacaaaagttaattctaagccccatggttaccaagagagtagttgatatgagggaagtgtaaaaccaagcaactgtcaaaaaccaaatggtataatataaaggaattgttccattttgtagattgttatcatcagcttcttaaaaaatctttactatagtgagttgtaaaaataacccctttaagaacaaaattctcaattttaaatgctagagaatttaagagtttatgcaagacccacagctcactcctgaacaatcactaataattacatgtaatccaaatgcacaggaaattagtccaaagagaatgatcatcctagtaaagtggatacatgccactgtaaggtctgtcctgagaaagggtcttcccaactctccctataaaataccgagtgaagcacaccagatgaagcagttaatatgcttcatatgcaagccatatcagacaggctttatgataactggtatatcctcccatcaaatatgcctattacccaggtcacagtaagtctggggctaagggggccccttttacattggtgccccttccacagaatcataggattatttaggaagccttatcaaatttgctgtctctcataggtcttacagatgcaactccctactgggaatcccaaactccttttcaccagaaaaggtaaaatggtctgaaggttaaaaagggttcctgggatcagaacataaaaacatacaggttaattataaaattatataattataattataaaaattaagatatttaaacaagctttacataaggtagttgtaacccctttacctaaatgtcttatgaaaatgggtaatgcatctgactggggatgttacccctttccagtactataaaactgaaggcaagtaaatctgctcttttaggaaatgttaactgaacacactaaatgggaactagtaaaattgcctgagcccacaaagtatagggtaaaagctggagtgctagtcgggacaaatcctccagtgcatggccctttgtgctgagcgtttattggggctgatgccaaaaataaactgtacttttcgataacaatgactgaactagagaatttccacttggtggggcatttactgccttgtgatggaatgttatccgaagctacccctatgctaatggaaataatattttccagaagagttctgtgacaaaaaaaaatattatgtaaaatcttgctaactgataagcagaaagcctctttcctagaactaattatgaggagctgccaaattctacagtgtctgatagacagctctcctgagctgtttggtttgcaaatggtattttcaaggtaaacaaacatcttgtttaaaagctgctgctctggtaaaagaagggtcaagaaaatcttttaagttatttgggtgaagtatgtttttataagcaaacttatctttctaagttctctaaaattcagatcgcaattttatgacaatatagttgtttgcgtaagttcgatataagttttaaaacaaaacaattagagacactggttattttatcgaggcttagactagaatacactatttttaaataaagttccagcaaagccaatttaaaaggagtttatatggtcaattaattcttgctgcattttatgcaaataatcaggcaagcataataagcctaaaacttaccttgcacactaattggtcttgctataatttatctttaatagaaaaaaaaaagcagctcaagaaattgtttcaaaggaaaagcataacacatagtgttagattttagccctaagttgttttttcgatcacagattgaataattattcttggctacaataatcctctagagagcaccagattataatttttcatcatatttttacttggtggcctaacggaatgggttcctttttctattctgacacacaaattactcttaaaattgtcaaactatacttccaaggaaaccaaaatcatggtgttctgaagaccagagataggaatctgccttatttggcatcccactgggcctagatgtgtttcactacaaatgctctgatgctaaaactatacaagcaccctccctctaggcccagggactatcgaggaagaggtgagtgcgtgaaattttaagggctgattttgagggataaaattaggtcaaggtcaaaccctgcaaatcaagaagggatacaaagatgcctaaacagctggtaagacaagtttagttgccttctaaactattatgtgtcacctttgcatccactccaaccataaggaattttctacttactatagaattaaaggaaaatatttactaacaggataaaaataccttgcaacaaagcctcctgggtatttatcccaattatgagttgtgaagagaaatatatttttatctagatacatattttaaaattcttttgcagaacaatgcttatgttttctatagctaattgctgtaagcctgtaacacaaaccaaacttacagtagctcaacacatagaagttaaaaataagtcagtcttataactttgacttttggttttgttcattggctttttacttaaaataataattttaagaggtgatgaatacctgtccacatccattcctatctggcctagaataattaactgactataagtccctctgccatagggagtcctgccaagggacaaaaaacaaaacaaaacaaaacaaaaaaaacactgtagagttatatgacttctcctgtgacaaaacctccttttctctccccaaaacatcagtatagggtacaatacaaaagcagtgagaaaaatagatttgtctactgataacaagtcctatgacgatttatttatgtatatattttttgagacagggtcttactcattgtccaggctggagtgcagtggctcaatctcagatcacgataacctctgcctcccaggttcaagtgattctcctgcctcagcctctcaagtagctgggattacaggcacctgccaccattcctggctaatttttgtatttagtagagatggggtttcaccatgttggccaggctggttgccaactcctgacctcaagtgatctgcctgcctcagcctcccaaagtgctaggattacaggtttcagccaccaaaccaggccctttatgacaatttagacactgaggatcaggtgtttcttggatttgatttataacctcctcaggatgtcatacctatggagataaattagcctgaagagagattaaatttgttgaattctgatttaatgctggtcctacaatcctcaaataagatttatgataaggtttaaataaccctgataaggaaggtaaacacactgtgagtctgatcaaagaatataaggatgcaagcagggattattttttggctgcttgggttgtttactgccctctgatttcacttataaccttcttggatgcctaatcttgactatctttttgatatttgttactatattagcattttatatctcttgtaagtgttatgtcagactcagcaaaatgaaaaaaggcacaattgaagactcagatcatgatagctcacaaaatacatctgatccaggattttttcttcttttttttagactaaaccctaggcctgactccatctcaccccttacacaattggctattacatcaggtcagggcatgtcctcctgccattatccaaattgctgctgtttaaaacgattaccatcaaatcagacaactctagaaatgagccttcctagcaccctgagacctgctgctgtttattggcctgcccatgcattctatggaatgtttttggccaagaggggagactgaggactaagctctgatttttttttaccttgcccaaattcctatgtaaggggtctggggagtcatgccttacaaaccatgaattctcatctggcaggttttatttaaccgtatgtattgtgacttactttccaatctgactctggcataacattatgtaacatagaagaaaatcaaaatattttaccccaaaacatatatctttgccatattttgaggtggccctgcaaagctgtcttttgtgggggaaaatttgtatctgtaaagaatcactattctgttaaagaactagatcttttttttccaggccctcccaatactgaagagattaaccgagagtctagcacctttaaaaagggctggagaggaaatatttgtcatctattgtctctaagggcagccactagaagacttcaatagaaccttggtctccacagtcttttaccctgaacatttccttttttttgatcccaggtctttagacaaagtcaaccagttgtcaaccagaaaatgtttacatttacctagagcttgaaagttcccccaccttgacacattgaattgccctgcctttctggaccaaaccaatgtatttctcaaatgtatttgattgatgtctcatgcctccctaaaatgtataaaacaaacctgcaccccgaccatcttgggcacatgttctcaggacctcctaagggatatgtcacagcccatggtcactcatatttggctcagaataaatctcttcaaagattttacagcatttgactgtgttcctctaaattagtaagccaaacacccatgtaagttttgtattaaattttcctattttgataacagtatctactaaatttcctacatgaaaaacctctcttgtttctaaaaatcagaatgtttaggaactcagagtcttatttttaaatcatagccacaataaatatttacacactgaacagcatcttgtagattttacaaagcattaggataagtggttttcttaagtgttttttttgtttgttttttgttttttttttttaattctcagtgcatttaagcttaactgatggacatatttactggtgagtattgaaatagattaacatcttttaagtgccaaaaggcaaaaccaccgctttttatatgtgctgtactaatagagatcctctgacttttgaaagcttacccactgcaatcaaagccctagacactctttaagcatccagttcacactactcagcttttaaaaaaaccctctagtgaatttgctaagccatgcagttctgggatccaaatgagtgagtgtgattcaatctgcatttccatattcaaaataatacaaaaaagtctaaaggagcaaagatatttaggactacaaacacatacattttaataacaatagataaaaaagaaaaatcagatccatggccaacctgccatgaccaaaatttagaaggccagattttcactcttccagctgacaacataattagcacccacaattgccacagacacatatttcctgtagtgttttaatttttattattatatcacagttttcttcttaaataacacaatactaaattataaactcatgtctcattcaactttcagacaggatcatagcttacttttttacaaggcagagttgaatatttacagaaatatacatattacaaattttataatctcccaaaataagctattacagattctctataaatgaggagcaatattagcagaggaggtaactacaatcacatcaaaggcaggtaacaaactcattgtttgaccaaaatggaatgcttgttctatgtttttgcttgattattagaacagacttaaaacaaccatgtagggaaaaatctttgttggtttgaatctcaaaaaaatttttgaaatataattattagaaaacattgaagtcttaccaagtatataacctagaggtaacttttcagacatctttgcatgtggtaggcagaactctaaggtggccccaacattcccatgccttgaatgtgggtgggactgtggatataatgagatagtcacttatcagtcccagattagcttacatcatatagcaaagggagagtcactccatgatcagattacattgtatgagaccgacttgacccactgaagagagagattgtcctctagcttcaaagaaaactgtcagggaacacgacagcccataagaaggcagggaccctgagttctacaactaaaggaagaaaattctgtcaacagtcggtgaatgtggaggaagatcccaacgcctcaaatgagatagaaaccttctccaacaccttgatttcagcctgatgagaccctgggcagagaactcagctaaccagtgtctagactctcaacccgtggaaattgtgaaatagtaaatttatattgtcttaatgtggtaatttgttgggcagcagtaaaatccaattcactcaaaagaaggtttgtgttatctaaaattccacaatgtctccattaaatacaaaacaaacaaggtggggggaaaaatccttatctttagcaaatgaaaatatggttagataattcagtttaaatttctcaaaatttgcattttactcgagggaatcagtaagactaatttttttttcatagctctaataaggataggtagaggttttctgataatataaataatagaggctagtaatatagagcatgcacggtacagaaaagaaagatcagtgaaatcagtacatgagacctagtaccagctaggccaccaatagctgtgtgatcttaggaactcacgtaatttttttgaatctcagagtcctcataattaaggggaaggtatactactcctcaggagtctgtgtattaataagctctttgaggtgatttccaggcttgttgaagtttgagaagctttattttatatgttcaagaggtttgcacatttttgttccaatttaataccttactatacatgcagatacaggctttatagggtctttgtttatataattttgtgggggttgaggaagggttcaaactagtttcatgagattcagagaaaatcctttttcgcctccttttgttttagttccttattcacatccatctaattccaaaatccttgaaatagcccctccactcctctgattcttctgcctctctactgatacttccctatcacagctgaaaacagtcacctttttccttcttaatatgagagtaaactaacaccccccaaaaatggcaaaaaaaaaaaaaaaaaaaaactccaggcaaaacatcaaaataaaaaagtaaaatacttcctttaaatatacatttcctttcatttttagactgacttctttctacttcataactgttaatttcttccaagtgttgcctaaacatactatttctttttttgtttcacccctggtttacttttcaattcattgttacgtggtgaaataagtaccctcacaaaggaaacaacctcctcctgctaaatctgtccctatgttgctgaatctttcagcagcatttaacactctttatccccagtgacactttttttttaggaagaatttaaaacataaagtttaaatcatacaatgattacatttatgcccaccactgttgggaacagtccccccaaaatctggccataaactggccccaaaactggccataaacaaaatctctgcagcactgtgacatgttcatgatggccatgacacccatgctggaaggttgtgggtttaacggaatgagggcaaggaacacccggcctgcccagggtggtaaaccgcttaaaggcgttcttaaaccacaaacaatagcatgaacgatctgtgccttaagggcatgttcctgctgcagataactagggagacccatacctttatttcggcccatcccttcgtttcccataagggatacttctagttaatcgaatatctatagaaacaatgctaatgactggcttgttaataaatatgtgggtaaatctctgttcggggctctcagctctgaaggctgtgagacccctgatttcctactttatacctctatatttctgtgtgtgtgtctttaattcctctagccctgctgggttagggtatcccaaccgagctggtctcggcacaccacctagattcttcagtaatctttgcgaccttgccatttgctgtgtctagcatatattttgctaaatgattgtgtaggtaaattgtgaatatcatgtcatgcacacaccttcaaatgttagtacttcagcttgtactttctaagcataatgacattttcccataacacaaagcgttatacagtacatattcatatttcctaattgtccctgaaaggtctttagctattttacttcttgtataagctcatactcaggtatcagacagtgcattttgttgttatgttctttaaactcttataatcttgagttcctcactgtcttccatgatgactttgacctgttaaacagtgtaggtcagttgcctttggaatggcccacatttcatttcatcctgttttcacacattattcttctaatccctgaatttgctataaacaggagatacagtttaaacattctttggagacaatttcttcataggtgatactgattgtttcatattacaccctggcagtaggcccctaagtcagatggaccctctattagtgacgttcagtttggtcatttggtgacagtaatgtctgccaggtttttctttctaaagatagatatatatatatatatatatatatatatatatatatatatatataaattttttttccctttgcaacttgtggagtgatattttaatatgtgcaaataatcttttgcctagtggtattagcggccattgttgagcccttgcctgaatcagcatttcactggggttgaagaatggtcccttccttctcgaaaagctttctacccttggcatcagcaatatcacaagatctttgtctatgtttatatttccccttatattctggtccctttgcaagctcctttgcttttgctcctccataaatgttggtattcctcagggttcttcctgtgagctggaccgttttcagttacggttggtactcattaaatatcttgagaaagggaaatttggaatgtgcattttaatagaattagaaaaaaatcatttctccattgccattttaaggtttatttcagcattcagggcaactgatctccaaaattaccaaccatatggttagttctttggaatgtcatagttctaaatatttaactatatagattttcaaggactgcttttactaccatgaagactttaaagcagcatttaacatttgtatcaacacagaagatggagaagacatagtctcactggcagcgcaaaaccttgtcctgtgcatggtcacacgctcagccaccagggcaggctcagctggctttcaatatgtgtgaatgccttgctgaggtatctctaaaggagatactttatgtttccttattttcatattttattatttccatgtgttaaaaaaaaatgtacatgggtagtttatcaaagaatcatatagcagtttactgaacttacaattaaattttctaaaaagattaaaactcatggccagctaacagccacatcaacaactaaacataccggaatcctgtagctgttcaatttaataaaaatttgcaggaggggtgattagcttctctctctttttttttgtctttttaacttttaaattcccactttcagtgcccagatgccactccataaatactcatcaattgtctctactcttttcactgaattataaatgatcatttcaattgatgtttattcaaaattcaatttcccttaatttggaagacaaataactgaaataggactatattttacacaaaatccagatgaccatagtaggtcatccaacccaccttcaaaattattcaagaataattaatttttcaatggttactttgagatattatactttttttttttttttttttttttttttttgagacagggtcttgctctgttccctagtctggagtgtagtggcatgatcatagctcactgtaaccttaacctcctgggcaattttcccaggcaccttaaactccccagcaatcttcctgcttcagccttctgagtagctgggactacaggcatgtgccaccattcctggctaatgttttaaaaaatttttgtagagacagggtctcaccattttgcccaagttggtctcaaacttctagcctcaagtgatcctcctgcctccacctcccaaagtgctgggattgcaggtgtgtgccactgcgcccagccaaaatactataaagtattgaatcaaaagtagattgatatatattttatagagactattgttaaatgtattctaatgctttaaatccaaaatatcagattatctacaacatactgttttctaagcttctggataaatgagtggtttaatattgttataaatgcctaaagttatagctatttcatagctgacttaattcaacaacccttgtctaagaagaataatcatgaatgtaaaaggatgccattgagattcttaaaattgtaccacttagaatatacagatctgtcagcaggtcagctgggataaggggtttgtcaggagtgttatgaacaatttgattcttaattaaaataaaactcatggaaagaaaatgagttttacttaaaatgagaataatagagtgcattcattccattagccagtattcttaatagcttaacatttatattgtgttgattttacaaaacagttacctaagattctttttattgggcagtcattcacaacatatatcataaactatcataatgtttatgtttgtttgtttgtttttaaagagtaaagtcagtcaacttagtggatacaattggaagctatattagtttgctagggctgccattacaaagtaccataaactgggtggcttggaactgcagaaatttattttcccatggttctagaagtcagaagtctgaaatcaaggtatcagcaggattatcctcttctgaaggcagtagggaaggatttgttccaagaccttctcttagcttctggcgtttctttggcttacagcaacataacttcagtcttcacagggtattctccccctgagtgtgcctttgtgtccaaatcttccctttttataagaacatcagtcatattggaattaggggtctactctactataactcatcttaaataattatgtttccaatgacccaatttccaataagctcatattattctaaagtctagggcttaggtcttcagcataggaatttgggaggatgacataatttgattcctaagaaaagataattgcccattttggaaattatatcccctcaaaaattagtggaataagccaatttgaagtcccttaaatttaataccatatacaaataaatgtaagaaatatatactctatggtcatatgtctacaggtaactcacttttgtgatactttcattcaataaaaatagatagtaagtaattcaccttagtctttattgacatctattaaaattaagcaagacaatagccaaaaatatatatatatatatatatatatatattttttttttttttttcttttaaagggtctccaaaatactacctaatttcatagagtcccaaacacatgttgacacctatttctcatcccaacatacacatcccaaaggtattagtcttaggtcatttgagatggttcacatgtaaaaatctgggtcactgtgccctgtgatctccttatactttggtgtatgcccttacagctttaggccttgcctaatcacatgctccctgggaagttacaactaagtagtttctccttctaaaccacccagcagctattcaaaactgtgattcttgtgcaagttcgatctcttctatttctcttttgcagtgtgtaagaaggaagggaagagggcaggaaaggaaaatgtttgaatttagaacttgtgaacatgtaaaagagaaacagtgggttatggaaaatacaataaaaaatataagacagagatgaacagtgtgaatcttaaaactataagatgagaatttatttctttcagtttgatctcttggtatttattgattttggaacattatagatgttaagaaaccttacttgttagttatagccatacctttgaaccctcaatcaaggagaaacacagtaattgacatgaaaatctctttttttggacaaattcagacaaaagattaggttattgggagaaatcttgccattataagaatgtgatgtcataattttcagaaacttagagaaacacaatgcagatttaaaatttagtattaaagatctattgatatatcatgttaatagttcaaattagaaatgccatatgagtatcagaatagttgagtaaaatatgctctatgattttatacttattttggatttcaaaaattcagtaaatttaaataaattaaaaaggtatttatgtaacatattaaagaatatatacctgtaatcaacaaacatgtatttaccaataaagcattggagatgtgcagattaaacttaagaacagaaataggatgttatctataatctctggtagttcacctatttccagaagctctagccaatggaaaaaggcaagaaatataatatgcacaaccatcagaaaagcagagagtaaaattgggaattaagtgtctcagtttacttatatgtaaaatgtgatattaatggtatctatatttcagggttatttcaaagaagataatactgcaaagcgcttggaatatgcatatgtttacagtaagtattaaatagaaattagctattatgattactattatttgtagatataattctataactttaaaataaagaaaatcaattaataaattattagaactttattataagcttcagtcatgaattttcttacataaaataatgttagaaaataatagaaaacattttattcataatagcaacaaaaaggtataatctaatcagaaatgaacttactaataaatatgaggtctttcttaagaaacattgctaatactcagagaaataaaaaaagcagtgtcatgttcttgcatagaaaaaatgacttcatttcccaaattaatttactattataattgcatttttttttttacttctgatgataaggtcttcctctatcacctaggctggagtgcaatggcacgatcataactcactgcaaactcaaactcctgggctcaagtgatccttccacttcatcctcccaagtagctgagactgcaggcacacgactccacacccagcttacttttttatttttaatttttgcagagatggggtctcactttgtttcccagactggtcttgaactcctgtccttaagtgatcctccagccttggcctcccaaagtactggaatttcaggtgtaagccactgtgtctagtgccgagttttctttataaaataaaatgtgacaaaatgattacactaaccaacaaaaataaatatggaagactagctctgataaatcttaaaatttagagtgatgaggaagggacctgttctatagaacattctaccatattataaagctgaagtcattaaaacattataatagtacttagaaatcaatactaatggaacagaatttacagttccttaacatataccagaatatcagaactcaaaataagataaggtacagatcaccagagaagaattcagtgtgtcatattttccagaaagaaccattaataaattgttagatcaattttgtgaaccacaggcagtttttttttatttgaaacggaatgggatggaaaggaaaggaatataatataatagaaaatattagaattcatcacataatactgaggataaaaattattttagacactttcatttcagttataggtatgtatataagtgttcacgtgtgtcagcgtgttctagattgtgatgtaaaatttattttttctcttactgtgggttgtgctccaaaaagtttgaatacctctccaataaataatttggggtaattaattaattgaaaaagaatcatctatttatatccttgtcttctgctaaataatgaaacaaaatatagatgagtattttttaagattactataataaatttaaatggatatatgtatataagatcgctaggaaaatactttagaagcataaaagggaagaaaccacaaagaaaattatttgcacgtctgaattcacacatacacaaatgtgtggttcggaaggtaatcaaaagtgatgagaacatgacaaactggggaaaaaaattacaacaaaatacctttaatgtattaaagaaacgtatacccttcatgtgtaaagagaacttggcaatcaatttttttttaagctgggtgcagtggctcatacctataatcccagcactttgggaggccaaggtgggaggatcttaaatcagcctggtcaccataacaagacccccatctctatattaataaaaaaatttaaattttttaaaaaaagaaataaattattaaaaaaacactcattctctaggtagacattttgtagaaaaaatatataactgaatacaaaatgtttactttcaaaaaagtaattaattagacaacaaaaaagtaaataattagacaacagtgaaatattatcttccttttcaaatcttgcaagaactattggaaaagatataaatactgtctgtggcaatctaagttgatgcacactattttggactccaatgtggcaatatatcaagaacctaaatgttagtgctcttgggccaagtaattccattttgtttagtttcgtccaaagaagttgtctgaaatatgcaccatagttcagctattgataccattacttgtaatggtgctcattaaatgctgtgtacatcaagcagaacaagctgcagaagatacatgctttcatttgaatatttttcaatgaaatagagaaaacaatctataaatgagaaaatctgaatcaaaattttatatatgtccaaaagaaaaatgattagaagaaaaaacactgactgattttctctgtgttgatagatgtggagattataggtaattttcaattttcttctttatatttctttatttgtccatatatctctaatgagtacatatttcttttataatactaaaaggcaattcagtttatttttaaacaaaacaacctctctgttgcccccttcccatcttgctttagtactggttttctaaggatttccctaaatgagattacaatggtttcaaattaaaacatcagttgtccctatctaaattggttctttgaaaaatgaatgcctgaaggtgttgtaaactgctcttctaagtgcagtcatgtgtcatttaatgacaaggatagttctgagaaatgcatcctcaggcaatttcaccgtagtatacttacatagagcgtacttacataaacatagatggtgtagcctactacatacctaggctatgtaggatagcctattgctcctaagctacaaatttgtacagcatgttactgtactgaatagtaggctattgtaacacaataagtatttgtgtattcgaatatatctaaacatagaaaagatacactattataatcttatgagaccactgtcctacatgtggtccattgttgactgaaacatcatcatgcagcacatgactgtacaattaagcatttccctagtcattttgttttgtgtttcagtgatttatttttcttaatacaaaccttgcatggggcattaacctcagtattttcatttgttacctctctcacctgttaaagacaagaaattgaaggagctaacacagacctgctaatataatagtttcctgttaaacatgttaatgaattaatattgtaaaagataacaaagcttgctaagtaaatgaaaatgtcaccccttctgtgttagcataaggcactttgattacttcatattgcatatgcatgtggtggacatcatgatgcccactcgaatatacctttaaggaaggacctgctgcctcgtcaggattgccccagctgccttgcttacagtcagtccccttcctggtattgcccacatccacttactgacaaggtgggagtataaagacctcaccctctcagcctgatttaggaggactcaaggaccattctaggtcccaagcatcctgttgaattaggcctgcactgcagtttcacctttccctctgcacagtatttcttctcttctttttcacaatggcatatcttaagaaactcatacaaggtcaactccatctcagaatgagaacactctctggaacaatgaattacttcagtgaatacaggtgtactagtggcctcttggatatattttggattttattatcataaaaattgatgaatgaaattgtagaatcagagatatatagatacattaataagaaaacacctaaaaccaagctcaccttagatcattatagaatttgcctttgcccactactcattaatagttaccagtttataattttataaaacaccgtgatctgagtttgggagaacttgacaatttattttgtaatatcttagtaaaataattttttaaaaaaatcactgttgtatcaagctttgggttagttttagtaaaatgacacactcaatgtactaatttgaaatcttttcttgattgcagctaaatagttgatctgatccatgtgtccccctcactctgttccacatatggcaacaaacaatcgcataagtttagcaaactgaaccttgtttttgacactttgcagtgcttcaaatgatgcggaatcagaaagcagcgattgaaacttactaacccgacctgctagtctttgaactgaagctctttgctgccctctgtagatacctagagatgaaaacggcaaagtcaacattcactttctcagttatggtaattttgttctgtaatcttaatagaaaaatagactaaacagaaggtgtttcaattaaagggaaattaaggatcgttttttcctataatttcttttgtactatatcgttgaatttctgtatttgcctttaaaaaaatcactatttaaaattaaaacttcgtgtttaaaaacactatggtaagacaaagtgaaaatacacacatgaatgcatgaaaaaagaattagtaatttttcaactttcttttgacttttttatcattttatgtatattatccacattttaaaagtcatatgaattatggtagataatgtcctctaaacataagctacaagttctattttcacatgatagttttccttgcctttggcatgataattattgttgtttctagtttcttgggaggggctattcttttgcaagaaaataatcactatttcaattgttgcaattcaacttaaaattattttgctgagcattttctatgcactcagcaaaagtctacatgctgtgtaggggatatcaaaatgatgataataatagcagcaaactgctaagtgcttaaccttggaaagatattgtagcacattactttacatatgctaaccatttagtcttcccaaatattataaggtgtctgattttgtagagcctacaattttgttgaaaatagtattactcgatgttccatcatcatttctctgttaccacaaattgctatcttaaggcataagaaaggtcagccacgttttgtaatgcttgctatttcacagcgtgtatgcggttttactcctattcaggttatcagtacttcaagcttatctatagcatcttgtcttttaagcactgtgttaagactacttctcaagatataatcaactactgaatgtagtttctctaaatattagccaggcttccatctatcatatcttcaaagtagtggttatatctttatgaaaataagatcctaaaagtcctacactgtggtccttcattatttctactaaataaatttctactaattctctctttcttgtcgctgtacttcccttattttgtactggctacaagaagacttacttggttcatctttatgggatgaaattatacttaattagatgtaataataagaaaatcattattagtgaaaacagcagatacgttctagcactgatggtatggaattacagtctgtgaaaaagttagctataacagaataaaaagccacatagttatgatagatattcgatagatatgtccctatgaaagagtggaaaataggtttatataaatgtaaacatattaatattaagaatcatatttattcacacctgtaatcccagcactttgggaggccgagatgtgtggatcaactgaggtcaggagttcgagaccagcctgaccaatatggtgaaaccccgcctctactgaaaatacaaaaattagccaggcatggtggcatgcaactgtagtcccagctactcaggaggctgagacaggagaattgcctgaacctgggaggcggaggttgcagtgagccgagatcacgccactgcactccagactgggcaacagagtgagactccatttcaaaaaaaaaaaactatcatctttataaaggagtttcagtattatgtaaagggcatcaaattaattttttttgttaaactttatatctaaaagcattaacatcattggctatttctgcaaataattttcaaaagaatatagcaaaagtttgccataagttctgctcaacacaagataaatcattgtcttttttattatactactaatccagcatgtctacatagtatgagagcaataagttttgcaaaaattgaagatttagtaaattattaattaaacaaataattttaaagcctattatgtgctaggtacgatttttgtcactagagttacctcagcaaacatcataaacaacaatcctcaccatcatggtatagtcatctgatgcatagtaacatttcagtaaaaaatgcaccacatatatatattacagtgttaataatttagtttaaatattgtgatattttaatctttcaaatcttttttctgaaaacacctattttttccttcagttgttaaaaattgtgaaaatttatgttcagcaaaattcactattttcatataaacaattctatatactctgttgaacatatagtcatgtaatgaccaccacaatttcaagatgtagaatgattactacccaaagcaatcaacagattcaatgaaatgtctatcaaaataatgtgtcacttttcacagaaatagaaaaaacaatcatacaattcatgtggaatcaagaaagaatccaaaatgacaaagcattcttgaacaaaaagaataaagttggaggtataatataacttgaattcaaaatatattataaggtcactgtaataaaacagcatggtatttctataaaaatagatatatggaccaatggaacagaatagagaacccaggaataaatctacatattgatagccaactgatctttggtaaagctgtcaagaacacacatgagggaaaggataccttgttcaataaacagtgctataataactagacagttatatgcagaagaatgaaactagattcttgtctgtgaccatatacaacaatcaactcaaggcggattaaaaacttgaatgtaagatacaaaactataagacaactggaaaaaaatcagtgaaatgcatcaggatattgctctaggcaactattttatggttaagacagaaaagcgcaggcaacaaaaagaaaaatagacaaacgggactctgtcaaactaaaaagcttctgcacagcaaaaagaaacaatgaacagagtgaagaagcaacctgttgaatggaagaaaatatttccaaactattcatctaataggggagtaaaatcctgaatatacaggaaactcaacagatgaaagacaaatagccccattaaaaagtgagcaaagaacacgaattgatatctttcaaaagagacatataaatgagcaacaggtatatgaagaacacacaacatcattaatcatcggggaaatgcaaatcaaaactgagatatcatcttgccccatttagaatagctattattaaaaagacaaaaaataacagatgttgttgagagtattagtctgttttcatgctgctgtaaagacatactcaagactaggcaatttacaaaagaaagagatttattggacttaaagttctacatggctggggaggcctcacaatcatggccgaaggcaaggaggaacaggtcacatcttatgtggatggcagcaggcaaaaagagagcctgcgcaaagaaactcccttttctaaaatcatcagctcccatgagacttattcaccatcatgagaacacaacagaaaagacctgcccccatgattcaaccacttcccactggttccatcccacaacatgtgggaattcaagagatttgggcagggacagagccaaaccacataattctgccccagcgcctcccaaatctcatgtcctcacatttcaaaagcaatcatgccttcccaacagtcccccaaagtcctaactcatttcagcataaactcaaaagtccatagtccaaagtcttatctgagaaaaggcaagtcctgttcacctataagcctgtaaaatcagaagtgagttagttacttcctagatacaaagggggtacaggcattgggtaaatatgccaatttggagaaattgatcaaaacaaaaggggtacaggccccacgcaagtccaaaatctagcagggctgtcaaatctttaagctctaaaatgatctcctttgacttcatgtctcacatccaggtcatgctgatgtaagaggtgagttctcatggtcttgggcagctccacctctatggctttgcagggtacagtctccctccaagctgctttcatggtctggcattgagtatctgcagcttttccaggcacacggtgtaagctgtcagatctaccattctggaatctggagaacagtggccctcttctcacaactccactaggcagtgccccagtagagactctgtgtgggggctctgaccccacatttcccttctgcattgccctagaagagggtctccatgagggccctgccactgcagcaaacttctgcctgggcatccaagcatttccatacatcctctgaaatctaggtgaaggttcccaaacctcagttcttgacttctgtgcacccacaggctcaacaccatgtggaagctaccaagacttggggcttgtatcatccaaaactgcagcccaagctctatcttgacccctgttagtcacagctagagcagctgggacacagagcatcaagtccctagactgtacacagcagagaaaccctgggcccggcccacaaaactattttttccccctaaacctccgggcctgtgatgggaggggctgctgcaaaggtctctgacatggcctggagacatttttcccattgtcttagtgattaacattcagcttctcattacttatgcaaatttctgtagccagcttgaatttctcttcagaaaatgggattttcttttctgttgcattgtcaggctgcaaattttccaaactttatgtcctgtttctcttttaaaactgaatgcctttaacagcacccaagtcatctcttgaatgctctgctgcttagaaatgtcttctgccagatatcctaaatcatctctctcaagtttgatgttccacaaatctctaggacaggggcacaatgccatcagtctctttgctaaagcataacaagagtcacctttgctccagttttcaacaagttcctcatctccatctgagaccacctcagcctggatttcattgtccatattattatcagcattttggtcaaagccattcaagaagtctcgagggagctctaaactgtcccacattttcctgtcttcttctgagccctccaaactgttccaatctctgcctgttacccagtttcaaagttgcttccatgtttttgggtttcttttcagcagtaccccactctactgttaccaatttaccatattagtccattgtcatgctgctgataaagacattcctgagactgggcaatttacaaaagaaagaggtttattggattaacagttccacataattggggaggcctcacaatcatggaagaaggcaaggaggagcaagtcacatcttatgtggatggcagcaggaaaaaagagagcctgtacagagaaacttccctttttaaaaccatcagatcttgcaagacttattcaccatcatgagaacactgcaggaaagtcctgtccccatgattcaaccacctcccacggggtacctcccacaacatgtgggaattcaagatgaaatttgagtgggaacacagccaaaccacatcagtgagcatgacagaaaattggactcttatacactattagtggaaatgcaaactaatatagcattatgaaaaatagtatgaagatttctcaaagaactaaaaatagaagtaccatacaatctagcaatcccactaagagtacgtccaaagaaaaagaaactaatatatcaaatagatacccaaactcccatgtttattgcaacactactcacaatagtaaagatataaaatcaatatcaatttaaatgtccatcaacacttgaatggataaagataaatggataaagaaaatgtggtatatatgcaatggtatagtatttggccataaaatgaatgaaatcatgtcatttgcagcaacatggatgaaaactggaggttacgagaaataagccatgcatagaaagacaaatattgcattttctcattcccatatgtgagagctaaaaaagttgatcacatggaggtagagtaaaataatagataccagaagctgagaaaggtgtatgggaggcagaaggggataaacagaggttggttaatgggtacaaacatgcagttagatagaagaaataagttctaatgtttgatagcagagtagggtgactgtagatacaaccatatattgtatatttcaaaatagctagaagagaggtcttgaaatgtatccaacatataaaaataataaatacttaggtgatggagtattacaaattactctgacttgataattatatatattatgtatgcaacgaaatttctcatggaccccataaacatatgtaaaaatataaaaaatacatttaaataaaattttaaaagatataaaacagtatcatcatccaaaaaatttcccttataccattttgtcaaaatagctctgcaaatatattgcccacctttttagaaaatgggagtttaaaaaaattgttttcttattactgactttagagaaatttttcaatattctaggtatcaatcctttattagatatatattccacaaatattttttcccagtctgcagctagatcttttattttctaaagaattcccaatattcatttgaagaacctgcccattattattttttaattatgcaaaagtattgaaatgactacgtcaaagagatatctgtactctcatgtttcttgcagcactagtcacagtcaattccaagagacggaatcaacttaagtgtccatcagtagataaatagataaagaaaatgtgaatatatacgcaaggaaatagtattcagcctttaaaaacaggtaattctgtcatttgtgacaacatgaatgaaattggagtgtattacattaagtaaaataaagtcaggcacagaaagacaaatactgcatgatcttatttgtatacagaattttttaaagttgactttatagaagtagagagtagaatgatgggtaccagagtatggggggagatgagagtgggggaaagcagagaagttgatcgaacaatacagagttccagttagaaaggaggaaataaatttcaagatctattgcacagcaaggtaaccattgtcaatattaatgtattgtgtatttcaaaattgctaaaagaatagattcttaagggtttcactacaaaaaatgataaaaatgtgaagtaatggtatgttaattagcttgatataattattctataatgtacacatatattaaaacatcacattgtatccccaaaatatatatataattattattggtcaattaaaaataaacattatactatacccaatgtgtagtcactgcacaggtgataggtgcaccaatatctcagaaatcaccattaaagaacttattcatgtaaccaaacacacctgtttcccaaaaacgtattgaaattaaaaataaaaataagaaacaataaaaataaaataacataaaaaatcaaaatattaaaatattaaagttaaaataaaaaacaaactaaaatattggattcaattgttttactatgttcactctatagcagtagaatattattaaagagtaataggagaaaaaaaggcataaatgtagatatttctaacatgggatacaactttgcataggagaaaagcagaaggaaagctgactctttctaagctattagaaaagttcctcgtaaagcagttataaaaacagtaggttactaatatttgcaaacttaaatgcaattgaaatgagcattaactgcaattctgattctatcaaagttttgtaatattctcattgctgtttaagttttggataacttttttcttttcttttgagtctttaaaaaaataaaaaataaagcttgatgtgacataataaataaaggtgcaattcataacctcctttcctcacactataaaaaaacaaaaaaacaggaaaatatggcaacacaattaatggcaccaatcaatgaaggaaagggccatgatcaagtgacaaaatttaatagcctgggggataaggaaagaatgaggtgattccatagaagagctcaacacagctgggttcctaagcctactttgaaccccaaatctggagacaagtactctgagtggatactattgtatttttccttttcagagaagagaactttagaaattgatgctgagagaaatgattaaattgtgaataatgagtttgacaatttcagaaagaaaaggatctgaaggaaaaataatccaaactccattggtatctttctagggaaatgaaatgcgtatctccaaatgaatagaataaaccctgataaagggcccataacaataacaaagaaaaaccgcatctctattatgaaaaatttcaaacatgtttttcaaaaagagagactagtttaatgagctgccatgctcttatcactcaaacttaacaatcatcaacaacagttgccaaatttgttccatctatactgccacaagctccagctttcttttaatttggagcatgtggcagttggttaccaatttggtcatttttttttttttttttttgtagtcaatggcatgtctattacatagcaggtattcaatggcgtttgctaaatgaatgaattaatcaatgaatgcatcaacctccattcagccatttcccagaaaatgagtctgcctttaaaaatgatgaatgttatacatgatgaatataacaggtaaatatatgcaaagaacaacatcgtgttgaaacatgctcaaggacaggcatttcaaagatgattcaggctaacattatggattcttcttaaatgagaaagaaaatcctgctgatggatgtcttcctaagccagttgggactaagaaacacagttgaagctcatccgtgacagaactaaaatgatcaggcctaaggtcatagcaacaacttgttgctgacacatcagcaacttgtacagacatcagcctgtaccttaaaacaatgcacttatatgaacttaaaatatgcttttgtaaaactgtcagatctaaattgatgtaatttaacatttttttgatagtgaattttatgtcttacagagccagtgctaaaaaatgtgcatagacacatatatacacatgtgtagacatacaaagaccaacataaatgcataggattacaccatttttaccatttgtttcccaaatactctagaggccagccctatttgcctgggaaaatatatatatatatatatatatatatatatatatatatatatatatatatatttatatttatttatttataaactacatacatttaaactatatatataaagtttaatgagcgaccatgcacttatcactcagtcttttaaatattgatcattgtagagatcaaagtagctgatagtagatctgaattgtttttacttgaaagaaaatagaaaacatctcaattttgctaacaatcttacaggatttatggttgaaattatgtcacatcaaatttataaaaacaaaaacaattgtgcaagtagatttgcatggttgtgtttcacagatatacacacatactttgtcattttgtttattcctaagaaggactgtttgggattgccactccaatggaagaaaaataagaattgagatacaggagacctaaatgtatatactttcgtataagtgcatatatataatataaacaaaggacgtttacattttatacgagtatatatatttatacaaaagtatatatatatatttatacaaaagtatatatatatttatacaaaagtatatatatatatatatatatatatacacacacacaaaagtatatatatatataaacataggataccagaatccctaaaatgtcaattgaaacgacttaatatatcacctggatattcagtttatatcacattaaacacctaaatattttgaaatatgatgctcttgagggcactattgctattattaaaaagaactcagactatatttgctttaaggaagcagtaatttttttctgatacaaatgctaatatttggaagcgattacaattcaaatgaaacttaagtatttgggggcaacttaagaatttgggggaaattctaagtgactacttgtgggaaattagtagcatccacagagaaaatattttaacagagatgatttgaaaatctgccttttttgattttcaatataatgaataaaacattatgatgactttaaaatgtatataatttagtttgaaattttaatacaagaagtattattttaattctcataattaaatttaaccttataattctatttcaataaagcaaaagttatagagcattttatgtttcttcaaaaagtagtcagttgatggtgatttctacttctatgataaaactatctcaggtagaacgattaagaaatctgaccaatctgtacaaggaaaaacattaccaattttagtataattcttagcttagtccttaccctcagtccatctacctatttcactaagcaatgaatcaccaaggaacttcatcatatgtacatagaattcagagaaatgtctctaattttcaacaataactattttctcagcaacaatttactggatgtagatacagtcttttaagtattgatcattccagaggtcaaagtagctgatagtagatctgaattgtttttacttgaaagaaaatagaaaacatctcaattttactaaaaattttacggatttatggttgaaattatgtcacaccaaatttataaaaacaaaaacaattgtgcaagtagatttgcatggttgtgtttcacagataaacacacatattttgtcattttacttattcctaagaaggactgtttgggattgccactccaatggaagaaaattaagaattgagatacaggagacctaaatttttagaaaacataaagttatgcaaaaaaaattgtatgtttatgtctcatgaatatacacatgcagaaatacaataatattttaggcatttccactaaaaggtttatttggagtttgcctctgttcagtgaaagagaactgtggattgagtgcacaagacattagttgttgtctcagccttccatgtaattcagtttgggaaaattctctttaccatattaagcatccaattttattttattttatttttagttctggggtacatacgcaggatgtgcaggtttgttacctaggtaaacatgtgccatggtggtttgctgcacctatcaacccatcacctaggtattaagcccagcatgcattagctaattttcctggtgctctccctaccctttccaccccgcctcccccaacagaccctagtgttgttgctctttaccctgtgtccatgtgttctcattgttcagctcccacttataagtgagaacatgtggtgtttggttttctgttcctgagttagtttgctgaggataatggtttccagctccatccatgtccctgcaaaggatatgatctcattcctttttatggctgcatagtattccatggtgtatatgtaccacattttccttatccagtctatcattgatgggcatttggttgattccaggtctttgctgttgtgaacagtgctgcaatgaacatatgcataagcacccaattcttgatttgttaaataatggggatatatataataaacaatcactgaggtcactttcaaagctaaaaagcgctaatattgtatgtagttggaattatcacctttctttttataaagggtttatatattttaaaatttatgtaagcaatgaattaacattaaatgaaaaatgtaaatgaaatatgaataaaagggaaaaataataagtcacagatattctactgtcctgtcacagccattactagtatttggtcttccagacatttccatatgcgtgtatattatttaaaacagtatcaggctctctaacttacttttcttcctaaatacaatataaccaatgcctttccatgttattagtataaatgtccacaattataaatattttatgtgtatgcacaaaatacatttaatcaattccctcttttggacttttaaattttgttgttgtttttaaacaaactgtggtaacactgtacatatatctttactaatttatctatctccttgatataagtgcacagatttgtgatcattaggtcaaaggctagatatttctttttagtaatttgatacattttgacaaattaccacacagaagccctgttctcatagggagttctacaggctatgtaccagagggtttattgtctccaaaccaagacaatcctaggagcctcattcctgttaatgtttgccatttttataggcaaaaaaaaaaaaaaaaaaaaatggcacccttctttaacttgaatgtttatttctttgattatggatgggaataaatctgtgtctacatcttttgactcactttacctattaaaagtaaattttctggatgtgataccctatttttaaaaaattgatagactttattttttagagtagtttatgttttcaaaaaaattaagcggaacgtacagtttccatttaccccttctattcccctccttcccccagcttccctattaacaacttgcaatatgttatatttgttataattgatgaaccaatattgataccttatcatttactaaagtccatagtttacattagggttcaagctatatattgtatagctctacggattttgacaaatgtatgacaattgtcttccattacagtttcacacagagtagtttcactgccctaaaaatcctctgtgctctgcctattcatcccttcttccctcccacccctgacaaccatggatctttttactgtctccagagttttctcttttccagaatgtcctatagttggaatcataaagtatgcaatcttttcagattttcttcttttacttagtaatatgcacttaaggtccctccctgtctttttatggcttaattatttatttctttttcaagctgaataatactccattgtatgaatataccacagtttgttcatatattctacctattgaaggacattttggtggctttaaattttttttgtcattatgaataaagcttatataaacatttgtgcacagtttttttgtggacataaattttcaactcattctgattaataccaaggagcatggttgttggactgtctggtaagacaatgttaagctttgttagaaactgccaaattatctttccaactggttttaccattttttattcccaccacagtggatgagaatttctgttgctccacatcctcaccagcaattggtgttgtgttttaagttttaggcattctaaaaggcaagtggtgctatctcatcatcatatcaacttgtaatttcctaatgacatatgatgttgagcatcgtttcatatgcttatttgccatctgtatatcttctttgttgaagtgtctgttcctatcttacccatttttaaactggtttatttgttttattattgtgaggttttaataatttgttgtatattttggataccaattcttcaccaaatatgggttttgtgaatattttctcctagttttactttttcattctcttaattgcccattaaaaagttagcagtattaatactttctcatacatattgcaaacactcttacaataaacaaggctttttggtttgggtatttgcatgttctaccatcttaaagtttctaatttatttgaagacaaattgtatcaacccttctacggtttctgcctttggtaccatgctctgggattctatacacattaacatgctatattttagtatacactagtctaatttttttctcccatttttaaaaataagttcttgattgatatgaaatgattttgatgtatacaggagatgttttattctttaatagttattaggtaaatcaatgccattaaaaataagatataaattttctctattgattgaaaataccaacgtaatcatacactatatttccacatatatgtgggcaatgtctaaactcttaattctgttcgactgcatgttttgttgatttcagcattgcactactctgttttgagttttgtaggattttagtgtattttaattctgagtagggcaaattcatcttctttttttatattttaaaaatattttcctaattagtttgatacttctagttttccacacagatctcatatttattttgttactttcccatgtatatcccattttacttttgatttaggttgtgttaaatttagagaataatttgaaagagtttacatattttcaatgattggatcttccttcacatagagattatgtctctcaaatcatgcaagctttgaaaagtatcttgcagcaatttcatttcctgagcatttcttctttttttctttttctttttctttctttttttttttttttttttttttttttttttttagagatagggtctcactgtgtcacctgggctgaaatgcaatggcacaatcacagcttatgaagcctgtaactcttgggctcaagtgatcctcctgcctcagcctcccaagtagttggaactacgggcatgagccaaaatgcctggcctgaacatttcttttaaaataaaatctcaaatatgttgtgttattcttgctactgtgaatgtgattttccttacaaaaagtttctactttttaaattcttatgttttaggtggttacctattagttctcatatatgtttacttgattataatggtcttccatgaatataattacattgctttaaaataatccatactccccttttctagtatctatgcccttttaaaattttgcttatttatcttatttccttattaaattacctttttttaaagcacttacagaccagtgttaaatggatttggttggcatctctaacttctttctggcttgaatggaactctttgggaatgcataattctgactatttgtatcaaatagaatcttaaaaagtattttaaatgcattttcagtcctatggctagttgaatttattgatatctttttgcatgtacatagaaatatatctttgtaactttcatctaataacatgatagaataagacctgcactatcacactcccacttaaatttgtaacccctacacatatccagtatttccttttgcctttccgtgtcctattttttaccatagaacttatcaccatttgacgtactttacctttcagcaagtttatttattttttatctattgtcagtatcctacagctagaatataagtttcatgaagtgtagaatttttatctgttttgttcactgctgtatctctgcaacttaaaaaagtatctctagaatttaaaacatcttaggcatttaagaaatactttaataaataaatatgatgccacaaccatttagaatggttaatcaaaaaagacacagcctttgcctttacataatttataatatattgagggtatatataaaaaaaactacaagaagggactgggatctacaattgtaaagttttggggatgtgagagactctcacttacataaagtggttagaaaaggcttttctgaaatgatcatctaatcagtgtggcaaatatgtgtgaagaccctaaggcaaagaattgctagatagaatctaggaaaatacaagaagggtggtgtggctgaaggtttttttgggggtgaggaaggatggggaagagtgacttattataaaataagagagatacaaagaggacaaattggcttaataagccacagtgaagagtttggattttattccaactgaaatgggtaggcttttaatagtttaaatcagaggcatagtctgattgatttatatttttacaatctcactctgtctctttgagaacaatatgttgggggagagagcaaaacagaggaaatatcaagaccaattaggaagctcttatagtagtctgggcaagtaatactgattgcctgggatagaatgagggcagagtgggcagagagccatcactagaattgaaatatgtttgggatgtaaaatctcaaactccttctcctcaagtgatcctcccatcttggcccccacaaagtgctgggattacaggtgtgactcactgtgtctggcccagggttgtagaatccagataggacacactttccataaggaccagaacttgctttgaatgcagaaaggcaatggctttctaagaagtaagaatgaccaaggaaccttatcatagccttccttatttatgttactttcatatagtagccaatcgcttatgcggacaatgttgataggaaagggaaagatagggcaacccatagtttcttttcctttcagttcttccttactcatcagtaagatgaagctaaagattgttacagaatgtcaggtattaatattaaaatatgaaatacaaacagttgaattaacattgtatagtatttccactgttctagtaagaatgaaatacatatgcaggtacaaactacatattatgagttgtgtaattttagccattctacatacaagttaaatactcctgtatttacatttaaaactggcattgcacaatgtaaaaatgaatggtaaaatgcatactaataaactaataacttaagaactttatttaggacaacattaaatatcaaattaaaaataccatgaaaagtcaagagagggactgtggaagaaagcaaaaaaaaattataattcattacctttaatagtactttctccccccaccactttttgtacaagggccctacattttcattttgcactgggaaaatggctgcattttttagagtttttattacaacaggcagagtcattcttgggcgttgcaaaccggtgtctgtttctgggtaccccaggcaaagagaggatatgggaagaagagggctttgacaagccatcaaaaatgagtctccttttactccttaattgatcacatagaaaatctttttttgtttgtttgtttgttttgtttgcttgttttccaattccagcaactagtatttctacttagcacccttatcctgcaaaaggtcatttcttaactagtatagtattcagctggttggaaaattgaaagaatctcctacgagtcatttattcttttcttactgacaagataggcctcaaaaatgttgaatatcaaaatgtggagaaattattttttagagaattctggttttactgattcatcgaagatttataagaaaagctataaaggtattatccttccatcctattaaaggcctactaaagtgagacaacacacctttttgttgttgtttccttttgttttgttttaaaaagcctagtgttctactagaaaatattaattttgttactttctaagttgtaggaattagttttttcatttagtgattattctcacaagcaatcataaatgtaacaactgttttagaacagagatggccatgcattttcatgtatacacagggtgttttaaaagataaagagctaattccaataaaaatagactgaattacatatgtaggttgtattaattaattctggaatcaaaattttctcttctactatagatgttaaatttctttactacattgaatctagttaaaaggtttttgtacaatttacccttgtgtgtcacatatatttaatattttatttcataataaaaaagtaagcatttcacagagaaaattgacatctagcttttttgatgtctcagtgaaatcttccctgagctttagggaatggatgagaatttcgtttctcttaggtcttcagtttgaagactaccttagaaaagaaaaaaaaaatgccgcacactctagatagctgtttgctatagtaaaggttatgaaaattaatagagagaatcaagttacttttactgggacatcaatgagaaatatcatactaaattatcaattcatgctattaataaaatgaagttattataacattttaagaaagacatgcccaaagttcatttaggagaagctcttgggcaataagtaatattgagtcaaatattagaaggccattgaacctaatgactttttcgatactttctaattttattattttatgactcaattaccacttttttgtaaaaagataaaattaacaactgtcattcttgactgacacaaagagacgatgtggtcacctagcaatcaaaaacaatggggccagatgttctgcatcaactaaccaccaacacatttaagcagacatcactgactaatgtggtgttaatgaaagcacctcttacaaatgaaaatcagatgttcacctatcccgacatctgtgatgttcatctcatcaactgagcttttaatgacaattaactgtggtttttacacattgcatactgcttcctagtcacaaggtattagaccacattttgagaaatccagaaaaaatagaaaaaagaaagcatataaaaccttatcaataaaacacttgtggtgaaagtgtgctaaaaaggaaaatgcatttgtattttggaattaaaagccatttgtagttatgtccactttgaaaatggaaaagtgattcaattaccaactcaaacttcaatgaaaccagccactcttctccctctcccatctcctgctgcctgctcaactgcctttctgcccagcaatggagagtcacacgctaatccttaagaccacggcactgagcattctcagtgtttaattctgcgcacttctcctaggcaagctctctacaatagtcatattaaagtaatatctgtcctccttatccagcatcaatctaatactaaggatttttttttttgagatttaatatacaacaacatggatgaacctggaggacattatgtcaagtgaaataagccaggcacagaaagacaaacactgcatgatctcactcatatgtggaatcttaaaaagttgatcttgtagaagtagagagtagaatgatggttaccaagggctgaagtggttgggcatcgggggttgaggagatattggtcagaggaataagttgagaatatctattgtacaacatggtgaatgtagttaatttattatactcttgaaaaatgaaaaagagtggatataaagtgttctcatcacaaaaatgatagctatgtgaggtaatgaatatgttaattagctagagttagtcattccacaatgtatattttctttaaaataacatgttgtacatggtaaatccataatttcatgtcaatttaaaaataaataaaatttattcatagagtttaaatgcaagacatcagaaaatgaaactgaaaaagttatacaaatattcttttttttactttaaaacatatttagttaagtaacatgtacccactttttgaaaagcaatcaaatggcaccttgcccctctctgatttcaatgatttgaaatgtttttaactttagtattcacctgctatatttcaaaaacattctactctaatcttgctatttgttgttatttttaggcactatctaatgactttctcttatgcaaatttaactacttaatattatcttatttgcttgctgatgattcctacttccccctatcttcttagtacaatagaataatcatttttagttaataatcaatgtttatatcatgatgactattgttcactgtagtgtgttatcactgcatttcctttcttataaagcttttgccttttctttcatttgtagagtttcctactctttcattctttccccaaagttgcatcagatatggcatattcctatcataaatttgtttgcttgtttgtttgtttgtattttgagatagggtctcactctgtcagccaggctggagtgcagtggaatgatcacagcttactgcagccttgatctccaaggctcaaacaatcctcccaccccagcctcccaagtagctgggactacaggctcacaccaccatgcctagttaatttttgattttttatatatatagagagagagagactgggttttgccatgttgctctagctagtcttgaactcctggactcaagcaatctgcctgcctcagtctcccaaagtgctgggattacaggtgtgagccactgcacctggcccagaagtttgttttttacatcaaaagccctatcacatctgatggattcatttccttctttttcctggagcctgtccttgttcttccagatctagtgggtacttgtcatctgctaggacagccatcctgttgcctccttacacttcattttgctgcttgccagaaacgtgatttttgactgacttaccaattaagtgagtttggtattaatgtcaggtctgactatgcctgaaataaaaaacccgtgaaatgagactgtaaagaccataagcttaagaaagtgggccaaagtaatttctcataaaaagacagaagatgtttaatcactcaatcaccacctagtatagaacctcacactttgctcagaggaaaatcacaaccagcgcttgctccaagtctagttctgctcagcaatgcaagttctctgagttaatttaactaacttggtctctttctaagtagatatgttggtctacatctggctggcatgacctcacttaaggtaaactctgcagcctgagttggaatttcagaaagagagctatcagtctgtttgttgctgctgtaacaaaataccttaaattgggtaatttataagcaacagaaatttatttcttacagtactggaggctgggaagtccaaggtgaaggctgtaccgactccatgtctggtaaggactctttgcttcagggaaggcactttgtttctgcatcctcacatagcagaagtggtaaaaagggatgaacctgctctctcatgctcttttataagggcactaatatcatatcacttcacaaagaccccatctcttaatattattgcattgtggattacatttcaacatgaattttggagggacccaaacattaaaaccatagcaagagggctgggggtggtgtctcaatcctgtaatcccagcactttgggagaccaaggagagaggatcacttgaggccaggagcttgagagcagcctgggcaatatagtgagaccccgattctacataaaaataagttttaaaaattagctgggcaaagtggtgcatgcttctggttccagctactcaggaagctgaggttggaagatcactttagctcagaaagttgagggtgcaatgtgccatgatcatgccactgcactcctgcctgggtgacagagtgagaccgtgttcaaaaacaaacaaacaaacaacaacaacaacaaaaaccacagcaagggccttgaaaagcacattagtacagtgctgccatttgcacaggttccctctcctgtcctttttgataggctctcaattttgcctctcagagatttgcacacaaacatgatatgactgaaaaaaaaaatgcccttcaatagcattgttgtttccactgcacttctcatttgcttgtcaccttggcaatgcagtggcaggatacaagcatcttaattacaatactgatcctaagaaataaggaagataattgaaaaattttagtcatactcgctttctttgcttattatctattgaataaaaagtaagaggtaggccgggcgcagtggctcatgcctgtaatcccagcactttgggaggccgaagagggaggatcacctgttaggggtttgagaccagcctggccaacatggtgaaaccctgtctctactgaaaataaaaaaaattagctgggtgtggtagtgggtgcctgtaataccagctattcgggaggctgaggcaggagaatcgcttgaacccaagaggcagatgttgtagtgaacagagatcgtgccactgcactctaggctgggtgacagaatgagaccctgtctcaaaaaataaataaatagtaagaggtaaaagagatgcaggaccatttcatccctcaggataggtacagagcctaccagctttccaaagacctactttctgggaaatattaaggaactgataggggagaaaaagtttattatctctaaactaaaaaaaaattaaaattgaagtaaacaaatgacaaattaaacattacgaaatccacaaactatctaatttaatgaattatttaatagattattacattgaaatactaattttattacatgtaaaacattttgtaaagcttagattcttttcactttccaacagcgtccaagtatgcataatgattccaacaagagtaataatattaatgatagtggctgcatttggagggcagaaggtggctttctaacttattttgaaaaatgtcaaacaaaaaagttgaaagaatagtccaatgaatatctgtacgcttcctactaagattatacaattgctaaacgtttaagaattgttaagtctttttacaagctcagtaattcttcatgactctctgaagtagttcttttagcatccctaatttgcagcggaggcatatgaggcacagagagattatgcaacttttcttagtcatacaaaggcaaatggttggtctgggattcaaagctagagattttctaaaagcacgtttcttaacctacgtgcaaaaatcattcctgtattaaataaagtaagtaaaagtaaatcctttataaattattttacatcgaaattttatttaatataggatataggtgtattctaatgtactttatcagtgaaatctctgaatatcataatgtctagaaagctttctaaaagcctctaggtgaatagacagcaaggcagaagtagatgtccttggcagtgcagccgggggagaggtgaggaaaccaagcaagacatgcaaagattttggactcatttctgcattttttgggatggagtaagtttctttttctctggggtgactgtgtacatttcagggagatttctatgttacacagcctagtttttctccacaatgatggaaaactaagaaatatatcactaattcttagactacacaattaacaactcttgttgcttaattgagagacatggacaccgagattcctgatccagccccagctgcagcctctttcatttgtggctgtcaattacaggactaccaagaataatccaccaatctcctggcataccaggaaaattcctggtctagattcagacaagtggtttatagttccagctctactttgagttaatcctgtttaaatttcagttctcatattctatgattcatttgtggaacatatactgagtcattttgaaaagttttaggccaaggctaactttcttacatgcaacaaaaagttgctggaaaaataccatgttgccttacaactgtttcaaacactttcggcctgatatctgtaaccccagcacttagggaggctgaggcaggaggatcacttatgctcaggaatttgagaccagcctgggcaacatggcgaaaccccgtctctacaaaattaaaaaaaaaaaaaaaattagccagatttggtgacccacacctgttgtcccacctacttggggggctgaggtgggaggatggcttaaacccaggaggttgaggttgcagtgagccaagatcatgccactgaactgcagcctgggtgacagaatgagaccccatctcaaaaaaaaaaaaaagtttatatctattgatatatctcatttcacaatcttcacagtcttgtgaaagtgttatccccattgttccattgagaatatggtgatactatgacatcaggagttaaaaagccaattggtaacagtgacaagactaaagcccaagcctctgactcccagcccttcccactccaacaggcagaattacttctatagcttcatttaccactacttttcctgagaaatgtatgtatttttccagcattagcatcaatagcaggcaaaatagaaggtgaccaattagatataaattgagaggctgccatagggttcctttgctcaagagtaacactccttacctattttctgtagggcctaaaatgtcacgagtacacacatttgttaaggccctcggcagggctttcggtctacaagatagtgcaatcaacgtactccaagagatggcatatcctaagcagaaattggctctttgtcaggagaggggtgggagacaggtataattgccatgtttaaacaccttctggaaatggttttagcaaaaggttctgagatggtgaggagggatgacaacctaagttgtcagtaatgggaagaaaatgtgatgatattgaaggtagtggaccaaaaatagactttgcttacttcacagttttgcctagggccagttttgatttcttccattaacatagcattcaccttgcctaaccttgaaagtttatgagggttttatgtgaatataagaaaaacagaagtgatcactttcaaggtcacagacaataaagtttctctaactgtggtcagggtgtgtgcctctgatgtccttcaatatcaatctttctttggagaagcattttccaagtatattccatgaatagtgtttttgttttgttttgttttgctttttgtttgtttttttaatggaaaaatcttgggatctgttgacctgaaattttggggagtgctagctaacatatttaaccctgaggatcaacagtgcacagctgcacattacaagttctaagaagtttgggtttgttaacccactgtttcctaaatcgttgtgctcagaaaaactccctttttaaaatattagtattctgtgaagtcctcttggaaaatgaggttttactatttgcataataaaaatagaacactttaaaattgttgtccatgtttacctaacatctaatagttcaaattatgtttggatttgttgtaaatttttatttatatggaattcaatttttgtcttagttaatgcttttattatctaagactcatagcatactttttattaattctcaaaattaggtacaaaaatggttagtcctctttttatttcaaatatttttatcaatttcatgattaaagacattagttgaatttgcttttggtgatatgataacactactggtattgtatagaaaatatattttagacctcagcaaaacttttttctcactcatgttctagacaaagagaaatcaaggagataaagaattagtagataatgctaagtgtaacgctgtaaatattggtcattatatataatgataccagtattacctttcagtgggcagggtggttaaaaacctgtttgcttcctttgtttttgtaaaaaggattttgattatctaccaagactggagatgggtggtaaggaagagtcacacccaatatggcctttaaggtatggtcaaagtcacttaattgggaatgaggaagcctgaatttaatgtttggcttttcactaagtatttgtataaacctggtttatacaaacagccctaatagggctgttatttttagttcttattattatgtttatagttttagcataaggtatataactgaaaaggtttgggatgtgtttattagttactgtgagttacgaacttcatatgacttaggatccactaactaccatactattaaagacacatactatattgtgctgtttcatacattatttaataaaacgtatttaaaaaactcatgggcaagatacaggtgaacaaggaaacgtttatttgggaaaatacaagtaatgactgcataagcttaggaaattgtaataatcactttcttccacagaattgggctcgcaatatggtatacattactcttattctcattcctgttgtaaccaagtcttctaaaaacctgtactacttatatttcttcttgtgatttcatccaggttcatatctttagaatctataagctgataattgtcagtgtgcatttccagctctgagtgctcccctgagttcccctgactcaaaaatccaaccatctacttgacatcttcacttgcctttctaatagacatgtaaggcttaacatgtccaaaacatatatcctgattatccacaaaatcctggcccacaaactttttgcccaacatctttccattttagtacagagcacatataattttccagaacttataatggatccttatttactcacttttcttcatctccacacacgaaaattaacacatctaacttctcgatttctcatcctctccagtgatactaacactagtacacactaccatcatttctcccttgggttttggatatagattactcactgctagttctgcttcttatttgcatttatttaataatcttccaaataacaaatagagtgatcttttctaaacacaaagtaggtcattttactctttaactcaaagtcaccaagggcttcccactgtacttagaaacaatgtcaaattattttccataaagccctatttcatctggtcctgtctaccccttcaaccttaccttttaatcctccttcctctctagtgttcagaaatgccaacaaataactcagttctgtagtaacctcattagagaggtagataatgacaaagaaaaaaactccttgcaatttgtttttactatgttatagcaccattggtgcttcagtaaccactacacaaaaataattctgaacaattaggcattcactcctgaaaaaaaattgtagaatattatgttgtacgtttatatatattgacttgctcagtgctaacataaagcaaggggacagaaaaaaaaccaatccaccaatcagtaggcattttaaaaatatttaagccgccaccaacgcaccaatgtaaaattcacatgcacacaaaatatctccaagttctacaaccagcatcttaaattaactttgtttcttaatgtgccaaggaagggcagtgcaaggcctcagggtaggactctccagtggtcgtccccatgcagaaacattaatttgaacaacaatccatgcacagaaataccttcacaagagctaaggaaaccagatcacagtatttggttgtagtacaataataagaaaaggcacatggaagagggtaaggatgtcagtattacattacatgtatcactcctttcccaacccaaggtgccacagcacagagagagatacagttcacatggtgggaaaagagatgtgagtgcaaaactttaccttggatactaacattgggcccaccaaagtaaaacccagcactaggtacccatggcctcatattcaaggctgattcttgcatattaagcctctggatctaccctggtgtcaggaaggatcacactgttccaggcttcaggcttgtgtgtaaactcaaactatgacctgcaccatgggtcagtggatgttagtggccctgggctcaggacagctctcaacagcaggccggcctcagtgggcctgggcttctggcctgcgctagtggtgcatttgccataatgagtgctaggcttctagtagcacttcaccagttgcagctgcaccaggcttctggtgcaccccagcacagcatttgcacagggctttcccagacatagttgctaaaataagtaccactttttcaagttgtagacatcaacacatgaccacagggatcaaaaacaatcaggaaaacataacatcatcaaatgaacaaaataaagtcccagtgactaatcctaaataattgaagatatataacctgcttgacaaagaattcaaaacaaatgttttaagaaagctcagtgaacttcaagaaaatacagaaaaatacttcaataaaataaggaaaacactaagtgaccagatgaacaatttaatagaaaaattgaaacaattaaaaaataaaataaatagaaatcccatagattaaaaatacaatgaatgaaatgaaaactgcaaccgaaatcatcaataacagaattgacgaagcagaagaaagaatctgtgaactcgaagacaggttatttgaaaatatacagtagaggagaataaaagaaaacaatgtaaaggaatgaaaaaagcttatgggacttatgaaacatcatcaaaagagcacatttttgagtcacaggaatttcagaaagtgaagagaaagatcaagggttagaaagtttattaaaaaaaaaatagcaaaaaacttcccaaacatggagaaagacgcaaatatccgtgcattaggaaggtcaaaattctcacataatgtcaaatccacataagaataccccaagacatattataacccaattgtcaaatatcaaacacaaagaaaagatcttgaaagcagcaaaagaaaacaaccaaataggtataagagagtcccaatagagacagcaccagacttctcagtagaaacctcacagaccaggagaaagtgaggtgaaatactcaaattactgaacatcaaattgctgaaaaatctgtcaagtaaaaatactgtgtcaagcaaaacagtccatcagaaatgaaggagacaaagactattcccagaaaaataaaagctgaaggagtttcttacctgcagacctgtcttataagacatgctaaagtggcttctttgagttgaaagaaacagacactaatatgtaatatgaaaatatatgaaagtataaaactcactggtaaaagtaagcacaagtcaaatttagaatactctaagactataatttggtgtataaatttctaagactgaaaaacaaaactattaaaaaaaagactacaataatttattaaaggatagacaggataaaaagatataaactgtggctttaaaaattcaaaatttggtggcaagagtggaggaaaaatgtagaggggtgtgtgtgtgtgtgtgtgtgtaattaaagttaagttgtaatcatcttaaaataacctgttataactataagatgattttgtaagcttcataataaccacaacaccaaaacctagagtaaatacagagaaaagtaaaagcaagaaatcaaaacatatcaattaaaaaaatcacttaaccaataatgaagacagcaagagagaaaggaagaacaaaggatctatgggtcaatgagtcaatgacaaaattaaaagggaaataaaaaagagatatatgaaaatggaaacacaacataccaaaacatatgagatacagcaaaagcagatatgagagggaagtttacagcaataaatgcctacctcaaaacaataagaaagatctcaaataaataacctaatgttgcatcataagaaactagagaaataaaaacacaccaagccaaagttagtaaaaaaaaaaatgaaataataaaaatcagagcagaaataaataaaatagagactacgaatacaatagaaaaattaataaaactgagttggttttttgaaaaaattaacaaaattgacaagtcattagttaacctaagagaaaaaagaaaactcaaataaataaaatcagaaataaaaaagagacattacagctaatacaacagaaacacaaaggcttatgagatactattatgaaaaattatgacaacaaattggataatctagaagaagtggacaaattccttgacacatgctacctaccaagactaaatcattaataaatagaaactcttaacagatcaataatgagtaaggatattaaatgactaataaaaaatcggttatcaaagaaaagcccaggacctacaaccttcaccattgaattctaataaacatttaaagaattaatcccaattattctcaaactcttccaaaaaattgaaaaggaaggactacttccaaacttattttatgtggccagtaccaccctgacaccaaaagcagacaatgacattacaaaaaaaattacaggccaatatccctgatgaatatagatggaaaaatcctcaaccaagtactaacaaatcaaattcaacagcacactaaaaagatccatggcaccacaatcaaagggaattcatctcagggagatgtaaggatggctaaattacgtatatcaacaaaggtgaaacaacacataaacagaatgaaagacaaaagtgatataattatttaaatagatgccttaaaatttgacaaaatttaacaacctttgacaatgaaaattctcaacaaattaggtacagaagatcccttctatagtccgtaacacaataagggccatacatgacaaactcacagctaacaaattactcaacagggaaatgttgaaagcttttcctttaggatatggaacaagacaaggatgcctactctcaccacttttatccaatacagtactgcacgttctaggcagagcaattaggcaagagaattacataaaagtgatccaaattggaaagcaataagttaagttgtccctgtttgcagatgacatggccatatatatagaaaaccctacagatgcctccaaaaagaattagaaaaaatgaatgaattcagtaatgttgcagaacacaatattaatatttaaaaatcagtagaatttctacacactaacagtgaactgtctgcagaagaaataaaacaattccacttataattgctacaaaatataaaatattagtaacaaatttaaccaaggagatgaaagatctcaaatcaaaaactataaaatattgctgaaagaaattgaagacacaaataaataaaatgatattccatgttctatggattggaagaatcaatattcttaaaatgctgatatttttcaaaatgatctgtaatcaaaataccaatgatattctttagagaaacaaagaaaatcctaaaattcatatggaaaaacaaaagactccaaatagccaaagcaactctgagcagaaagaacaaagctgcaggcatcacacttcttgacttcaaaaactacaaagccttagcaaccaaaacatcatggtactggcataaaaacaaacacgtagaccaatgaaacagaatagagagctcaaaaataaatccacacatttacggccaacttaattttgacaaagcagccaagaacacacaaatgagaaatgccagtctttccaataaatgatgctgggaaaactggatagccacctgcagaagaatgaaattagacctttctctcacaccatatacaaaaatcaactaaaaatggattaaagatttacatgtaagacccaaaactatgaaactactaatgaaaacatagaggaaaactgcatgacattggactgggcaataactttttaaataggatccccaaaacacaggcaacaaagcaaaaacagacaaatagaattacatcaaactaaaaagcttctgcacaacgaaggaaacagttaaaagagtgaaaagagaacctacagaatgggaaaaatattttcaaaatatacatctgataagggtttaataaccaaaatatataaaatactcaaacaactcaacagcaagaaaagaaacaaacaaaaaaccaattacagaacaccaagaacatgaatggacgtctcctcaagagaaaacatacaaatggccaacaggtatgtgaaaaaatgctcaacattactcatcacgacacaaatgcaaattaaaaccaccatgagatgtcacctcacacctgttaggataaaagacaaaaaaagagaagtgtcagtgaaaatgtggagaaaagagaatccttgtacactgctggtgggaatgtaaattattatagccatcatggaaaacagtatggaatttcttcaaaacattagaaatagaattaccatatgatccagcaatccaaccactgggtacatatcaaaaggaaatgcaatccgtatgttgaagagatcgctgcacttccatgtttattataacattatttacaatagacaagatatggaattaacctaagtgttcatcagtggatgagtttctgaaaaaaatatggcatatatacataatggagtataatttggccataaaaataaatgaaatcctgtcattcgtgacaacatagattaacctggaggacaacatagattaaccaggatagaaagacaaatattacatgatcttactcatatgtagaatcttaaaaagttaatctcctagaagtagagagcagaatggtagttaccagaatctggggtggtcgtcggggcagggggctgttgtggagatggtccatagatacaaaatttcagttagaagaaataaatgtaagagacctattgtacaacatggtgattgtattcaataatacgttgtattcttaaaaaatgctaagaaagtggatataaagtgttctcactataaaaataataactatgtgagataatgaatatgttaattagccagatttagtcatcccataatgtgtatatacttcaaaacattatattgtacacagtaaatataaacaattttatctgtcgcaaaaacataaatatactaaatacaatgaaagtgattacacataaagtgttttgattacaacattactgcaacagaatatatattgtgaaacatcttaaagcatttgtaagaacttacaaaaataaggaaaattcaaaatataaacttatttttatctagatattaagaatgtcacttattttctcctgtcaccctctacctctagcaatgccaaaatgcttgtgattctctaaaagcaccaccatatcccacagagttctacttttaagtttgttacttcctctgccccaagggcacaactaggacagccaacatcaaggtttatcaagtcccatgtgctttattccccagtgaccctcacactctcctccaggacaattaatcactctcttttctgtatattgtgaacacaactccacataattcatatttctaagaaagtacattgtgcatattattttgtgtgtcactctaaaaataataatttatttaatatttatctcctctataagactgttagccttttgacttcatgaactatgtcagattcattcttttatctttcacagcatatcctggtaccacatatagaataagtgtctgggtttcttaactgaactctattttatttttatttattaaataagcatacagtttacattgtcttgtaagttttgtgggcactattgataaacaaaatgaaagataaagacaaatgaaaatctgaactatataaatatcagctagctttcatattttgcattcaaatctaatttatatatctttctcttttgatttcatgctttgttaaatacattgactgttgaattttcctgttggcatagaatgtgtagctgcttcttttatacaaatgtctacaaagaaaaaatggatgagtgtgacagaatcaactgataccagattttttatgctagacatgctaggcactcattactaaacactagacatgatacattatttaattatccatatatgataaagcttctataaatgttgatatctgtatgtattataacatgcatactttctgaggtatctggggctttcagaccagtcttgattgatcaggattcctattttaggcttactcttcccaggtaattgctcatgtgtgtttcccagtctcctctttaaaaaatatgtgtgattttatgttaaggcccaagtgactaataatagtctaacatgcccacctaagtgttagttgaataacatcttaacttaatggaagggccaactgttgaatgagtaccaggcatcagttggaatagatatttttgcatgggaaatgtcccagcactaaaaacttccatcacatgcaacataactcatgtgcgcatgccatctgaaagggccacatttcattctacttccagctctaccttattctattttttctactccttcacatggctctctttgggatgcacttcacattttcaataaattatattttaaaatagcattaaatattctctctcagttttaaataacagatatattattcttcctgcaacagttcatgtctaattggcatcatccacctttcacttctttcactgttgaatacatcattctcacatgccatgagtttgtttgggatgggaagccattcactaacctaagtaaccataaaaatgttcattatgtatgtatgcattatgcatgctattgaaaaaacctggaaaacaacccaaacattttacagagaaggattggctaagtcacttgcaggatatgatgtggaagaatattcattggcttattcatgatatgtgaagtgggagaaagtaagtaggttaataaagaggcatgtgtgaatatagaaaataagtaggttaattaacaggcatgtgtgaatatatctatatgtatatctgtatgtgtatcaatatctctaatttatctaccatctatcaatattttgttaaaacgtacacaaacctttctttttatttattttttttaagacagggtcttgttctgtcatccaggctgtagtacagtggtgtgaccatagctcactgcagccctgatctcccggttcaagtgatctcctctcacgtcagcctcctgcgtagctgagactacagtgcaccactatgtccggctaattattttctttctttttcttttttgtttttttttttgaggcagggtctcactgtgctgcccaggctggtcttgaactcctgggctcaagcaatcctctcaccttggcctcccaaagtgctgagatcacaggagtcagccaccatgcccagccttatacaaactcttaacattaactttactgaatagaaagattataggcaatttttgttttcttattttccttatgttttattttttcccaagattactgcagttagaatgctttaaaataacaacaacaacaataaaaaaagataattaattttgtaaaatgacacaggttttaagactgggttaataggagggtggcgagggctattatcaatttaggtaacagagggtaaaacggcttagaagtaatatggtgtaatagagtgatatgcccttttgagcatgatgagtttaagccagctacttggtcatgtttggtgagtacttgaaacaaacacagcttgtgtaataatacctgtgcattgcaaaattttcaaacagaacaaacatatatgaaactgaaagcaacagttattcctctacccttgtcccaaactctctggacttcttccaaatagtcattgtattttcttgattattattacagaaaaaccacatatgtatccatatttattttacttattacaatacacatactttctgcaattctttttcacttaataatatagcttggagcgctctttacatcagaatacaaagatgttgcattatttgtagttgctatagagtattccatgggatgcatttaattgagccatttcctcattgatccttggaggtgtctgtagtattttgctattgcatataatcttcaacagatattttggctcatctattttttgccagcatgatttcaggtaacattcttaaaagtgggatttctgggtcatggactatgtacattttaaagtttaaaagatactgcaaaataattttccaaaaatttggcatcaattcacctcccaataaataggctttgagagttactatttcctcaaactcttgccagtgcagggtagtacaaaactttccatttgttgttaatctgatagaaaaaaagaaagcaataacttctaggttggccatggagtctttagtctgatgcagcagtaaaactgtaactgggattcttcgtgtctcttcttacagggccacctgttctgttagaggagcttgtctaatttattttctgctttctcttttattctaataaatctcaactaattgcaggaaataattttctctcagtgattatgtacattttacctttcctttccagtttaccattaagctggagaacagaacaaaacaaaacaaaacaaaacactcagcctggtagttcttcctggctttggtgaattgctgaaatggtaggacaggttttgagccactgttttcttcctctcttgaggggttttctgttcttccatgtgattttcagtggatgggatgcttccttaacacataaatttacttaaaatcactaatgggaagtggttatgcccacactattgtgaggattctgttacctggattgctttgatgtgagtgagaatagcggtagtgagggcgggtggatcgaggggagcaatagtaccacatggtcatttctgggattttttgcctctgtaactaccactattcaaaaattatgacttgagatttttctgtatatattttctgtatagatttttctgtatagatttttctgtatttttctgtatatatatatgtgtgtgtgtgtgtatatatgtgggtgtgtatatatatatgtgggtgtgtatatatatatgtgggtgtacgtgtgtgtatttacacacacgtacacacgtacacacacacacacacacacacacatatattttttcttttttgagatggagaatcactatattgcctaggctggtcccaaacccctgggctcaagcaattctccagcctcagccccctgggatgataagtgtgcacctacgtgcctggctcctggttttgctacttcctttgctttattgctgaggatacattttgcccattttaagactttttggtggttaattttgtaaagttttgaagaaagcaagtcaattgtacaacttttatctaacatctcagtctagaagtctcttagcatatttttctcaggtttaaaaaaataaatatgtgtgtaaaaaatgtgtatattgattttctgaaatagaacatctctaatgggactctcgcaattactacagacactgcttctaacattgctatcacacacaacagcggctacccagcccttttttctttttatcaacaatcaaatgttcatggagaattattttttgtttcctgtgtgttaatccctttctggagtttattctctaaagactatcaagtagtatttctccacagtttatttagcttcttctagaacatttttcttgctctgacaaggactatcacggaaaattaatcagggagataaaagtcatatatatagtacaccaaaatgataagaggaaacatgggaatttaaactggattttacaaggacatcagattttcgcatgcaaaacagtacaattaaagctagtcttgcagttcaaactcttaagacccaaagtataatgtaaacgttttatgaagaaacttaatatactttaaatacagtctctgggcagatattcataaaatatttcatggtagtagattaccccaaactgcattttattgttcttccaataattttctttctggtttgatacttccttttattacatgacatgaacaagccttttgatgggcagtttcactgccattttaaataggtttacttggttgctacagcatctatgcccaggacatgtcatttctgcattacgcacctctctctctctctctctctctctctctctctctctctctctctctctatatatatatatatatatatatatatatatatataaatatgcacacacacacaaacatatatatacatatatatgtatatatatgggagataaaagataaaagtcatacagtacaccaaaatgataagaggaaacatgggaatttaaactgattttacaaggatatcggatagagacagagagagagtgcaaacaaaagaaaaatttatataaatatatataaattttatatatttataattttatatatttataattatgaaatataaatatataatatatatttatacataaatatacataaatataaatatataaatatataaatataaatatataaatacatatatgatatataaatagataatataaaaatatatattaatatagataatatataaatacattatatttataaattataaaattataaaatttataaatttataaatatatatttataaatttcaaaattataaaatttataaatttataaatatatatttataaatttctatgatatataacatataaacatatgtttatataaactttatttttggtttacaagtacgtttgtacacaaatatttctaaaccaaaaataaaattataagcctcccaatcaattgaatagaccccctctaagccaagggcattccaaagtaaagcagaaaaactagttcaggtcatgatggaaagaggacatcagatatgcctcattatacccacctccctttggaattcaggaacaactgaccagcgttaacattaaaacgaagtttaaagactgacaaacagactctttgcagcaataagatacatcataaaatgacagataaaagcaggccttgaaagaaatcgaagtattttaccctgaaatatgtttctttgaagtatttaaaatggccccgcaaaactgtctttcaagggggaaatctacatttcatagagaattcccttcactttccagtttttttcctgatccaggagaaatgaagagtctggcacctttttaagtctgataagaaacatttaccatctattctctctgaaaccttcttcggggaggcttgatgtgcattagaagagccttggtctccacaaccccttatcttaacccagacattactttctattgattccaggtctttagataataattgaactcttttgaccaattcccaatcagaaaatctttgaatacacctatgacctggcaatacttccacctccctgaccccctcccactttgagttgtcccctatttctggactgaaccaatgtacagcttacatgtattgtttgatgacttcttataacttctgtccccctaaaatgtataaaatcaagctgtaactcaaccaccttgggaaaatgttctcagggcctcctgtggctgtgtcacaggcaggaccttaactttggcaaaataaacttctaaattgatggagacttgtctcagttactttttggtttacacatttttacatatatatatattccatgacatggaatactttgtgtattccgtgggaatacagggaaatactgggtagaagtgggtagctccccaggaaccccaagcctggaaacccgcagcgctaaatgggaacagacattcctgttttcacgcccaaatgttcccttttggcccaccacatccctctatcctgtaaccatataaacctcaaacccaaggctccataagcagatgggcaggtgaacagaagagcagaagagcagcagagaaggagagaagagatggaatgtctgaatgttgagaggagtttggctggggatggttggaaaggagattatccactggatggccaaactctaggggaagattgtctttccactccatcccctttgtagctcctcatccatcccactgagagccacctccaccactcaatcaaacccctgcattcaccatccttcaagtctgtgtgtgacctgatttttcctggatgccagacaagggcttcggatacggaaagctgtcacactggccctctgcccttgtgaaaaggcagagggcccactgagctgcttaacacttaagctgtccatggatggcaaagctaaaagagtgcactgtaatacaggcccacttgagcttcgcaagttgcaggcacctacccctagacactactgtgggtccagagcccaaaaaagcttgcccagatcctgcgccttttgctccccctcccataaagggtttgagcagtggcagcagccaaacagatgagccacacccctgttgcatgtcctgcaaggggcgtcagggaactctcctgtttcacatatgcatatacacacattaataacttttttcctaatcccttgggagcatgctctttctcctttggaagatggttgttgtcttcaaatgcaagaacagaatagagtggagtaagagacaattaatttgtttacatcctggtagttttcttcgccaatagataaacaatggcaggaatataagagagtctaacatttacatttagtcattaacttctaattcttatgtacaatatattagccaatattcatttgttagaaacatcattgttaattgacaaataaaagcacgtgaagctagtttgtgttagacagtttatgataagttgttcttttcaaaatatagaaattgtaacttgacattagaaaacatattagaaataaagtttacccttttcactttgaatgcggagtttgacttttttccatcaatgatttttatatctgaggaaatgagtaaactcagaattactctgatttcaagcaagatgaatcctgataaaggatagaaagatcaaatattctcggagtttaatttgtatataatagcaacctcagtgaatgtagtcagtttattaaatatgctgatggtgacaaaggaaaatatactctaaattttatactttagtccctatcatatatttatttccatattttgttcttctagaaagctataataaggacaataacaactatcattgtgtgagtattttctctatggtaggtattgttctaagagctttatatgtaactgctcttttaatccttgtaaccaatgctatatagaaggtatttataattatcattttactgatgaagaaacaggtgtcaagaagttaagtgtcttatctatatttaaaaaggaaatgagcaggagagttggaatgtaaaccaggcaaagtagttctggactctaaactcattagaatagtttctgtgctttggtgactaagaactagacctttgtttgaacagggctttattttaaccagctataatacattgagcaaattatgtcacaatttcctctctaaaatggggatgatgattcccacctcagagggtacactaggaattaaattacattttgggtataaacaaagtagaatagtgcttggtacataataagcagtcaataaatggtggttattattatttattaatgtagttgtttcctttgctaatatgataaattttcttctgtgaaaatgacagcaaatgatggctttcagaagctttactgtgaacaacatgcacgaatattaggcttttgatttgaaaaaaaagtattgttttggtctcagcactgaaaaggttcataactgctgacagagactagaactacaatctgcaaccaatttaagaaaaatgaagttccctgatatgcaaagagcaggagagtggctatactacagaattttctgaagttgcccattaagctgtaaatatgtaccttgagcctgtcattcctctgggactgcatgaatactttgtattccatgaccttatatataatgtttcacacgccacactgtaaaaatccccagtgtgctatctccaactagtgactttttcctagtaccaagcagagcacctagggatttgacaaatatttggcacctgcacgtattacataacattgagaataaatctgtaagttttagagacagacgccgtcaggtggggagatgaactctgccactctttagctatgtaacctttaccagttttatagtctaaggctctgttactttctctataaaacaataacacaaatatcgtctctgaaggattgctgtaagaattaaccaaagtgatacatgtaaaattgttattactgtaccatttgcacagagtgaaggcttcatgtttattcttttcttactctccaattgtaattaacatgtaccagtagaaaaagcatctctattttattatactgcattgtaagatgctactctgtaaaaagttggattcaaaatattcagctcactgaaaaccctttcttgaatgctacttgtcaaaataaagaggacccaatgtaacatatttatataaagtgttagtgtttaataaactgataagattggcagtacacaaaatcaaagtctaagttcctatgtatgtacagcatgtgaggccttcgcctatgctattgcattgaaaacatgtaatgtgtaaaagttacataagtaacattccttttagaaattttcccgaatattgctaagatgtccctgacaaagaagaatgaggtctctgtctacagagaattttaagtaaagaaccctagggattttgccaattgccttgtatttgcatgcaactaagaacattaccaatagcattttcttttgaaatactaattctagcactataataacaaatggtgtattagatgagttatttctacaatatttagaacactgactggtatactataagctttaatatttatcattattattgctgccaaaagcaatggttctagttaaaaagcatacatggccaacgttgtttactcacagattaaagtttttcatgtgatcaaaaagaccacaaaaaaccctaaataaaggtagattttttttccttacaggaaacaaatggtaaaaggaatataaaaccatctaatcattttatagaacagctactggctctgccaagagctcatttaaatgatcccatttgcttctgaatatgttatatgtatttggcatttagctttcctctacttcaaaaaatttagacttttcacagagataatgaaatcactttcaattaatacccagaattgttacaaagtggccagtttgtccttgattgattgcttttgtattttgtcagtattctttcttcactgaaaattttgaatttggttataaaaaataaagacatttaccttttaagatgcttcagggacatagaatgacaaatgaatgagacatatattgaagctgttttgtgctcatttttagaatgtcttatatttcagtgccttcacatttgcaaatcttaattcaagatatttttacatttttccctgtgctcagtatttgagagtctcaatactgccatctgcataggctatctggacactggaaatctttgaatttttaattgtagggattttaactctaaaaatatttggccactaaatgtatatttttaatttctctgctttcctatagaaaattgagattaattgtgagctggggctaataaataatacacacgatttttttttgttcttatcctcacaatactcatatggggttgaaaaaagggagcaattaatagtgtttgtattaccaaaatgtctcccttaatctgcttctgaattctcctctccttgggcttcccaatgctaatggcagaaaggagaattcagtggcactcccctgaagccaaagctaaaccaacatatttacagcactcttttggaaactacatttgtgtccttttctatcccattccttacaggatggtgatgtggtgggcaggggaagcagggaggtgggtgcatgtttttcagcaatcactgcctcagttgatcagaacatgtctcatctgacacacaatgtcttaactacctcacggacagccttagtcaaaacatgtaagacgacattatacatgaggaagaaaggctggtaacaggtcaaaaaaaatgacaatatttcatttaaaacttatttgagatcagctctttatttatcattacataagtctttaatgaccccaatacatacatacactgacctctcctgtcctcctcactctcacacacacaggaacagaaagccagcatcctccatgcactcccatgaaagatggaccctttaaagaacctcttggttggaagtcagagaagcggcaaagatatgaactggaggaataacagaagagcagatcctagagctaatgctcgggggctaaataagtcctggtggcccccaaaccacttctaccgtgctgcctggaacagtcacctcactctattaaactctttgaaacattatcaagttgaaacttgtgtgtcttaacaagcacactgtcattaaaatactgaaaaacctggtcacagtgaggaaatcataggcattcacgcccaccgtggtacaaattatttcattatagacactgctttccttctaagagtcacctgagaaaaaagactcacctgaagagatctgaattttgactgggtgtaagggaataaaaacttaaggtcatcctggagcttaaaattcaccaccagtaaacggggaggtctgaggagtggtgtgtagtatgaaaaacctgagaggaagagcaataccacgtgcacctgatggtagaagggttttctcttagcctagaaggtgcatgtggaattttccccctcattctacttacctgtctaagcattaaaaatatgaagagacacaaaatatgtctaaattatgaaatgactgcctttcatgaagcatagttttctgtgacttcttataaagcagcacatttaactattcttatttttaaattagaaaattatttccatgcattaccttttataagaaatgtggattgttattccgtgttctacaaccacatccaggaagagctgccatttaggaagaaactgtcatctgcccagccctgtgctatgttatttcacttaatcctctcagaaacctatgagacaggtgcacagcaggaaaccagagacagggtgcggtttatggtaggtaatgcacagctgtatattttgtgtagccactgctgtcattttatatcaaaggcaacttgaggtgggaactaaatgacttactatcatctttactgttttttgagtgaagctgatcacatggaaggagctgaaggtggtaccaaaagtcaattattaggcaggtaaaatcatactggggaaggcttaaatacaaggttcatcagattattttgctttcacttttattgttcttcttcagaagtttcaatgtgtcattgaaaagtttaatgcacaatgttttataaataggtatgttatgaaaacttaattttatagttttagaatggattagagtaggcaagagaagggtaagattgtaggcataaaatggcaaaggtctggattggggtattagtagtggacacaggaaagatggattgatagggttactttaaaagaaaaaacattaatagttccacagcaagcacattttctccagtgttcaaaattaaagataatttttatgctacagtttataaatgagaataaggacaactattatatataaaacagctcacccactcattgaagggtataataccatcttgtgaataattaaaagctaccaagtgttcgatgggaaaatatgcagttatgtttaaaaaataatttacttggggacatgcataccacataaataaattaattaatatccagaggaaaccagtccttctatgacctcatattaaacagaaaggttcataatagcatgtaaactatgtcttaaaaaataaatggaagttcaatcaactctttagttatctaaaagatattttggtagccaaagtgtcaatattacttgaaatacagagtataacaagaaatatgaaagcaataatatatttggaagttcagaattgttttcaaatgaagcaatattatattatttatacactttgaagaaatgaaaatagagaattattgaatcatctagttggatggacctaggaccaaggaaaacagactatattacaggagatggtattagaacacctagtttaacctttaattgaaatttaataatttgttttaaatcacgactgactgttatagagattctgcataataaaaaccagtctcctccactagacaactctaacgattaagtccattttatcttttatcgaaaactatctcccttaacatctatttaatggcccattctggtcttggtaaaaacataaaataatattactcctcctaacagatggcagccctttaaatattccaaatgtacctttactaaagattttatttgctaggataaacattccagtttcattattaattttgatgaaaactatcttactattattttcatgagaaaggagagggaatgcatgtttgtatgttgtttcatatacattatctcatttcttttctttttgtttttttgtttgtttgtttgtttgtttttgagacggagtctcactctgtcgcccaggctggagtgcagtggcgctgtctcggctcactgcaagctccgcctcccgggttcacgccattctcctgcctctgcctcccgagtagctgggactacaggcacccgctaccgctcctggctaatttttttgtatttttagtagagacggggttttatcgtgttagccaggatggtctcgatctcctgacctcgtgatccacccgcctcggcctcccaaagtgctgggattataggcgtgagccactgcgcgtggccatatctcatttattttcattaaaaacagacgaaggcaacttgagatgacagttctcatttatgttgtttttaaatggatttttaaaagtattggtagaagtccattaccaatctttagaatttatttgaatgcttgattttttctttgaaattgcattcgtcaagcctaatttttaatttagcagttaacacttcattatgcatgtctagagaaaagtgtggggaaactagctgcagtgaggaaacagtcactgaccaccagaaatactctagagacattttgtttgttgttgcatttaatcttcctaaaattcctatgaggaagatactaccatctccatttttcagacaagaaatctgaggccaggtgcagtggttcacgcctataatcccaacaatttgggaggccaaagtgagagaatcgcctgagcccaggagtttgcaagcagcctgagcaacatagtgagaccctgtctctactaaaaataaaaataaatttgagctcacagagtttaagcaatttatcatagattatcatagtaaaaaaacagattatcgtaacaaaaagaagtagctctggtacacagtctgctgaccctaaaacctctattcttctcattacagcaaatacagatgacaatggcacctccttcacagggctgttggtataattaagtgagttattattgggcatcagtgccagtgcttggccatcttaagaaggcatcagcttagttccacatagttaagtctcttcttcccagtgaaatctatttagcctaaaccatgatcattgggagtgggctatttaattcttctgaagtgttaactgtaagcatttttctccaattgcacagtattcttggctaataacattggaagtcttgattatgctccactttcttgttttcaaacaggaaactactgggaataggtactatcataggatcctggactaataatagaatcctaaactgttcttgttgactctccctcatatctaccccaaggtctcctccaacccgtttaggttccactctgatacctcagatgaaatgaaagtatgccatatgccatcactgcttaaaaccctccctattgcctggagaatacaatctgggtttcttagcatgaaataagtattgagcaatctggtcttggcccgtctttttgcttcctcctttcttttaccttgtgctatagtaatgctaaacagtgagtactttatgctgtttcacacttctgccaactttgtcgaaatatcacacaatcccaatcctagatatttacccaagagaaataaaaacatctgtccatacaaaagcctgtacataaatgcttatagccactttattaataatctaagaaactggaaacaacccaaatgttcatcaattggggaatgaattaagactcagggttacatccatcaatggaataccactcagcagtaaaaaggaacaaactactgatatatgcaacaacatgggtgactctcatatgctttacgctaagtgaatgaagacagactcaaaagactacatattgtacatcccatttatgtgataacttggaaaaggcgaaattgtgggaacagaaaatctgtcagtggtcaccaggaactgaggtaggggtagggcattgactacaaacggacataaggcagctttagggggtgatggaaatgttctttgattgtggtgatagttacatgactatatgcatttgtctaaattcaaagaactgaacaccacaaaacaaatggattttactgcatgtaaattatatcttaataaactttacatttaaaagtcacatatcttatttcacttttgtccatctattcatgcactttttaaacaatctccttcattttggggcaactcctgcttacctttaagacctcaaccttaagtatcaatctcctccaagtaattatgcctcaattccatgctaggctgtgggcttctcctctgagcttttccaccacctgtgcatacatttgtctcttatgatacataaaatatagaacccgtgcctgacactgcaccacaaactccttaagagaaaataaaagttttatttatttttacatccgaaaacactcaatgtaagaaccccacaaatgcttgttgtacaccttaaagttatgtttggaactttgctatcttctaaaatagaggtggaaattatagaatgtacttgatttaaactcaagtccatttgactattgtatgaagtctgttttcatattagaaatagtgcaacgaagttactgtcacacagtctaattataatacaatcttttaaaagatttacaagcaaaattattgcatggttctatatttgacatatgttttgctggcaaaatgtttgtgagagatatgctaaatatagtaacataaaacatcctaaagtttgtaaaatatatcacagcagttaatgttgtaatagttcttttgcctttttaatattttgagcaaatttttaaaatctcaacttatgcaaatgtgtgcatataaaattataaaactctctggattaaggcaactgagaattctcattggtcaatgagacatttagaggatgaggataatccatgcaaattaaactgctcaactgagcctgttttgtaatattctaaactgctgaccctatcttctttccagagacaggaaaacacattttatggcctgattatgatgcagagctgttgggaaaatagttattatgagataattatatcccaacagaatgtgaggtgcttggctgccctttgtatagaatgtcacctgaggtgtaagagttgtataccacttttattctagcagggaggttattctgattcatagcctgttctgtttttcaggcattaggccactgaaatgatgtttttcaatcaaaggaaaaaattaagataaaagtgaaagttcatgatcgactacagttattaatttaacatctaaatcttacatttatatttactctctggtaaagaatgaaagaatacatttgtgtctaaaaaagtaggatttgctgaacagactagaaggaagagattctgcaatgattattccatcaagatagttacagtttccaattataacattatcagtccttccattttagagtggtgtctggggatgagagttaccgaagcattgcaagggaatgtttaggcaccccaatccccatcatatatggttgtgacagctatagaatttcatttccagaatatataatcttccctttttatactgatcactgataaattataagacccataacaaatagcataaaaactggcttctaacatgaaaatatctaatagatctgaagcttggaattaaaattaaataaaataaaaatacattgataggaaacaggttgagctatctgctcactgggttttcctcctttctcttcccttctctttcctatcctcctttatttctatcttccattcttctcttccacccttccttcctattttagttaccaaggatcaataaatggagtcacaggcagatttactttcacgcccaatctactcctagctcatagtattatagtgaaattccattttagttttaaaatagatatagtagcacctatctttaaaagattacttgaagaaagtgtccatgccatactatgcatcatagctttgctttgaaatctcattaaaaatacaaaatgattagaatatgtaatttgcaagtgactattgcctgattcttttgtaatgtttattttgtttttaaatctcttaaccaatattgaaagtgtttttcagtctctaaagtagctgtgagaaaaaaaaatcctactgaagtaaacatttcaagaagcatttatttttgcacttaaacagtcaatatttaatcagtaggttaaacatccaatttcagggttcaaatgcaagctggctgctaacaaaaccactggcaataaatagtatgagtgttctttcatgcagccataaattactgtctattatcactaagctgttgtgaacaaaacctcaaaaaagttgaattggtcataaacttaaaaaatgaatgcatgcaaaatggtcagttttgcatgactcatttgagaatgaaggataatatacccactgtaatgtaaattctctccatgcggagtgttgttgtcttactctcaatatattccatggcagggacatttaatggtacaatacaaatgcaaacatttaattctttctgccaaacactcaatggcaatacatcacatcacacactaagcaaagctaggcaagaaatttgctatatagttaacagtattcaaaattgttataatatattcttttattttcttcactccttatccttatccttatcttcactccttttttcagcacataatacttttgttccactgatgaagcatataaatataatgtcacttctttctctgatacacatagctaattttatttttagtgagagtaaacatataggtgtatcctaaatctgaactacaactctcaacttctagcttccaaatcacaagcaaattagaaaagaaatcttgatctgtttttatcttttatagaaaaagttgaattgttaactggtttcttttgtttgattgtctctaaactcaagactctacaggctgaaagataatttcttcttggttgctcctcacacttcctatctttcctgttcttttaacattctaggtcttgtgacaaaatgctgcttaattctctatgaaatgatatcatatttaaaagtgttggcaccactgaagtgaacagcaatctgtgttaatgtggccagggtaaagctaaatcactgtggcctcttttggagatattttaaaaaacaaaagaaaacaaaaactgctgaaggctaggtgccttgtcttacatctgtaattgcagctacttgagatggttaggtgggagatcacttgaggccaggagttcaagactagcctggaaaacacaatgagacctcgtctctagaaaaaaattaaaaattagtcaggcgtggtggcatgtacctgtagtactagctactcaggaggctgaggttggggattgctggaccccgggagttcaaggttgcagtgaactatgataacaccactgcaccccaggctgggtgacagagcaagaccctgtctcaaaaaaacaggcaaaaaaaaaaaaaaaagatcgtgggattgtcttgtcttgaaataagaaaaagagaatctatgccaagtgtttacgtgctgagagtacccctttaaaaatacaaaagctaccctacagttatcaataactactaattgtaaaatgtgtaaaagggtattttattggataaattaagacaaacagagctaatataaaatgttctcctagcccagttttatgtgatgctggctaacatgacacaagcactctcttccaacaatgaaaactaagaaaatgaacccaaagaagacttgcatagaagcgtaagtcagattgttatggttatttatggttgtgattgtttgggccatatcttgtgaactgacatgacttcttaaaggacaagagagttagttggtcacccagttgagcccacatcaaagcctgagaggagtctttcctaccttttcaggtcattctagatctaaataatagtaaaagtcccagatctttagaggatgctaataggtactgagcattggaagcggagtaggggcaatggtttggtgctgctgtttcctgctttgtctacccaacaccagtaaatttgtctctatttaaaagccttggcaatgaatgcgaattttattagcccatgtggattaaaaagaagtaggaagagttgtatttacttcttgtgaactttgttccaagtctgaagtaaagctctgcaggatgtatacgacaatgattttttttttttgagccaaaaataagacttaattcctagatttgtactaagcacaggaaaaaaaaaaacaacaacataagacagaaaagttatttatagtttgtatggcttatttacagttttcttcagaaatctctctgctgcttgcttctgacgtgatatctcacatatctttgaagttcagaacattattgtttttttctacctcccctgggccatccataaaaccccatacatgctacaaagaacagaagtgaagaacaggacaaaacaattagcagtgaaaataaggaatacagcctttgggcctaccatctttcctccaacctacaagagatcggcatagaagggggaaaaacttgagtcaaacacattttcagattggcttcagctactgactgatacattaaaaacatactgtttttgaatcagttaccatcccggagcctataatagtatgcatcaaggaaaagtatagcttgagagttatttctacaggtgcaaatttctgttttcaagtggataatgcatatgaatctgtgtttagcataattgaccaagaatcagattctgggctccagttgcagacagagataacagaattctaaatatgcttgtctgcaactgatgatatgacttctcacatatattcttttcatttagcaaaatttatttgaaaaatattctttttttttaagtttttttaaaaatttttttttattattatactttaggttttagggtacatgtgcacattgtgcaggttagttacatatgtatacatgtgccatgctggtgcagtgcacccactaaatcatcatctagcattaggtatatctcccaatgctatccctcccccctccccccaccctcacagtcttcagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttttatggctgcatagcattccatggtgtatatgtgccacattttcttaatccagtctatcattgttggacatttgggttggttccaagtctttgctattgtgaataatgctgcaataaacatacgtgtgcatgtgtctttatagcagcatgatttctagtcctttgggtatatacccagtaatgggatggctgagtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgacgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctccttttttgtaggttgcctgttcactctgatggtagtttctttcgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaagtgtaaggaagggatccagtttcagctttctacatatggctagccagttttcccagcactatttattaaatagggaatcctttccccattgcttgtttttctcaggtttgtcaaagatcagatagttgtagatatgcggcgttatttctgagggctctgttctgttccattgatctatatctctgttttggtactagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgaccatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgtcggtgtataagaatgcttgtgattttcgtacattgattttgtatcctgagactttgctgaagttgcttatcagcttaaggagattttgggctgagacagtggggttttctagatatacaatcatgtcgtcggcaaacagggacaatttgacttcctcttttcctaattgaataccctttatttccttctcctgcctaattgccctggccagaacttctaacactatgttgaataggagtggtgagagagggcatccctgtcttgtgccagttttcaaagggaatgcttccagtttttgcccattcagtatgatgctggctgtgggtttgtcatagacagctcttattattttgagatacgtcccatcgatacctaatttattgagagtttttagcatgaaggttgttgaattttgtcaaaggctttttctgcatctattgagataatcatgtggtttttgtctttggctctgtttatatgctggattacatttactgatttgcgtatattgaaccagccttgcatcccagggatgaagcccacttgatcatgatggataagctttttgatgtgctgctggattcagcttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacattttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtctggctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcactcaggagcaggttgttcagtttccatgtagttgagtggttttgagtgagattcttaatcctgagttctagtttgattgcactgtggtctgagagatagtttgttataatctctgttcttttacatttgctgaggagagctttacttccaagtatgtggtcaattttagaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtcttgatggtctttacattttggcttgattttgcagcggctagtactggttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgttagattggggaagttctcctggacaatatcctgcagagtgttttccaacttggttccattctccccatcactttcaggtacaccaatcagacgtagatttggtcttttcacatagtcccatatttcttggaggctttctcatttctttttattcttttttctctaaacttcccttctcgcttcatttcattcatttcatcttccattgctgacaccctttcttccagttgatcgcatcggctcctgaggcttctgcattcttcacgtaggtctcgagccttggttttcagctccatcagctcctttaagcacttctctgtattggttattctagttatacattcttctcaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccctatctttgtggttttatctacttttggtctttgatgatggtgatgtacagatgggtttttggtgtggatgtcctttctgtttgttagttttccttctaacagacagtatcctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgttgggagaaccactgctctcttcaaagctgtcagacagggacatttaagtctgcagaggttactgctgtttttttgtttgtctgtgccctgcccacagaggtggagcctagagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccgtgggcataggaccctccaagccaggtgcgggatataatctcgtggtgtgccgttttttaagcgggtctgaaaagcgcaatatttgggtgggagtgacccgattttccaggtgcgtccgtcacccctttgtttgactcggaaagggaactccccgaccccttgcgcttcccaagtgaggcaatgccttgccctgcttcggctcgcgcacggtgcgcgcacccactgacctgcgcccactgtctggcactccctagtgagatgaacccagtacctcagatggaaatgcagaaatcacccgtcttctgcgtcgctcacgctgggagctgtagaccggagctgttcctattcggccatcttggccttgaaaaatattctaagtcattgccttacctttggaaacacttttagctagaactttgtttgctttgtattttcgggttcttggcagtaccagacacacagttggtgctcaataaacagttgttaaaaggatgacaaatatgcatttctacttaatttgggaaatggagaagtccagccacatcttcactgctatacagaaggctctaggtttgctggcatttgggcatatgctatattatatggtgcttgtattagaaaaagactagctttggaagaaggaagtcattgggaatgaataagtcaggaaaaagcatacttttctaaaaacatattaattttcttttccttttgtcttatctgaaacatctgccagtagccataatcttaaatgataatctcactgtattaaagcaataggttatctgagagaattaatatgttaatgggttaatacatgatcaataattagttaatttcctatccacaaccaattcacaaaagtgtcaagggagtaaggacagaccagttagcctggggttctgttgaagtctaaaggggaatcacagtaaggaagtcaagggttagcatgagggattggaactgaaaacaatcattgctcaataattgcgtataaggctggttttatgaaaaagattcaaatacaatcaaatatggtttggacataagcagcacaaagcagcatgtctggagtcagcaaagctgaccagcaatctccattctgccaaagagccacataacctcgggtgagacatttaatgtctttagacctcatgtcccaagtctgtaaaatgaaactatcgaactagatggactctaagttctgttccagcaataaaattctgtgatctcttgtcttttatctgatttgtcacagaacattttaatatcattgatttttaatagcaaaaaaagaaaaacaaacacttaaaacttattgctaacatactgagtaaacaatgacagttttattaaccatatgtgtaaagtgcacttaaaacttaaatagacaagcctgggcaagtaaacaagactccatctctacaaaaaaataaaaatataattagctgaggacagtggtgtgcaactgtagtcccagctactcaggagactgaggtgggaggattgcttgagctcaggagcttgaggctgcaatgagcaacgagtgtgccactgcactccagcctgtatgactgaatgagactccatcactaaaaagaaaaaataacttgaatagacagctctcagtttgtacctttaaatagtatgagaaagtagatcagaattacagacttgctactactaataataatgataatacattaaaatgggtctttacaaactcacaaaatattttctgattagaaaagttttatacacttgccgggcgcggtggctcacgcctgtaatcccagcactttgggaggccgaggcggtggatcacgaggtcaggcgatcaagaccatcctggctaacacggtgaaaccccgtctctactaaaaatacaaaaaattagccggcgtggtggcaggtgcctgtagtcctagctactctggaggctgagccaggagaatggcatgaacccgggaggtggagcttgcagtgagccaacgtcgcgccactgaaaaagttttatacactcaagttagaccatgcatgcatacacatgcaaacatatattaagaaaaatgtagaaatattctataatcctcaatgcagagagataccatgagcactttaatattaatctctttctctctaggtatctccctgtctcccggtctctctccatactcatgccaacactcacagttggagttctctacctattatattaatataccctactttcctcacttaacgtgagcattttatcatagccctaaatacattttacaaacatgattttgattgcttgaacaataatccatccttgcatatgccacaatgtatttaaatattcctctgctgttgggcttttggcactttctaatttttcacaatgattttaagtgaaatgtctttgtacatatgcctttgattgaatctctaattatttccttaggatagacttctggagaatattatggaaaaggaggctaaacttgaagctctgagacgatcctgaaatctaatatcagcataatttgacaaatagattaatatgcatgaatttccaggtttagttaaactaataggtgctcttgaaattaggattttcagtattttattataagagttacaaatctaagcattccatttgattctactgggaaatacattggcttaacacattcaaatttgcttttcttatttttaaattttcaattcctgcttttttcctttcatttcctttaaaattgatttctcacctcttaggctttatccttatctttgtactatttcattattcttacttccatttgtttccagaattattttctgttatactctatttccttcatcaaatatatcttcctcttacacctctctacctttttctttctatcataattcacacttctcatgtgtttctgttcctttttgatcttacaatggcttctttccttcctgggacccttccatttgaccctttgtattttcttccatcaaagccatgtttataaactagtattatggcaggacatatacgtcaagaaattggagagaagataaagcatatcgtttggataaactatttcatcaaaacttttgattcatctgtgtcccattttgtactaaggtggtttctagtcaaaacagtttactggtagttttaaggaactgcagtcagtacatatgaagtatctctcatcattaagagtagctagtcactatttacaaagtttctcttaaatattatttgagggactaatttgctttggataagaactttgaaatcttacatgagcataaaccctatctttgaaattcatactttatttatgtgataagaactcataatagtaacttccatattttcttttaaggtattactaatattattacttaaagagaaaaaaacattttgcaggaatagaggttcatctctctcaatacatttttcaaactgggtctgataaaagaaaattgtggaactgatgacagaacttgaggatctggcatgaattccaagagaagaaaatgaatgatcattttagaacacatataataataaaatcgtagtaacattcattaggaaataatgttctaagtgggagatacaaatctcacatacacctgacagctatgcacttgcacaccatgttttttaaaataatggtcatgaatttcacattgacaaaattatattactacatgaacataaaattgtattaatgtattaattaattgtattaatgggtggtgagtctactagtagttactctttttttcccatacagtataagcagaaaagtggctaatgcatttgacaaacttgtaactatgtaattgagaaacactaactcacttatctttcaaattttgtttctaagactcgacctcatagttcactattataaagatagattttttatttcctcaaagtgttatgattaatagtttcccagggaagggaggtgccgtatcacatgtcactgatcaatggtttcaacaactcatcttttcattcatttatcaaaactttaccgaccgtaatacaccctgagtttgtttggttaagatatgatgtaacaaatgatttaatagaagcattgaatatagttttggaagaacagaatgtgtagcttctgagaaagaaaaaattccaccccctgacatctagaaatggacttggcactcagaggtgaaccctgttactctcctactggacataaacaatctcacagaataccaaccacagacaagttcagcataaaatgatgataaaacaaaagaagctcatttcataattctgtgtaagtacagacaaaaacacgtttgccacattacccacaaaatgacaaacttccttatttctcaactaaaatcagggattgctacttcctgtcaatcgcagctttatcctttttccaggtggccctccttgtggataaaacttactgagaagcccaatcttagaattgctcctgccttctgacaacatctaatctagagaaaacccctgcgttttaaatgtcttccctcagattatccaatgaaagcccaaatcctttcaacatcctcttactgatatgtcccacagcttccatagccagtgccatcccttgctgcaaggagaaataaaccccatgtgttctgctgcagtggtgttcatcctggtctgagacctgaaggcattgcattcctctgtactaacaggaggaaaatgaaaacctcgcaggggaaggggcccagtgacagtcaggtcttaaaggatgagcaggagtcagggtgggtggaacaaaggactgtcttctaggcagaggaaacaggatctgtgaaggaccagaagacaacagagcgatagtttggtttgtttggaatgaaaggaacataggagaaagtggtggtttatcagaatgaaaaaaaaaaaaaaaagaaaagggatgaatgaatgaaaacaatgggagcctatgtcacctcctgttagtgacaatttatcctctaaggaaagggggaataggggacaatggcatgtattctcaatgtggagagcacactggcagaggcaacatccagcaaaaaatgtgcaatttatcattattttacatagtgatcacttggtgatctagaaatctaatttgttctttctctgctgttcttatctcttctttgatatgaatctgttaaattacaatttttgtctccttccaacttatgatttcaaggaagattaggaacagctggtcagcagctgtattgagcagctttgcatatacttgaaggacattattaaattgtcccgtgctttctattttacaattgcattttcttcgacatttccctcacaactctcttttttccaatctttcttcatgtctgttgtgttcaaaactctcgttgaattctctatatctcttcttaggcaggtactcacagctctagattagtctagtgaggaggtaacggctgggcacatcttatcccatttgtttattttttatgcctcccttcaaaaagtaaacagatatgtagtcttcaaaaagtaaactaatatataatatacaattatatattttttattttggaaaaaatataaagaaccatgtcagtatcagttttcataacttaaaattgctttcatttggaataattatgtttggtcactgatgtctccgttgcttgtcctctctctaccatcccaaattcattgttacgtgagtgtgatgatggagtgaacaggagaggaaatttattgttctaatagcatttaagatcattgctgttcaaaagtaagccaaaacacaacagaataaactgccaaacagaatcattcttttctagtttgaaattgtttgctaactaaaagtcatattaaatatgatcctggaattgaaaccacctttataaagattataacagtgagataagtttagcagggctgacactgtcttgcttttagcttcacaggctgtctgtcctcccttattctggggaagggccaagttaaccacaggaggaatttagtttgtagtttaactttaaggcaaggatgataatagtctcttcctcccttattctggggacaggccaagttaaccacaggaggaatttagtttgtagtttaacttttaagcaaggatgataatagtctcttcctaaaactgaccccatctttgttttgggactgaaactgcctttgtaagactaatgaaaaatgacaagattaggctatgggaggtgcctttcatagcatgcctttctataattgtttactgcaccagaagtcacaagatttgtgactctcccaactgatcctatagataacatcatattgtagaatctaagattggtcttttgagatgtgtttcaaacctttgcattctagtgactgactgactccacctggatttgtgcctcatgattcagcccatcctgtggtcccatctagaggcagactcagctcatgcataaggatagttttccctatgatttaattccccaacgaatcagcagcacacattccctagccccactgcctgccaaccctagcctgtgagttctcagggaggctgatttgagtaataaactccatctaccacttggctagcactgcattaattaagctctttatttgctaaatttcagttagttcagaggaataagttcaagagatctattgtacattatggtgattatagttaataacatatattgtataattgaaaattgctgagagtatattttaagtgcaaaatataagcatgtgaggtgattcatatgctaattagcttgatttagccagcccacaatgtatatatatatcataacatcatgctgtatctcatgaacatatacaatttttatctgtcaattaagaagaattaaaataaataaatctgtaatttcattgaccatttctcacaggttgttttaaagcataagttaaggtgatcaacatattcttctctttgttatacttttccctacttgatatattagtgagaatattaattatcacctcattctcaatgactaggttaattactacaattattttaactaatataactttaaatactactttagagtttctactcttagtatgctttatttgtggataaacacttttagttatctaggtacatttttatggcacttggatttgatgggaataaaaagaaattatcctgatctaaatctttagtctttctttgtattctccatatattagtcatggtttccatgttgttgaattgtccttttttggagttaacatgcctgatttctgtttacattggccaataagaggatgtagaactgcagctggtatttaattctaattatttgcatttttcaataacatttatttcagaaaaatttttcaagattattttttgctaagcacaagatatttgctattctgtaccatgttccctaaaagcataatgctaatagaaatctgcaccttgattaatttttatattaaaaaacaagtggctaggcacagtggctcacatctgtaatcccaacactttgggaggctgaggtgggtgatcacttgaggtgaggagttcaagaccagcctagccaacatggtgaaaccctatctccactaaaaatacaaaaattagctgggcatggttgtgcacgcctgtaatcccgggcaacagagcaagactctgtttcaaaaaacaacaaaaaaagaaaagacaaataaaaaaatgataaaatattacagtgttctgaaaagccccatacagcatcagctcacacatgtacacagatacacattaccaatagacgtatgatctacacataagaaccaagagagcaattttactttaatggtactttggttcctaaaaggtcattgtgaagagtggatttcttatctaattttacttgtttttaaattttaattcctaatctaaactagctgcctcatgtacgctttcagaagcacttgatgctggaaacagacaatatgatagagtgtggggatattataataagggccaaaggcgaatagtcaaacctgagaaaaatgggatgtgagttggtgatatcatggagaattaacttaggagttagtgggttaaaaatatgatctccagggaaatgagttcaaacttttaaaatgctggaaaaaagaattttaaatctgagagaatggatttcttactttggggacattctggtgatagagggtaggggattggtaaatgatttctgacttactgctgctgattttgaaatattttaccttcatattcttttacctatggctttaatgtccataacttaaaacagtatcttctaaaattattatgattccctaaatatgcatgttaaaaataatgaatactcgtcaaaaagactaacataaactctgttagataatagaaaagaaacagctagtagtcaggatttcaattttcataacttatttcctaactccatggtgtctaaaacttacttgaaagaaacattatttcctttatccctgtcatagttcttcaggctgtattatgcataccacatcctctgtagccctcagcctttggtggaagaaacgaaagaaaaaaaaagtaacaattacatctatttgatgtttcttctgcctatgaggtctttgtataagtaatgcacactaaccaatcatgccattggctctccatgaggtctttgtaaacctagaaaatgtttttctctattgaaacaaatctcattattaaaacatactgagacagagtaagatggctaaacaggagcctccactgatcatccatcctcctcacaggaacaccaaattgaacaactatccacacagaaaagtgccttcataagaaccaaaaaccaggtgagcaatcacagtacctggtttttaacctcatatcactgcaagaggcacagaagagggtaagaaagacagcattgaattgctgacactacccctctcccatcctccagcattggccacctggtgctgagagagtctgtgcaactgggggagggagagtgcagtgattgtgggactttgcattggaacttagtgctgatttgttacagtggtaaaaacaccgagcagaagtcagtggatgcccatagagggagcatttagaccagccatagccagaggggaattgcctatcccagcagctgaaactagggttctagcaagcctcactacctcaggctaatgactctggagtcctaaataaacttgtaaggcagtcaaggccacaagactgcaattcttagacaagtactggtgatgtgttgggcttggagccagtggacttgggggacatgtgacctaggaaaacaccagctggggtgaccaaaaggagtgcttgtgccacccctcccaaaaccccaggcaccacagcttacagctctgggacagactccttcctttcacttgaggagtggggagagtaaagaggactttgtcttacaacttgagtaccagctcagccacagtaggatagagcaacaggcagtcctgttcctctagttcctcttcctgaagttcctcttccaaaacctaactctaaaatgacatttctagatacaccctgggccagaagggaacccacttccttaaaggtaaagactcagtcctagagggattcatcacctgctgactaaagagcacttggtccctgaataatcagtagtaatacccaggcagtactcacaatgggtctttggtgagattcagagatgtgtagacttcaggtatgacctgacatattcccagctatggtggctatggggagggactccttttgtttgagaaaaaaagaaggaagagtaaaggggacttcatctgtcagcataggtactaacatgaccacagagggatggtgcaccaggtggactcatagggtctccaattccaggccttggctcttagatggcatttctgaacctgccattggccagatggaagcctgctaccctgaagggggcgttctaggcctggcatcattcaccagaagctgacggaagggcccttggtccttgaatgaacattggcagtagccaggcagtactctctacaagttcggggtggtggtgtccatgaggggagacccctctgcatgtggaaagggatggtaataatgggaaggactttatcttgtggcttgggtgctagctcagctgcagtagaatatagaaccaagtagcttcctaaggtttctgactctaggccttaactcctagatggcatctctggacccacctgggatcagggagaacttgccaccctgaagggaaggacatgagcctgtcaggcttcactatctgctgattgtacagccctatgcccttgagcaaacacagccagtcagcaattactctaggtcttgggcaagacccagtgttgtgctggcttcaggtgtggcccagcatggccccagcggtggtggccagaggagtgctggagtcacccttcccccagcaccaggcagcccagcacagaaagagactccatttgtttaacagaaagtgagagaagagaacaacagcgtctgcatggtaatccagagaattgttctggatcttatccaagaccaccagggcagtaacatatagaccaaggtggtatgtaagacctacagcattactgggcttagggtgccccctaatgcagatatagctgcagtgaagaaaaacttagatcataacacacatagcccttcaaatacatggaaaatcctcccaagaagaatgggttcaaacaagcccagatggtggcggctaaaataaatgcccaactcttcaatgcccagacaacaacgaatatccacaagcatcaagaccacccaagaaacatggcctcaccaaacaaactaaataaggcaccaatgaccaatcatggagaagctgagagatgtggtctctcagagacagatttcaaaatagctgttttgaggaaacttgagaaaactcaagataacacaaagaaggaattaagaatcttatcaaaaagatataagaaatagattgaaataatttaaaagaattaagcagaaattctggagttgaaaatgcaatagacatactgaacaatgcatcaaagtctcttaacagacttgatcaaccaaaagaatgaattagtgagcttgaagacaggctatttgaaaacacacagtcagaggagataaaggaaaaaagaatgaaaaagaatgaagtatgactataaatctagaaaaaaaagcctcaaaagggcaaagagtcattagccttaaaggggaggtagagggagagttaggggtagagagtttgttcaacggaataataatacagaacttcccaaaccagagaaagataccaatatttaagtacaagaaagttatagaacactaagcagatttaacccaaataagactacctcaaaacattcaataatcaaactcccaaagctcaaggataaagaaggaatcctaaaggcagcaagagaaaagaaacaataacatccaatggaattccaatatgtctagcagcagaattatttgtggaaaccttataagccagaatagaggggcatgacatattaaaagtactgaaggaagaaacttttattctagaataaaatatccagtaaaaatatcctcaaacatggaggagaaatagtttcccagacaaaaaaaacctgtgacatttcatcaataccagatctgtcctacaagaaatctaaaaggagttcttcaatctgaaagaaaaggacattaatgagcaataagaaatcatctaaaggtacaaaattcactggtaatagtaaatacacaccaaaaaacaatattataacactttaattgtgatgtgaatactattcatatcttaagtagaaataataaaagataaactgataaaaataataactggctggatgtgatggctcacccctgtaatcccagcactttgggaggctgagttaggaggaccgcttgagcctaggaatttgagaacagtctgggcaaaatggtgagacctcgtctctaaaaaaataaaaaattcgccatgcatggtggcacgtacctgtggtcccagctgcttgggagacaagggcacaagaatgtcttgagcctaagagatcgaggctatagtgagctgtgattgtgccactgaattccagcctgagtgacagcataagacactgtctgaaatactactactactactactactaataactataacaacttttaaagacacagtacaataagatacaaatagaaaccacaaaaagttcaaaaatgggggtgggagaaagttacagtgtacagtttttattagttttctctttgcttgtttgtttatgcaatatgtgttaggttgtcatcagtttaaaataatgacttataagataatatttgaaattttcatggtaccctcaaatcaaaaaacatacaacagatacacaaaaaataaaaatcaagaaattaaaacataccaccagagaaaatcacctccatttaacggaagtcaggaagaaaggaatgaatgaaggaaagaacacaaaacaaccaggacacaaataacaaaatggcaggagtaagttcatacttattaataataacattgaatgtaaatgaactctctaatctaaagacacagagtagctgagtggatgaagaaaataagatgcaatgatttactgtatacaagaattacacttgacccataaagacaaaaatagactaaaaataaggagatggaaaaagatatcccatacaaatagaaacaaaaaagggcagaagtatctatatttatgtcagaccaaattgatttcaagacaaaaactataaaaagagacaaggaaggtcattatataatgataaaagggtcaattcagtaagaggtaataacaataataaatatatatattcaattaacacggaacaacccagattataaagcaaatattgttagagctagagacagagatagaccccaatacaataacagccggagatttcacaaccacattttcagcattggacagatcatctagacaaaaatctaacaaagcaatatcagacttaatctgcactatagaccgaatggacttatatagatatttagagaacatatcacccaatggctgcagaatacacagtcttctccttagtacatggatcattctcaaagacaaatcataagttagaccacaaaacaagacttaaaaaactcaaaataactaaaatattatccagtatctcctctgaccagaatagagtaaaaccaaaaatcaatgacaagaggaattttggaaactatacaaacacatggaaattagacaataagctcctgaatggatcaataaagaaattaagaagaaaattgaaaattttcttgaaataaattataatggaaacgcaacatattaaaaccattttattttattttattttatttattttatttttttgagacggagatttgctcttgttgcccaggctggagtgcaatggcacaatctcggctcactgcaacctctgcttcccaggttcaagcaattctcctgcctcagccacccaagtagctgggattacaggtgcccgccaccacaccaagctaatttttgtatttttagtagagatgggattttaccatgttggacaggctgttctcaaactcctgacctcaggtcatcccagagtgctgggattacaggcatgagccactgcacccagcctaaaacttattaaatgcagcaaaatcagtactaatagaaaagtttatggcgataagtacctgcatcaaaaaagtagaagaacaatcttatgatgcatcttaaagaattagaaaaatattagtaggagaaaataaatgataaagatcagaggagaagtaagtggaattgaaacgaagaaaacaatacaaaggtcagcaaagtaagtttgttttttgaaaagataaaatcaacaaaattttagcgagactagctaagaaaaaaaaagagaaaaagatttaaataataaaatttaaataaaatccaggttaataaaaaagacattacaatcattaacatagaaattcaaaggatcattagaagctactatgagcaattatatgccaatgaattggaaaacctagaaaataggatgaattcctagacacactcaacataccaatattgaacaatgaagaaatccaaaacctgagcagatcaataacaagtaacaagattgaagctgtaattaaaattcacccagcaaagaaaatcctgagacctgatggcttcactcctaaatgttatcaaacatataaggaagaactaaaaccaatcctattcaaactatcctgaaacagataggaagagggaatacttccaaactcattctatgaggacagtattaccctgatactgaatcttgacaaagacacatcaaaaaaagaaacttaaggtccagtatctctgatatatattgatacaaaaatcctcaacaacaacaacaaaactagcaaaccaatttcaaaagcacattaaatcatttatcgtgaccaaacagatttatcccttggaagcaaagatggttcagcatatgaaaatcaatcaatgtgatacactgaaggacaaaaaccatatgatcatttcaactgatgataaaaaagcatttagtaaaatttaacatctcttcatgataaaaataaatcctcaaaaaactgggtatagaaaaaacatatgtcaacataatgatagccatataaaacagccccaaagttagtgtgatactgaatggggaaaacctgaaagccttttctcttctctaagatccagaacacaaggatgcccatgttcatcacttttattcaacatggtattggaagtcatatctagacctttgtttgcaggtgatatgatcttagatttggaaaaagctaatgactctaccaaaaaaaaaaaaaaagaaaacaaacagaactaaaaaacaaattcagtaaagttgcaggatacaaaagcaatacacaaaagtcagtaccatttgtatataacaaaagcgaacaatctgagaaagaaatcaagaaattaatcctatttacaataactaaaaatggaatggaataaaatatctggaaattaatttaaccaaagaagtaaacaatctgtacaagaaaaactataaaacattgatgaaataaatttaaatggacacaaagaaatggaaagacatttcatgttcacggattggaagaatcaatattgttaaaatgttcaagacaatctacagatttaatgcaatctctatcaaaattccaatgacattccctacagaaataggaaaaaaaaatactaacagttacatggaaccataaaagacctagaatagtcaaagctatctttagcaaaaagaacaaaactggaggaatagcattacctgacttcaaattatgtagagctatagtaaccaagacagtgtggtactggcataaaaacagacacataggccatcacaatagagaacccagaaacaaatccatacatctacagtgaactccttttcaacagaattgccaagaaagtacattgggaaagtgacagtctcttcaataaatgctgctgggaaagctggatatccatatgcagaagaatgaaactagacccttacatcttgccatatacaaaagcaaatcaaaatgaattaaagacttaaatctgagacctcaaactatgaaactactagaggaaacattgggaaaactctccaagccactggacttggcaacaatttttttagtagtacccaacaggcacagacatccaaagaaaaaatggacaaatgggatcccatcaagtaaaaaaggtcctgcagagtcaaggaaacaatcaacaaagtgaagcaacaacccatagaatgagagagaatatttgcaaactatccatctgacaagagattattaaccagaatatataaggagttcaaacaactctatagaaaaaaactcataatccaataaaaaatgggcaaaagatctgaatagagatttctcaaaaaaaaagggacatacaaatggcaaacagccataagaaaaggtgctccacatcattgatcataagagaaatgcaaatcaaaactaccatgagatattatcttggttaaaaaggcttttataaaaaagacagacaataacaaatgctggtgaggatgtgaagaaaagggaatctttgtacgctgttggtgggaatgtaaattaatacaatcactatagagaatagtttggaggttcatcaaaaaactaaaaatagaactaccatatgttccagcaataccactgctaggtatacacccaaaggaaaggaaatcagtatatcgaaaagacatctgcattcccacgtttactgcagcactattaacaatagccaagatttgtaagcgatctaaatgtccattagtagatggatgaatggatttaaaaaaaaaagtggacatggtggcttatgcctgtaatcccagcactttgggaggtcaaggcaggaggatcactagagcccaggagttcaagaccagcctgggcaacttggcaaaacctcatctttactaaaaatagaaaaattaccctggcgtggtagcccacacctatggttccagctattcatgatgctgagatgggaggattgcttgagcctgggaggtgggggttgcagtgagcctagatggtgctgctgcactccagcctgtgggtcagaatgagaccctgtctcaaaaaaaaaaaaaaaaaaaaaagaagaagaagaaaaagaagaaagaaaatgtggtatatatacatgatgaaatactattcagccataaaaagtaatgagatgctgtcatttgcaacaacgtggatagatctgaaggtcattacattaagtaaaataagccagaaacaaacaaacaaacaaagaaaacaaacaaatgttgcatattctgactgatttgtgagagctaaaaattaaaacaattgaactcacggagatagacagtggaatgatggttaccagaggctgggaagaatagttgggggtgagaggagtggtaggaaggggaatggttaatgggtacaaaaatataattagatagaatgaataagatttagtatttgttagcacaacagggtgacaacagttgacaatcatttattgtacatttagaaataaataaaagaatataattgagttgtttgtaacacaacgaatgaataaatgtttgaggtgttggataccccatttaccttcatgtactattacacgttgtatgcctgtatcaatgtatctcatgtgcttgataaataaatatacctactatgtacccacaaatattaaaaattaaaaaaatattattttatgacttaatattaagagacaaattcttacttttaagaggactaaaaatcagaaggttttcaatcaccaagtacaaaccaaataaaaaatatagttacaagcactggggcagtttctactggcaaagcatattaatagaaaatctactttctgaatagcccagggtttgcataaatgataatgtttgtcatgccactgttaaaataactgacatatctaaaagcactttgcatgtgaataaattcataaaataaaaggcattgagttctttatgatagaatatagaatatcaatctcatttctcttatacaaaagaatcttcagggtgttggaagaataagtgaagcatacaattcgtacaaactccagaaagtgtcatttttattatatgagctttattattttttaaaatatcatgtatattcctatattatatgtttccctgactactattttcaagttaggacagaagatgagcttgagtttttcttaagtatattttaaccttatcatcattctttccacaacctctttaaaaattgctttagcacactgtcatttactgttaaaatctgacactgttggccaggcacggtggctcatgcttataatcccagcactttgggtggcctaggcaggcagatcacttgagctcaggagtttgagagcagcctggccaacatggtgaaatcctgtctttactaaaaatataaaaattagcctggcatggtagcacacacctgtggtcccagctactcaggaggctgaggcacgagaattacttgaacccaggaagccgaggtttcagtgagccaagagcatgccactgcactccagcctatatgacagaaagggactttgtcttaaaaaaaaagtaataacacagtttaaaactgttaacatttacccaattatagtaaaaatgtcaagtttgatagaagtataaaatgataagaagtaaaaatttaaaaatcctctctaactccttttcctctcccagaaacaaatactgtaattattcatgttgtattcaaagtgtattctacaaattttaaaagttaaacaatacaaatttgagaacacaatagaataatgtacacatatagtctgccaagttgactataggataagtaccttgaaatgaaacactggatctaaagatatttatcattccagattttgagagctatgctaaattgcccttcaaaacaaaacaaaacaaaacaaaacaaaacaaaaaaggttactgttaacagtgtataaacatacttttatcctctgggttctattaaacatttcattttttttcaatcatatatggaaagtgatatcttggtgttatgttatgtgagtgaggctgagcaatttgtcaaatgtgcatttctattttgctctttctgtgaactgtctgttcatattctttgaccatttttctcttgggttgttcaactttttctattaacttgtaagaattctctgtataaaataaattaattctctatcacacgctttagaagtatcttccccattttgtgtttgtcttttgacttgtttatggcattttcaactccatagaagtatttaatttgcatgtataatatgtatccatgttttcctttatagcctccaaatttattgagatacttacaaaggccatcttactgaatatgtttttaaaaagttttcttgccattattttctctatcttctcttctctttatgtttaaaattttggtgcttctagaatccaatttgatgtaaagagtaactaagaatacagttgtatgcttctataaatggttaggcagtcctaagacaatattttgtccagcctatcccagtgaacaaaaatgccaccttaatcaggtattaaattttcctaaaatatatttctgggcctctacatttttccatgaatcttctacttttgtaccaacactataccactttaattattacagatgtgttgaaatgtgtttaatatgtagtagaactgaactcgctcaatctagagtattcaataaacacaatagaaagtaaatgcttgaagagacaattaagggcacctaattcagctccttcactttggaggtaagaaaactggaggccaggaatgttccaagactcatttgaaattccatagaagttcacgggagagaggcactagaacaaggattctctcgctagtattctagtactcattcttctgagccatgctaataactattaagaaatacattcccatagactttaatacttctcaaattatttctagtccatgtttctgtatgacacgtatttttctattctaattttttatgcctttgaaccttcatttttctataaacttgtgatactttcattattatacttacttacaaacacccatatcccatgaaaaagagtgggagacaaaccaaatctgtcttccaacatcctttgtcatggtctatttattttactcattagaatcctaagtgggattgttctaatgttaaaaacattttcaaaccgatgcccaattgaaaggtacagttttgactgatgattaccatgggagttgtcagctagaggtggtcattggcatgttcatgagatctgtggtttcgcatgaagtgtaaggtattgtaaggtaatgcaagcaccactgagggtatgaacacaatacacatctaacttctattagacttaaaaatgtgaaacagttatgtaaaaagaatatgaaaatatgtgatggaatcacacaatgatttagagaaagaaacttcgcaattcgcacaatgagaaaaagaagataaatttaagaaaattttagaaaatagtaccagattaaatcaggatatcaggtcagtgtctctggaggtctgccagagaaacaacagcaggtgtggaaatcgaagaatattagagtctggtaagtcactgcctggggtggtttcatataaagaagctagacggtctacagaactaggaatccatcttactctcatgccaataataaaggttataattttagacaattatgctatcacctagacaattctaactgaaaaaaaaatactcattatatgaaatttacccaaaccattgtggcaaaattaaggatttggatgttttccagttgaatggggttggtcacatgatattaatgaaagaaagcacatagtttccccaaagctaaaagatctgaaacactttaatataagcagtgtggaatgagagtttaagccaaaatgcagcatcatttcttatctagaaggcacattgtacaattgcagaatgttgaaaagggtcatatagattaggaactagaaagaatcacttgaattaataactttcacccaaagagagtagaaaactaatgctcccatttatactactctcagagaattagacgcagatgcctctcagcactacagataactacctttgacacaaacaagtaagggatttttattttcctttcgagatgggttggtatgtgaaagtgttactacaaattgttacttttagaaacgagtttccatcttgaataccagactacatgcagcatggctgttccttatcatgaacaaaggcattgaataataatgtcctcttcagtaacaaacatttgttcattgctcaggagtttctcatattcattaggagctgaaattttaaataaatgctcaatttcttaagtcttttctgtctctctctctctctctttttttttttttttttttttttgacagagtcttatactgtcacccaggctggagtgcagtggcacaatcacatctcatggcaacctggacctccctgggctcaggtgatcctttcacctcgatctccccagtagctgggattacaggtgtgcaccaccacgtccagtaatttttgtatttttggtagagacagggtttcgccgtgctgcctaaggctagtctcaaacttctgggctcaagcgatcctgccaccttggcttcccaaagtgttgggattacaggcatgagccaccacgccccgcaaaaatatctttaaaatttatataataaaataaatctctctcctctaagatctgttgaagtaaaatccatatactaaatacactcatatgtacaattttcttatacctgaattagaaagaacaacaatattggtccaaggatacaaatttcagttagaaaggagtaagttcaagagacttattgtacaacatggtgactatagttattgacaatgtattgctgaaacatgctaaaagagtagattataaatctcaccacaaaaaccatactttatgatgtaatatgtatgttaattagctacagttagccattctactatatatatttcaaaacatcatacatgataaatacatacagttttatctatcagttataataataataataatagtcccttgcatttataaaaagagctgcagttcaatacataaattattcataaacatacacttcataatttgtttttaataataagaaaaggaatacaaataaaatttactgaagcatttttattataacaaaccaaatcacctcacagatatctgagtgatattactttaacaaacaattcaagagtgacaaaagcaaaaaaaaattgtattttgatttatcaaatccaaactgtagagttcatcttaaattttacttaggatttagagaaaatgtaaaaagcattcacttgtgtctattagatccaaataccctaaactcactggcttaatttatcagcttgaatggctctttgtcaaccttagtgttctgcgttggagaaaatgtgccaatcatcacagatgtctttacaatgaatatgagttcaccacttttagtgattagattttagagagtaacatccaaaacagtgagcatcttttgaaaggatatggcaaagttaaagtactggggactgctctaaaacaaattagacttccaggtcaccaagagatcagtacataaaataatgataaattgcatataatttgctggatggtgcctatgtcactatgctactcacgagaaaaaggaataaataagagacacacagttattgatgtatttattatttgttatgtgcagcaacattttgccccacagaaattctgtggtggatgcctttctgaaacttggaatatcaaagatttatagtattctcactggcaagagaacatataagattaatcagctccttaatcatacattttgcctgacctcatgcatttttttcttaaacttcgcaaccattataaaccacattttaaatgtctttgaacatcaaacatgttccatgattggttttgtccatattgattttaaagccagtcacagtagtacataaggggttgtatgtcaggggtcaaaagaagagacacaaattaataaagcattcactctgtcctcagagagctcctcctctgacaggagaggcagtgcttgattaattatcacaatgtaatagagacacttgcaaagtattataaaatctctttgtccagaaagtcatttctagtccagaagaaaataaattgcttttaaataaatcttctgggatagtcagtgcacatctaactaatcaacaggggaaaaaactttatacagacacttcattatattactcccaatatctcaaaccaaataaaccttcttccttcaaccaggccattctccacaatgccattaatcacaccttgctcatctctccatcttttccagggggaggctctgctcttcactttcagctaagttattgaaggattactttggcgtaggtagttttctaagagctttgcctgcatcaactgatttcatcctcactgtggctctaaaaagtaactacttattatttatttttagagatggtgttatgttttgttgcccagggtggagcacagtggctaatcacagtactatcgtggcatactatggccttgaactcctcggctcaagggatcctcctgccttggcctcccaagaggctgggactataggcacatgcctgcatgctaggcaaaaaaaaggaattactctttaacctctttgacagatgaggaagtgagtgcaagtgcaaagatcttaagtaattcatcacacaatgaacaaactttcaaaatggagcaatctactatcttcagagctcatgctcttaacgattatgcaggatttacacactcattctcattctttcaagctaaacagctgtgatggctgctacaaagtaaatctagtgcctattgcttctgtcactcactttgtatttctgtacgtggttacaactgcatgctttacgtctttggaaagatcaccagatagggaccacagaccaaactttgaatctctttcagtgcctagagatgaaaggatgcactcaatgaatgttataaataacaacaaataacaatactttatcttaatcatgattaaacttctgtcccttagagtaaaaatagtaggatagtaaattcctaaagaagtttctgcaatgttgtaggaatacagttcttaacatatattttttcactgttcaaaaattttaagctgaatggcaccttatagatcttagaggcaatcagccacaaatcacacagaactctctctgtttgttatatcaagattgactttattctgtaaaataatttcttatgcatcatctggatatgctacattgaggaggcatacctattataattaataatgaaggctttttgagccaaagtatgaagaaataacttgttgatgcatttaaaacaaaactttagacccccacttcatgttttatgtacacaatccgtaagtggtagtgtccttcttaggtgatatttagtaccaaataatcaagataacaatctatgtgtataagttataagttataaatttggggaagatgctaagaattttttgttccagtaatatttttcattaccaaattgttacttgatttttgttttatcaattttgaatgttcaacactgctgaaaaccgaaaaagtacttcaatatttattatttgtttgatgtgtgctatataccagattgtatttaccctgtttaacacaaaatggtggtaagataatccttaaaatatctttattttttgtagtttaaagaatttcagagctgcagggcactttataggaaaattgttttcttgactatgttggtcaaattaaaactggtgagaatccaatgtgtttgatttcaatgtgtttgattattaacaagatattgtaccgacaatacaaatgtatttaaacatgaaatacattttcaattatttgcaagtgcagtacaaggctgggcatggtggctcatgcctataatcccatcatgtgggaggctgaggcaggtggatcgcttgaactcaggagtttgataccagcctgggcaatatggcaaaaccctgtctctatcaaaaatacaagaaaattagtcatgcatggtggcgcgctcctggggtcccagctacttgggaagctaacatgggaggatgacttgagcccgtgagattgaggctgcagtgagctgagatcgtgccactgcactccagcctgggtgacacagtgagacccccatctctaagtaaatacatacatacatacatacatacatacatacatacatacatacatacatacactacatttatgacctaagaactttatcttcaataataagtaggttagagctataagaagataggaatctgcctattatcaaagaatttaatgtttctgtccaatatcacacattaattcaacaaatacaggttgagcattcctaatctgaaaatccaaattccaaaatactcaaaaatccaaaaatttatgaacattgacatgatgccccaatggaaaactccatacctgacctcatgtgatgggttgcagtcaaaacactgtcaaaactttatttcacgcacgaaagtatttaaattattgtaaacaattaccttcaggctatgcatataagatgtatatgaaacgtaagtgaatctcatgtttagacttgggtctcatccccaagatatctcattatgtatttctaaatattccaaaatatgaaaaagtctaacatttgaaacactctggtcccaagcatttccgataagaaatactcagctggtactaactgaatgggggtgttcactatactaggccttactagaggtccaaacatggataagatacagcccttctcctcaaattgcttatattctacactggaaaacaaacaataaacaggcagaagtgaaacaacaatgagagaattaaacaactcaagagaacagccatgagcattcaagagtgtttacatgctataactcaaaatatggtcatgtttcagtatagaacagtcaaaatcatagaggttaatcaacaaccaaatggagcccaagaacctggattgaatgggaagacttgattcccaatagctattagactctctcacttcttacattcacttcttcattcgttgtggttcaaatttattgtcccttgacgtccctccgacacaccagggtttcccctgggctacaaccttggcatacccctgtttcagctggaaagaccttgcctcacaaattgcttgaatccgttttgctgcaattacaaaggataccaaaatatctgcttacatttaattggtcaaagcaaatcacatagttcaagcctaaggttagtggatgggacgtcaaatccacttcctcaaaggacaggcctcatgtgagggctttttgccatttccttcaagttgctcaaatgccatcttctcagtcacctccctctgacccctttatgtaatgtttctacccatctccccacacacaagcatgcaaactacattcatattcctctattcccctccattgctttattcctacccttagcctcacattgtctagatattgggtcaatgaaacaaagagcattttccaaggtaaagctaaaatgtttacacaaaatacaatttaaagatctctaaatcttactacattaacatcacttaccatcacttaagaacccaaatcatcaatacctgcaccatttattgtctaaattatgattttctattcccctatcttaatcaacatgactttagtcttctgggaaactcttaccccaaaagataaaagttgcaagtaactttgttgttcatttcagaaacttcatgaaattccacttcaatcaaccactgactacttaacttgcaaatatagtatcaaatgactgtgtattccataaacacccctaacaaattctctcctagtagtatttatcaatcttcaattattatatcactagtgttatcccatccttaaaaaacccctgctttaaaatacctgtctgtaaaccagattcccaaacctttctttatctctaaatatttctactttgcccttccttctcttagatgttaagactctgttgaggtagtaaatttcctataccataggcaggaataaactcagttttgttttatttaaggttattttggtgacattttagaggacctagcattcaatctattttctgtgagccagagagacatgtgagacactagactcaaagttcaggacaaaccataatcctaattcacttctttgaatttatgcttaaaatatacataactaaaaaggctagaaagcattttgctaattctacttgcctgtgcactcatctccattgagtacacatggaaagccaaagaaatatttttgagctaataaggactaacagttttatcatttacttatcaacattttaaaattacaatgagaaaaaaagtaacaaaatataacaaggggattctttctgtcacttttttggctgaagcaaagaatagatggaaagtatcaccacattacaaagtgagttgctagacccgggtaggatacgtaaaggatatgactgacctcactgtgagttatgtgacatgcataacttacacacaacaaagttttgggcaaagcacacagtgcggtgctagaaaatacatacactgttttatgaagttagcatattaataacctacagtgaactttcaaatacttttataagctaaaatgtcatcacactaacatgctagtatgttttataaggtttgagaggtgccttttcaaaaattaaatattagcctatttttccctatggttaccaagtcataaatttctgtgattcctgtctgccattgatgtagcattttaatggagttcccaaatgttgttgtgcttggcttatatatcatcatatcttggtcatttccaagcttgtttagaagtagacaaccatgtgatttggctggcacttacattttatgtaaaatatactcattgacataaaaacaacaataataaccacaacaaaacaaccatatagcttgtatatgtcaatcccctatgaatctgcctctgtaacacctaattattaataaggtttacagaggaccttctacggtaaggcactgcactaaatgcttcacgtttattttatcatgtaatcttcaaccctcacaagagccctctgaggtaggcactataattaatcctatttcaccggtatgaaagccaacagttactcttagttgcctagaggtaaatagaaatagcagtgatggagtctggattcacatcctggtttcccagctgacaccaggaccagagctaataactaaaagaatctctgtatacattgttaaaatacagagccttcaagttaacaagtttttacaaagtcctgttaaaattcaaataaaataactcccccatcaccaaacgcaaattctccttaaggaaaattctatatgtgttatcacttcaatatatttatcctgcaatcatgagacttttgggtggaatataaatacttgacccttggaatagtgatttaaggtctctgaggtacaaaatgacaaatatattgaactcttgaatggactgcccaagaaaaatatatgctgctttctttttcattgacaccctgaggctatactaaagacttattatatctgaataacaaataaaaattaattgtatagtagccatatgagatgtaggaaattacattgatattttgtgtttagagatttaatcatttcgtttagaaaaaaatactgaaaaagcaacattaacaaaaaccacatgtgagagtatttttagtatggagaccctgatccccaatctcaaacaaaattttactttaaggtctatggcagaaatgtaatgagagtcatatatgtgatttaaaattttcaagaagccaccacatttttttaaagtagaaagaaaagtagaaaatatcgagaacatcctttgtattcttttttcatacttagtctggaaaatccagtgtgcattttatacctacagaacatctcagtgcacactacccacatctcaaatgctcattagccacatgtggtttgtggctgctgttttagatagtgcagatctatattctatgaatctcctaacacagattttttttgagaaacaaaatgcttttggttatagacgaactattatatgctatctgagattgtcagtttaattcagtcaacaattaactcaaaatgtaggggttttttggtaggaaattagttcctgtgtgaggattccagacactaggacaaagtcaggtaaattttattttactgctcacttcctttttagagaccaatatttgttattatctgattattaagcaggcatataactaattatattgcctaataagcataagcttactacacatgtaaattttacaacccctatattaatctcccaacatctctctgggataagtattttactattttatttatatgaaaaaatatttaagagctaaaagagattagttactattttagtctgttttctgttgctataaaggaattcctgagagtgggtgatttataaagacaaaaagtgtatttgactcatgattctaatgtcaggaaaggttcagacatcagaacctggttgaggatctagtgagggcttcaggctgcttcatggtggaagatgaaggggagccggagtgtacagaggtcacatggcaagagaggaaacgagagagacacagagagagagagagagagagagcgcacgagcacacgccagcctctttttaacaaccagttctcaaaagaactaatagagtgagaagttgctggccctctagggaggacattagtccatgaggaatttacccccatgaccccaccacctcccactaggctccacctccaacattggggatcaaatgtcaatatgaggtttagagcagacaaataataataatccagaccatagcaattatttacctgaatttccacaactaaacataaaactcatgctctgaaccagtggttctcaaagtttggctcaagatcagcagcaccatcatcacctgagaacttgttaaaaatgcacattctcattcagactccagacttactgaaccagagacttgcggtgggccctgagtccaacaatcagttttaacaagctgtctaggtgatggtaatacacatgaaagtttgaggacgactgctctgtactgctatactgcactacctcttcccagtaaatacctactatagaatatacaaaaatattcaaaaatgatataaaacctacccaccattacccaaagcaaatcattattaatatgtggtgtattaaattttcttatagtacttttccttttttttggtgttggtttgtgtgaatgtccatatttatatacacatacacattttcttttttacatttgatagtgtacgtgcttatataaatatgcatatgtgtatgatcatatgtaccataacaatacaaaactatagtcttgaatgttacgttttaaagacaatgctatattgcatgctacaagtaagttttgagttagatttttttaaaattaaagaagttctcatggtggggtgctgcctgggaggtgaattattgggcactgggtgatgggggaaggcaggcgctaagaaggacattattatatgctgagaatttaattcatctaagcttcctaaagtgctaatctgatatctgttcacagctatgtttctgcttttcctaaccaattttattctagtttgattttaaacagtgtttgttttctattttgtgctgttttgtaagctgaaaatattttgtggcaattttacttatcaataataactacagagagaatttaacaaagtggaaagttaaaaataatgattttttctgcaaatttatttatctattaacaccaaaatctctaaccccctctctcactacttcatgcagttacaaggagatgtatctccagagctggaggatggagtggcatgaataaacgttgttggtcactggtattgcaggagccaggatcctgaccccatatggtgcacagtggagcatgagcttagtgactcaaacatcatatccctccctgcccaccccacccccacccccacccccaccctcctctctgatcactttgttcagaaaagtcttcatatactaacgggtgtgactttttgctcatctcacacactgtgggagctaaatttatcatgagctaaagatacccttatttttccaaaccatcacagtgtcatttgttcccaaattactttataaccaaccctgattacccacagaagattatctgattactgagcagttaaatgagagcacttctctgttctccacagctaatttccccactaaggggagtaggggaaggtctggtttgaaaagctaaaataggcaactgcccaggtgatgtaatgtgaaatgtctggtaagaaaagtcttttctctggcttaacccattgccgtccatcattagagaagccagctacatgacatggcaacatttttcttaatagtctttaagaactccttgtaaaattaaactgccccatactcgggaaactttttaaacagttggtcaaggtgactatggtcagggctactagagcatatggaaagttgagacaaagcaggaacccttcttaggaacctgacagacacccccccaaagcaagccagagtcaaacaatgctttggttccctaaagaaactaaaggataacatcttaacatacgttcttgagttatttttcagaaactcctaccagatggaaaatgaggtctatcacatagacttcagataagggggaatgatacagacttcagataagggggaactgaggactgaactttgatcatctttgtttcgaatttcttcctgaggaccctggagagagtcacaggtatggaccagaccaacctaacacctccatgtatcgatttatgattttgcttgcaatttcccctttcccgaaatgtacccctgcctttaagaacccttgcttgtcagccaatggggagctcaggtcttaagtgttagccaactctattctccctgcttggcaccatgcataaatgccctttctcctgctgcaaatctctgcatcagtgtctgactttactgcactgggtaaggggaccccagtttggtttgttaacaaagccttcaggcaacttagagactggctctctcagcatgtgtgtcttaggaaaaggggcctctctgacccagcctcttgcccactgatggggtttctttgtgcaggacttaacactgtaaccaacagcaaaacctaagtgggctgactagaaagagaggtagaacagtgccagcgtgctggctcggggttgccttatgtggttagccatgaaagtttataatagaacttgtctatgttgccaatagtttacaatgcagtttagttgcttaagttgctgccatactctttcatctatacagaaatcaaaattggctatatcaggtgtaggggcaaagagaattttccctcccctcctgaaggttcgagtctgtggaaataaactgacaatagacagatagaaggagaaaagacatagaaagttattaatgtgcgtaagcatgggaatcatacaaaatttgagactcaaagaggggctggatggctgaagcttaaataacaccctcttcataggagaaatgcagatgggaaaataaaggcaatgttgaggagtagtaagcaatttttaggataatttaataggcagaaaataatttgtaaatgattctctttggaaattaaatgggactggagggcaggcaatagcttctgaaaaagcctaggtgtgatgacattcttcagttttccttcctacagtatgagtttaatcgcccctggtcaatgatatttcagggaggagactgaaggccattgtgctccttctggagaagcttcagataagagaacttcagagacagaggagttctatcctgtgcttggaggtagaagcaggagaaggttaaagttctccattctgcagctgcttctaaggccttttaattttctttagttcaaaacactcagcatgccagaatgccatacttttgggtactgttatctgaacctcaacactggaaatgtcttgtatgaaaataaaacaaagcaaaataatactgacaactcagatttatacagtgaccatcatcacaaatataatctaataaacagaacttatatagtttaatatatttttattgtaaagggccaaaggcattgacgatgtattaagaatcttcatgctttttcttagctgctatttataaatatgtagctttcctagcgttggaaacgctaacctttaacatggttcaaagtaagctagccttcaaaaccatattactcataacaattgtcccagcatcacagagaatgtgacattaaatgatttttaatttgggattttttaaagttttaaatagaaaccgcagactgaagtatactagagatattttagcttcttttggattatctctatgtttccctttaatttcagtggatcagcttagtatttgtggcctttttgggtctctgaagttctgtatggcaagtgcctgagtttagatctgacagaagatttcaactgtcaacaccaccagaaagaaataacataacagctaatttcacagggggtcgctgtgctggcctctgcctcaacaccgtgacatggggcacaggatagatgatgacaggagaaggttgttattagccctattagctcccagagagtttcaaccacacatcaaataatgccttgtttaaaaagcacttaaacacgtttcacattgttttcaaaatgctcttccccacgtcattcccacaatcacgggaaatggtggagttgatgaaagagggaaggaaaagtaaatttcaatacgcttttattggaagtcaaatccccagctggaatctgaatttacaatacaagaaagcagaaggtaaatatactgaagtgaggcattgttagcagttctctccgctttttgagaacagcttaattgaagtcctaccaagatagaaatgatcacttagcaaaccacattttaaaggcatttaatggagcaactcaatccctagtggaactaactttttaaaataaaagagcaataagtaacagttattatgggtggataacaaaattggagtctcatatagctgcttatttctatcattttgatgaaatatgggttgctcagaatttctgggtagaagactgaaatgcctgtctcttctgccaggctaagaatttctcaggtgcaaggctctttgtttactcagtaagtgctcaatgtttggaaaaaataaaaataaataataaatgaaaaatatacttcaggcttatcaccttttcaaaataaaaatcaatgtgggtggagtacaaaactgataatatttaacacctatacataaaaatgcctttggtgctatgtatattgattgtaatgtttatgaaactgcctttgcaaaattataacagcaagagaaatgtgacatagttgaccccatcttgcttgtgatctccaagctgtttttggttattcctggttataggccaagctaaatttagcagaaatttagtttatagtttaacttaaaagcaaggatgataatagcccttctttaaaaaataaccccctccttgctgaaaacagcctttgtaagactaatgaaaggccacaagaataagattataggaggggcctgaactctgataaatttctatagtttccataatccctgactgctcaggagtcatgtggccagaagtcacaagttttgtgagttccccagttgctcctataaaaaacatcacttctgtaaaacttaagacttttttagagattctttttcagactttttggcaaccaactgaccccacctgggcctatgacgcatgactcaacctgtcctgcggccccacccagagaaggactcagcatatgaaaaccattttccacatctttatgatttcatcttcaaccagtcagcagcacccattctccagctccctgcccaccaatttgtccataaaaaccctaacctctgagcctttggggaaattgatttgagtaataactctgtcttttctgtggcatggccagccttgagtcaaactcctttactgcaatgccacagtctcagtgaattggttttgtctgcgtagtgggcgggacgaaactgttgggtgattacatattcaccttgtttagatgatcagtttcctaactgagagaagtcattccagagaatggtactattggctaagattgaagcaatctgtgatcatcaattatgattataacttttctcaatcatttaacatttcagtacttattgactacccacttcctttttaggcaagataggggatacaaagaagaatgagacagatccttgtagaggaaattttcagaagaatgacttcaagtgttatacaggtgacatatgtatacatctttatttgatactcatcagtgacacatgccaggatctctgccattaattagctagctgtgtggtctggggagaatcatatatgtctgagtcttagttatttttttttaactaggataagaataaatagcatcataaccccttacagcattatcctgtattattctataatattctaccctgtggtttttctttcccacattctctagtttcttcataccactttccctgttatttcagctacatttgacactaccaatttaccactgttttgaaactgctcttccttagtttgtttcaataatattacactatcttggtatttttttcttcatccttttctaactcccctatttcctttactgcttcctctctgtcttcacagatcccaacatccaacttatggctctctttgattccagtctctgaactttctcccttaaaatgctatacagtctcacctaacagctctgtgctaataagttgcaattttcttcctagggttcccttgatgaagctagccttcatggatttccatcttctctgaactccgggacagcacatattgacgattctacatactgaaaacacaatcatatagcattctgtgccatcacatatatgtcaacttcatctcccctcatggactgtcagcttccggagtctagagaacatgttttatatcagcattttacgtctagcacttggtgaatgaggcaccatagaactccattagtacatcatttggtgggtaatggacttaagcctctgaggctgtaaatctggcacctctgacacatactaaataattggaatcagcttgccttgtgttctggctttataaagcttttataaagcccttcaacaacatagttagctttgaagaagccagatttgtttacataaccttataaaaacaatttttcttagagaagttttttaaatgtgggtgatttattttcctatgctagggataataaggaaaacaaatatttctgcaggatgcttgctatggtgtgagtgatttttttttttttttgtgaagactgttggataatagaggtaaaagagattttaacggttgccaccacacccctccatcgtttttattgatgagaaaccagattttatattaagttgctggtttcaaaaaagtgattaacaaacttgactctttgttaaaattttctcaagtacttccaaaaaaacactgatggctgccccctcacaaactctccccaccacagtcttcaaaggattctgatttaattagtttgagatggggtcatggcactggaatgcttttttggacattttaatgagaaccacactggtttaatgtctaggtttactgcagagtaatttaaacaaaaacactgagttgtggtttaaaactatatatacaaaaaccatttttatgaattattattcctggtttttaaagttagcaaatacttacatagtcattttatatatcacctaaaatgtatgtattaaaacttaagtataatttcaacaccaagaaataacactggtacattcactttatgaaacccattgtcttgtaatgaaatctctgattattacttttattaaacacctgttggaattctactctttgaccaataggtggcaccagtaatttctgtgttaaaccatgcggcaactaaatggcacagtctttagtggaatatattttatgtatatctctattaggattccattacaagcttcagcttgcgaaattcagttttaatttatctgcatgtgtttcatttaagtgctccttaattactagaacgcttagcataatgaattctgaaactatggattgatttaatgccacagtaaagattttctgctttaatctttaattagttcaccgaacttgtatccatttaatatcagcaactatgatattactactaataatattgttttcaaagcagaaacaatgcaatgcactgagccctctttaacaacagtatcaatttaaggttatgatttctgagaaataatttcaatgttaaaatatactttatggttatgaatattttttaggatttctataagtttaaatatagtattaatctaataccatagtactctatgacttaaacaaaacatagagttttagttcagacaaatgatctagttaattgagttaattcacaatctcctgctcctctttacattttctgccaaaatgccaccactcgaattcgagagcaatgataatatataccagaagatatctatccatataattttccttcgccaaacagcaagaaagatactcagtagcactaactctagcctagctctattcctacagtaattttggtctctctattaaagttctttttccaaatttctggaggtttttgtggttaaatactaggcaacaggttttaccatgatacttggctcaggcaagccaattcagcaaatattctttcagctgaatttagttaaacgtatctctcattctgtaggaaaaattagtcataccaagataacagagtcttacgtagggatgccttttttctttgttttgttgttttgttcttaaatcacccttaagatggtaggccaaaaaaaaatagttttgaaggctgcaatacctctttcaaagacacttagccaattagccacagaaaattagtactgaatctctaatttagatcctggagctattcttatttcttagtatgaggctccccatgttccaggaaacaattttctcagcccagagacatgtttgttctttataagaagattcaagaggaaataagtaaaatagaagtatataaagtttctcttgctcttgggggttttctgcaacttatttcaagaaggcttaaaaattgaatggttgcaaagtagagtgaaatttaagtgggttttcattgatcagcctgaacctggccattttgtcgtcagaattgtttccagaattttgtttcttttttttttcttcagagtaaatacactatagatggtggggtgttcgattgttgttgttgttgttttttctgctttatggaagaaaaacagaacttttgttacagtatggctcactttatctccttgcccccaaatttctgttctccccagtgttccacaatcagacatgccttcactgttccccttatgcaaagctctcttaggcattttgaaacctgttcctcttaggaaatgtgttctgatgtttgtttattactatctgctcttgagataattatggtactaataaaaaactgcttattaaaacaaaacacaacaacaacaacaacaaaattccctgattcgaccaattgaacataggagtaaatgcagttcaacagaagtcataatcctggggtgccatggttctcagccttgatgcacatgagactcaccacctggaggtaggttaccaaagttagccaacaaaaacacagggcactcactcaaatttgagtgtcagtcaagcaatgaatcactttttaaatataagtatgtcccatgaaatatttagaacacagttatactgaaaaacacttattgtttatctgacattcaaatttaactgagcatccactattttatctggcaaccctacctggaaggcttagtaaaacacagattacctttgaatctgtactaccttcagagtttctgattctgattgggtttggcacaggaactttctaaagtttcctgggtgatgctaatgctgctggttagagactagagggggctatcctggaatttttcaaatttattagatcattatttattagatcatggaacaacatccgcttccccacagggaagcaatttaagcacatggttttccgtgaggaaccagattaggaaatgtggccgtggttcacagggcatctaaatgcaaaatgacatcattacaaacagggatccatatatatattatattatatattttttttcaattattgttggcatccaacagaattatgctaaaactaaaatgcatactttctttatttacaggcatattttgtattattgtgtttcactttattgcactttgcagatatttgtgtattttacaaattgaaggttgtgtcaacacgatgccaggcaagtctatcagtgccatttttccaacatgatcactttgtgtctccacgtcacattttagtaattctcacaatatttcaaacttttttgttattattatgtctgttattgtgatctgtgatcagtgatctttgatgttattattataatcattttggggcaccatgaaccatgcccatatgatacaatgaacctaatcgataaatgctgtaagtgttctaactgctccactgaccaaccactttttcctctctctctttctcttcaggcttccctattccctgagacatgatgacactgaaattaggacaacaaataacctacaatatcctctaagtgttgaagtgaaaggaagagtcacaagtctctcactttaagtcaaaaagtagaaatgattaagtagtaaagatggcatatctagtgatgagatagatcaaaagctagccctcttgtagcaaacagttagccaaatcatgaattccaaggaaaagttcttgaagaaaatttaaagtgctactccagtgaacatacaaatgataagaagtcaaaacagcctttttgataatatggagaaagtattagttgtctggatagatcaaacaagccacaacattctcctaagccaaagcctaatccagagcaaggccctaacttgcttcaattctttgaaggctgaaaaagataagaaagcttaagaagaaaagttagaagctaacagagtttggtccatgaagtttaaggatgtaaaccatttcaataacttaaaagtacaaggtgctaatgtgaagctgcagcaagttatctagaagatgcagctacgatcattcatgaatgtgtctacattaaacaacagacattcaatgtagacaaaaatagcctattggaagaagatgtcatctaggactttcacagctaggaagaagtcaatgtctgccttcaaagcatcacaggacaggctgactgtcttgctaggggccaacacagctggtgtctttaagttgaagccagtgttcacttactattctacaagtctaaaaaagggcccttaagaatgatgctaaatcgactctgcctgtgttctattagtggaaaacaaggcctagatgacagcatgcctgtttaaagcatggtttactaaatattttaagcccaatgtttgagacctactgctcagaaaaaaagattcctttcaaaatattactgctccttgacaatgcacctggtcacccaaaagctctgatggagatctataaggagattaatgttgttttcatgcctgctaacacccattctgcagtcaatggaataaggagtaattccgactttcaagtattattatttgaggaatacattatgtaaggctgttgctgtcatagattgtgactcttctggtggatctgggcaaagtaaaattgaaaactttctggaaaggattcaccattaagaacatttgtgactcatgggaggaggtcaaaatatcagcattaacgtgtgcttgggagaagttaattctaatcctcagggatgactttgaggagttcaagaattcagtataggaagtcactgcttatgtagtagaaatagcaagaaaactagaattagaagtggagcctgaagtcactccaccctttagcaaccaccaccctgatcagctggcagccatcaattttgatgcaagagcctccaccagcaaattaattataactttctgaaggctcagatgattgttagaattttttagcaataaatattttaaattaagatgcatacattgtgtgaacaatttgctgcaatttcatgaaaaacttgaacagataaacacatgaggaattacttcttatgaaggagcaaagaaagtggtttcttgaaatggaatctacccctgtgaagttactgtgaatattgttgaaatgacaataaatgatttaaatattacataatatgcagtggctcatgcctggaatcccaacactttgggaggccaaggcaggcagatcgcttgagcccagaagttcaagaccaacctggacaacatggcgaaacctcatctttacaaaaaaattcaaaaattggtccagtgtggtggcacacccctgtggtcccaggtacttgggaagctgaggtaggaggattgcttgagccaagaggtggaggttgcagtgagctgggattgcacactgcactccagcctgggtgatagagtgaaactctgtctaaaataataataataataatattaataaaatatataaacttagttgataaagcagtgccagggttttagaggactgactccagtttcaaaagaagttctactgtaggtaaaatgctatgaaacagcatgacttgctacagagaaatctgtcaggaaagaaagagtcaattgatgcagcaaaatgtgattgcttgtcttatttaagaaattgccacagccatcccaaccttcagcaactaccaccctgatgagtcagcagccatcaatagggaggcaagacccttcatcagcacattgattatgacttgctgaaggcttatatgattgttagcctattttagcaataaaattttttagttaaaatacatacattgtgtttttttagacataatgccatcacacacttagtagactatagtacaatgtaaacataacttttatatacaccgggaaacaaaacaaactgtgattctaatgtgctattcactttattgtggtggtctggacccaactctgtaatatgtccatggtgtgcctgtattcatttattcaacatatgtgctgatcatctaaaatgtatatatatatacagagctacatgctataatgatacaaggaagaatttaactgaaaatactacccttaagtggctcacagtctggtacttaaaatatttaacaatgggcattgaccaagaatgcattaacaggcccctcagctggactagacttcagacaggtttcttcctcactataggcccttgacttcccttttcttagagcattttctttagaaaattcacagatgtaactcctttctctgtctccttgagatgtaaatcttctacaatccagaaattactttctgaaaaacctggagtcatctctttgaaacgtaatcattaaacaagatagtgtccctatctcccagtatctgtaaaagggtaggagcctgagtttcataagtgacaattagcaaaaacaggcagcccaatcatattgaccaacctccccctaacatcctctagaacttttccattagctcaccgacatgattttgatgtcccctccaaatctcatgctgaaatgtgacctccagtgttggaggtgggcctagtggcaggtgtttggatcaagggggcagatccctcatgaatgactttgcaccatctccttggtgatgagtgaggttttgctctgggttcatgtgagatctggttgcttaaaagtgtgtagcacctccccagcttcttgcttctgttcttgccatgtaatgggcctgctcctccttcaccttctgccattagtaaaagctccctgaggcttcctcagaagccaaacagatgctggtgccatgcttcctgtacagcttgcagagctgtgagccaattatgcctctttctttataaattacccagtttcaggtatttctttatagtaatgtaagaacagcctaacacactcaccccattgtttaaaaatcctttccccttttgttttggcagagttggttcagtctgccaaatctgccaaccaacaaatcagagttggttcaaatatcataatattgtgatattgtttcccctttcaagtcttggctaaaatcctctttgactgtttgactgggctggtgcagtttctctttcatagtactgaccacaatattaatcttgagtagttcagtatattactaatgaagctcaacaacaaacaagggtaaatgtggtacttaatgtttaatattttgaacaccatctctgcttatagacagtgggctatgaaggaaagagcactgctttaggaatcagatggaatttgtttgaatctcagtcctaccacctgctacttaggtggccttgggggaataatatctaatttctttgaacattttttttcctcatctgtaaaataaaggtagcaaaaacctactttccagacatactctgaggcaggaaaaagataaacagagtaggaagagatgacatagtctacaatgagcaaataattgagcagacactcagagaacagctgagacaatttaatggcagggcactagcaaaggtcccccagctgaattccttagtactccttcaggctgcttgctgctcaatctaaaggaataaggccttctaaagtgccatctcctctggaaagtgtgtgctactactatccctgctctttttgaagcgtggttctttggcttcttctgagtttttacaggcttctctccttacaaaaaacgtccctcacttatttctatattcctggaacccagtcaccttgcatcttgagtatcttcctcatatagagctgttttggtctggttaattctcttcctctgccaacccactcctttctgaaggaaccaagcccctatgccttcctgatttttatccatcacccaaaatgacaatcatactccctattgtcattactaagcaagagaaatacatgtgtagcctggacagagccctagaagagacgtggggactgctgtgtgtcactgcaaaccaagccacccttcctctgaaaggatataatcaatttgtcaaaagtgggttatggctgggtggtggctcacgcctgtaatcccagcactttgaaaggcccaagtgggagaatcacttgagcccaggaggtcaaacctgcagtgagccctgattgagctacggcactccagcctcggcaacagagcaagacccgatctcaaagaagtggattattttgaacattattgtcctccagtagggcatctgtttttctcactaagtaagtcaatagtcctttcaagccaaaaaagcacatttgatttaacttcttcagttcaaattacgtgacatttaccataacataaaatttacaatgtttgcagcttaatttgtcacaaaactaatttttaatgagaaaatattagaaggcagtgatttaagctttactaaagatatcaacagtgtcaaataaatgcaaccaatattataattaaagtgatgacattgaatgcatatatttctatctgtagtctggaatataaaggaaactaggaggaggtcttttttatttatttattttttatttttttagcatcacctaaaataatcaaccaatgttgagcaatttctgtagatttagtacatagctacatgatgtaggatgttcaaaaatataataagtcttggtctctgtgttaaaagcagagttaggaagatacagaggcacatgtgaacatttaacatgacctaacagagatgacgtagagaagactttctgggagcactggggatttatctattctttgtagagatttgatcagacacttgtaaaggacaatgagagggcaaagcaaagataacagttggaaaaaggaagtgtgtgagttggaagaataacttgacaaccaggtggtagggttgatattgtatgtaggagatataaagatacctatccaagtccaatggaatctaggatgtaagaggtatcaaaaagtccttgtaaagggaaaatataacagatgacaggaagttttcggaagattttccatgtagcatgtattggaagtcagggagtaagggaataagattacttgttgggaaattgatgcagcaatacatttttttaaatttatttaacacaaactggtggcaaaagatgactcaagaagacacaataaagaataaaacaaggtttgggtctgggagccatgacttatgcctgtaaccccagtattttggaaggcagatggggaggatcacttgcagccagctaagaccagcctaaggaacacggcaagatcacacctctacacaaattttacaaacatagccaggcatggtggtgcgaacctgtagtcctagctacttggtaggttgaggtaggaggatagcttgatctcaggagttcaaggctgcagtgagctatgatcatgccaccatactccagcctgggtgacagagcaagactctgtctctgaaaaaaaaaaaaaaaaaaaaaaaaaaaaaaaaaaaaaaagaatgatataaggtttgcctgcagaatgaattttccaagggagcataacctaactgtttcaaataagtgacatgtctgtctagagagtcacttgggagtcatccacataaacatgaccagagaatatgaaatgcatgagctgaaagaagataacatgtactgaccatgaaaatgctgataaccaagagttaggcatagataatgttcaagaagttaaattatcagggactacatacattttccagaaaagtaattcttaaactttggtgtgcatgagaaccatgtgaaggctggatattcataatgcagagtcaatagatctagggttgaagctagaaatctgaatattaaccagtagctcctggtgatgctgctgccagtaatcctgagacaattctgggacacacactgagagatatttgtaaaataagaaaaaagctggctttgatgtacaactttatgatgcttttatatctgaaaagcgatctttatgtttttcatacagtctgcttgatgctgctattacatattaaaaacaaagccaaaacaaagtaaaacactaagtttagaagaaaaaaaagagagggcaaaagtctgcaatactacaaaaaaaatagagcataagaaaaattgctgagtcatcactgcatattaagaggtggacattttactgcagacatctttcaaaggacgtctgggtaaaatgaagttatggaaaaagtagatttatctttattgctatactaaatcagaatgcttgatgtgttccaaatatagttatcttcaatagatccatggcagtatcatttcagctagtcatattcttgcaagttttacatactatataacttcttcactctataatatgaaacagagttagagaattgtctaaatcttgaaagaatatttaaaaattaatcagcttcccacttttaattgaaaattatactatatatataacttttatcattcctgtgagatttttaccttttcatgattcctaccaattatttccactataaatcttttcatggatgaatattacagaattttatagaaatttagaaatctgtgtgaagaaaagggatcaatgaaaagatctctttccaataaaatgactaataacagctctagagatatttaatacaattaatccctctgaaaattttatgtgaaaatttccaagtttaacagcattcgtctcattaagcaacccatatttcattaggtatatacagcacttgtgaggcattgtaaaatcttacaactccagttccctctggtggcagaacattcaaaattagactgtcagcaactgaagagagctgcggcaggcttgcttgcgtttatagcctccagatgagaattacaaacggtttttacttgcgggctgtgatggctttggaaatagcttctcatctacatccttggagcaaataactgctgctgaggatggagaagaaacgaagctgattttatactgttgtttttgttgttgttttctgcaggaaaaaagttagagagttaatgaagcttaagaacatatctgcaggtgatttggaaaataattttcaaattaatgtatctactacatcttttaagccaagacataacaaaaagcagagaaaagaacaaaagaagacaagggaatagaaaaaaatcataaggaggagaacccttactgtgctcattagaagagtctctcaggcatgaaagaaacgttgggcaaggtggcttaaagacctggcattcagaaagatgatcttatatagataaaagttttattttaatgtatttttaaaaccaagggtatttcaggcaaattgaggcagttgagtttccagaaatctaagtacattgtagaggtttaacagctagttgagcagtagaatgaggattcaactacaaacttctgactagaagttaattttttgatatataacactttacaaatgtagatctaaagctgggaaggacaaaaggcaattctaggttactgcactctaagaggcatatgcttgaaagaatgccagatgtgatcaaatggctgaacatgttctattttctgtaacatgaagcttaaatatgctactgatttttgtaatcctagtgaaatgcagcctcttaaatataatcatatgtgcttttgcttttgaatcttgaagccaagaaatctgtaggattatgttccctcagggttcagaaattttaagaatccaagaggatagggcttaactttaaactctttctaatacacagattttaaaagtcatttggaggtgtaaatgtcacagaggacatataaatgcatgaaacattgacattttttaaaaaatgataagccctcagatttcaatttctcaaacaataataaagcagaaagcattctttgcgtgtccaagtggtgactatgatttatttaagtttgcatagcattcattgctttgtaactacctaacaaccattactcacttccactcctttatcttcattactaatggaatctagattttgtttaccatcctctgagggaccttaatcttcagagaggataggcaccagcaccagtaatgactgaccaaatccgatcatggtagtctaattccttctactagtaattagttcaggtggaatatgtgatgcaattatggccaataagacaagagaggaagtctgctaagaggctctgggaaaatttctttgttcttaaacatatacataaagaaaggttttgacttcttaatggaactacctaattttgcacttcttattatctattaatacatatgcttgctgtttagattattttagttgtttctttggctacttccatgcaaaagcatgctacctgatatacattcatgtgctgcataatcaattttcagtcaacaatggatcacacagatcagaaggtggtcccataaggttataataccatatttttactgtatctttgtatctttatctatattagatacacaaatacttattattgtgttataatggcccattgtattcagtacagtaacatgctatataggtttgtagcctaggtgcaataggttatatcacatagcctaagtgtgtagtaggttgtatgatctgggtttgtgtaagtgcacttgatgatgttcacacaataatgaaatcacctaatgatgcattttttcagaacgaatcctgtccttaagcaacacatgctgtgatttgtctctgagcttttacattttatgatagggtcagccatagggtaaaagttaggttgaagtaggccaggatagtctttatcagtctcctccatgatagctggaatcttcagagcccaactcattcccataataaatccataggcccttactgcacacttacaaatggacatccatgtgtcaaaagccacagggcatatcctctaccctcttatgtagctcctaatatgggacttcaattggtctggcatggtcctgggcaccccactagaccacatatcacatacttttaatagttactgcatatgctggcctcttccaatttttcatcctcctactcatgacttattttcttagaattctctttctctattgaaaaatggtgatagatacaatgagagcattaaatcataatgaaaatattattcctttccaaatagttaaaattattcgatttcaataggttatctttgagaacttagctctgatttaagaagatcaatagtttcaattaatgttagttctggtttaagaagatcaatagtttcagttaatgttcaattggaacgttaccagaatcatttgcatacatacaaacatatgtttgcccccttagcatggtctatgtttttaaattaaaagtacagtaagtgttctggaagataaagggtgctatttgtgcacagcagagaaaattactttagtatctgcacttcggtccttaatcctcctagaggattctaatatacatctgtatgggctgaatttttataagtttatattcatatcacatatatttaaaaattataaataatataagatctaactgtgaattggaatgagagagaaaagatggagaagaagttatatctggcaagaacctctaccatgcccataatagaatgactcttaataagatgaattctatccatgtgagaaaattacactccatctaaaatatttatatgcagaattactttcagttacaatttttacaaggtgacctactgttaattgcattaaacaaattaaagtcccagtttaaatatccattactaagatgatagcacttttattttttataatagcataaactaacactgtctgattttaaatatgacaaccaaagattcttttttaaagttttttctgtcaagttttcaaatccgagttttgttcaagagagagctcatactgattgtgcatgtctgctattatgatatacattcaatttttaaagactttttatcaagactccatccagtgtgcctgagaaaaagatattcacctcagtgtctgatgtttgtctctgatttaaaacagccttcaaacaccttgtcagaatctgccagtgtattgctttaggcaacaagtttctaacagtgccccactggagtacaggagaaagtgctttctgtcaaatgcagcacctccctaactcttttttattcttttaaatctttagacaaatggaacactaaaatcttgagtccatggcttaatgtggatatcattacattttactgatcacaaaggatacactcacaaaccagtactgcagaaacaatgttagagaagaatgaacaacgatactctgaaaactactctctcccaaagagaggttgtcttttgaggtagttctttaaagtattcaacctggggttttgtaaccacaggagttattcagagagccacagaatggggctaagttaattacttaatgtatatgttcaataaatccagaaatatttactgaccacttcccatatgtcaggcagtagacagttaaaaatgagtaggacagtaaatcttctgacttcatgggatctactggggaagatggtcaattaagcagaaactataaggctgatctggaagcatgtgttggaaacaactacctttcctggaatgaggggaagaagagtaaggaaaggcttctagaaggaaatgacacttaatctaagatcccaggagaagccaaatagaggaagtgtgtgaggtttcttcagatgtggcttgtgttagggcattaaatggaagaggaaatggaagtaataaatataagtaataaatataaagtctttagtgtatgccttgggttttatgttataagctcatctgatcctcacaaccaaacatcactgagttggatagtatccccatttaacagaaggggagacctagctaggttcagagagacttgacaaagtgcccaggttcattcatctggtaagcagcaaagccagcagtttaactcaggtaaatcacactccacggcacttgctctctccaccaaacaattcttgctattccaagaaagaaagggtgaatatgggggaaaaaatcaatcaatgatgcaaattgacagcataacttttcattatctagtgatattcatgtaataggaagatgttggagctcagaaacagcccaaaatatggtcttttgacatgccagactaaagaagcagcctcaaagtctctctaagaattaaactgaacctttgttgagggctaaaaaacaacttttgggttacagactctgtccctaggaaatcaactgtttttcagtttggatgcagatcagtccagaaatccccatcccaattgttcccacccctccattagcttctcagcccaatccttcaaagcaagccctgcaggtcactgattcctatctttaaaaaaattgtatgaatttatggagtgcaagtgctattttgttatatgcatagattgcgtggtggtcaagtcagggctttagggtatccatcatccaaataacaggtattggactaatatttattcctatcttgagattacccaggaaggttgacaatggactccctgaaactgccaattccttaatcatggctggcagaaataaatggtgcaggagtttcctatctgtgtccttcagtaccttactcctcagagggtggtccttgaactagcagcatcagcatcacctgggagtttatttaaaatatgcaatctcagacctcatcccagacctactgaataataattcatatttaacaaaatcctcatgtaatttgtaagcactctcaagtttggaaagttctggtttgaacagcaatgcagcttcatgataataaatatgtttccctccgcagggcttctatatccctatattaatattattatattcatattcactaagattctctaagaggggcatattgaaaacagtgttgtccaaatatatttcaccttagacgcctccctcccaacagccatgtatattgtgcagaattgggagagggagattaagaaaattacaggactattaacctaaagaatcaattctggaagtgctgaagcattagagtaagggtttttgtggctggatagatttgaatttgaatatcaacttttttctgagtagctgtgtgtacttggccatgatacataacctgtctgagcctcaagcactcagtagtaaattggagaggataatacctgctttgcaggacctttgctagcattaaggtgcctagcacaaataggcaatcagtaagtagtggcttcagcttcagttatttttatctaggataatgtaaagttaaaaatacaccagatgattactatgcaaataactaatagattaccagacatttatgtatatgattaatctattagtctttatcacactaatattttctaatatttaaacacaaatagaaaattgtacaatgcaattttaatcttttttctgattctagaaattatataaaatgtagaacattttgaaaatttcaaaaaaccacaaaaataaaaacaaaaatcatctttaattccactactcagagataagaactatgaacattttagggtctatctcacctatatttatcaacgcatatatatgtgtgtgtttatatatgcaaacttagtataaaactgcaataactgttttctaacttgctatgctcaccactaagagcacagacattagagccagactgcctgtgttcaaagcctggctctgtcccaaagcagctgagtgatcttcactaacacatgtagtcttgctatgcttcagcttcttcatctagagaatgggaattataatagtgtctaccttgcagggttgttggaggattaaatgagatagtctctataaaacataatagtgcctggtatataagaaggtctaggtcattgtctattataattattaactatatattatgaacatttataatccaaaaatattctactgcaattttttaaacatttccctactattacactgtatttcatacaacttgggtttatttgaagaaatgcatttaattttaagctgtttacattttttggtacagtaaataaccattctgcatatggatttctgcacatacctttcaatgttcccttagaacacattcctggaatcagaattgtataataaaatatcattttaccaactggtaactatccgtaagatttaatgtgggaaccaggacgtcattcagatctcctggagatcttaggaaagttgaggaatttgggctgcttggagaaatacgaccaaagatagaaaagctaaggtcaagagagacgggaaggcaacattatctactttaaaatgacagctacactacagctgtggctcacagagggaaggatgatgcctttgtgtttcagccaggcataaaatagacatacaatgaatgacgtttaaatactagacttttttctttttttaagttggtgcagttatggtcccataggaactgctagacttgggcttttctctggcacagaccaatttatcaaacagcaaagccatggcttttggagccaactgaaactggaatcaaatttaccgacccctggcaaatggaacacccatgtgtcactttgagagcctagtgcactgtttctaaactgtccaaacccacgtgcttatgcagccttgtgttctctgctgggctaagagtggaacatccacctgcacatccatttgaagtggacctttcagcatttgggaacctccttcatattcccaaaaatgactttgcccagatacagtatcagcttctcattaagctctgctttgttcttgatctcatgctctcataactaccaaacatgaattaatatcaccactaaaaattaactgggagggcagcagttgttaacatctctaatagcttacagaagtatgacattttctatgttggaaatcatgtctcaatgcaatgggtgcttaatattttctaacacctttgagggcaaggtcatgagatttaatatgtatttcatattactgagatcgtaaaatcaattaagtaacagatgaggcactcatacaatcctctctgatggactattattgatgactagtaatataacaaataacagtcatccctgaatatagatcacctagttttattagacccagatcaaagacattatctttagtggtaaaaggcaaataagaatatagatgaatctcttggattcagttaccactggactagggcagggagctcatccacttctcgagataatctcactagaaaattgatttaattatcctatagcagttagagcaggaaatctgatttccatttctgcagtgtcattttaggaaccttaaaacatttccaagttttagttcacttttttatttctgcctttgcatcatataattaatatctgtcttagaattgtaaaaaaaaatttaaaaaataaaaagtaattttgaaaaccaaatttgggttataatttctcttcatttaaccatttcttaaatattgggtgggattccagctcttcccattttttaaagtgatctattcttctctaagatttttgttattatctttaatgttggtaatacaaaatctatatgcccagcctccaactcaactctaccattttaaaaatcacatattaactacatattgcatacttgaaaatggttttattaattcaacaaatgtgtttagtgacttctaagggtactattgctattgttattattggttacaatgataagcaaaacacagaaatttcctgtcctcacagaactcctattctcgtaccacctcaaaagtaacatatcaaaagctaaactcaccactttcctttaaactaagcttcgatcacttttgctatcttaatatgattaatacaattgtggatatatatatatgtatatatatgtactatgtacataatctttttaattttaaatttttttgaatggtcagattataaagatgagtctgatattattcacctctgttcttttttgctacaaattacagttttctcaatgcttatgacagacgcatccatctatacgtccattgatgccaaaaaataaacattcctccatgttcacctcaaatttgctttccctcatttttttttctggcttaatgaatgatgtcatcatctacatagctaaatgtggccttcattttttctaatatctattcatgtgtgatttcttcacacatttagtgttcattacttttccacgatatggttctagatgctgcaagcatatagatggataaaaccctttgaactcctacatccaaacaactattaagtcatcatgaataactaccaaatccagaggaatcttctggaaaatatcgttctaatatgctccctttctgttttttaaaataatagttttattgagatataagcacataccataaaatagttgttttaaagtgtataagtcatttgcattactaatcgcggggatttaaaaatagataaaacataaaaaatgaagcttacaattcagtggcttttagttagtcacagaattgtggagctatcactatgaatcattataaaatattttcaccaccttagaaagaagatctgtacccattagtaatcactccccgcactccacttttccagtccttggcaaatactaatgtactttttgtctctgtggattttcctattctggacatttcatataaattgaatcaacaatatgtggtcttttgtgtctttttttcatttagcataacgttttcaagttcatgtatgttgtactatatatcagtacttcattcctttatatggatgaataatattccattgtatgtataaaccacacaatttatccattcatccattgatggacatttgggttgtttccaacttttggttattatgaatcatgctttcataaacatttgtatacaagtttctgtgtggacatatgctttcaatttcttttgttatatacctaagagtggaattactgggtcttatggcaactttctgtttaatattttgaggaaatgctaaactgttttccaaaacagctctacaattttacaatcccaccagcagtgtatcagggctccattttctccatatactcaccaatactcattttccatttttaaaaagttacagacatccaaatgagcatgaagtgatatcacattgtgttttaaatttgtacttctataatgactaatgatattgagcaccttttcacatgctcattggatctgtatgctgtccttggagaaatgactattcaggccaatttacccattttaaaaactgagtcatttgtctttttattgttgaattgtaagagtttgttatatagactatatataaatcccttatcaaatatacaatttgcaaatattttcacccattctgtgaactgtcattcattttcttgatggtgtcctataaagcaattttttttaatttgatgaaggccaatttatctgattttttttcacttatgattttactgtcatgattaagaaattttttgtttgcctaatccaaagacttattcctatgttttcttccaaaacttttatagttttagctctcacctatgctctatgatccagttatagttaatttttatatgtgatgtgacgcaggggtccagcagcttcatttttttacatgtggaaatccagttatttcagtaccattttttgaaaaacctacaaattgtcttggcaattttgtcaaaaacgaatttgccataagtgtaggtgtttatttcttgactcttaacatttcattggtctgtatacaatttcatttatttacttatttatttatttatgccagtacaacattgttttgattactgtatctttgtagcaagttttaaaattggggttggcacggtggctcatgcctgtaatcctagcactttgggaggccaaggcaggcagatcacttgaggtcaggggtttgagaccagcctggcctgtgtggtaaaaccctgtctctaccaaaaaaaataaaaaaataaaaaattagccaggtctggtggcatgtgcctgtaatcccagctactcaggaggctaaggcaaacagaatcacttgaacctgagaaacagaggttgccgtgagctgagagcatgccactgcactccagcctgggtgacagagtgagaccctgccaccaaaaaaaaataaaagaaaaaaaaagttttaaaattgggaggtaccctctatctttgttctttttcaggattgttttgcctattctgggtcctttatctttcttcacatcaattttggaccactttgtcaatttctgcaaaaaaaaaaaaaaaaaaaaaaaaaaaaaaggcagctcctcagctgtcattttgatagggattgccctgagtctgagaatcaatttagggaatattcccatcttaattaagtcttcggcttcctctgttttcttctgccactgctgggtgttgcttgccattacctccaacctacattactgctttaaacaattagattcatttcccactgcactccggaaaaatttcaaactcctcactcactctgtcctacagtgctttctgtgggtcagtatgtactatccctctttgaccttatagctcttccacttctttactgtttcagttgttttttgttctggtcctgaacagagcatgtttattcctatatcagaccctttgttttctatgttcccttgtctgaaatcctcttccctgaaatctttgtaagcctgactcctttttatcattcacttcttagttatgatcttacttaagcataccatctagtgttacaaaaaatgaaaaatctttattcccttctttcattccctagctgctctctttcatatttccctatttaattttcaagagtacttacaagtatataaaaatttcccatttattatttatttctttattgtctagcttcttacctaaaatatagactccagaatcttgaacaatgcttcacacagtttgcatttaataagtatgctaaatgttgttgcatggatttcaataattattttctacatagttcttcaagtaagaataatagtgataagtataacaatggtagataatatttgtctggcacctatgtgttaggctttgcagctaagcactttatagtttaatttacaatgacattataaggtatgtacaatcattcacttccacttgacagatgaaaaatttatggtttaggaggcaagtaacttagccaaaatcactggtcaagggacagagctaatatttaaatctatgcagtctggctccaaagcctacaccgggagacctctcaggcctcctagtcattaaataaacatttgctcaagcgccttttatgctgtaggcacagtgttggttgctgtgcatacaaccaccaacgccttcaaacagtacttcatatacaaaagttgtaaagaggctgggcgtggtggctcttgcctgtaatcccagaactttgggaggccaaggagggtgaatcacttgaagccagcagttcgagactagcctggcgaacatggtgaaaccccttttctacttaaaatataaaaattagccaggtgtgctggcgtgagtctgtaatcccctcaggaggctgaggcaaaagagttgcttgaacacaggaggcaaagggtgcagtgagccaagattgcaccattgcattccagcccgggcaacagagtgagactccgtctcaaaaaaaaaaaaaaaaaaggaaaaagaaaataatgaagaatatgtatggtgatgttgtaggactttctcctttctcctcaattcagctaaaaaccattttcttgtcacgtgaccagaaaagattaggcttgcggacacatagaagggtgcgaaaaatagaatttattgggcagaaaaggaaaaaaaaaactcagcaaagctagagaggttcccattaacaggcccccatctcaccgattgaaccttaggttaccagtatggaacaggggaagccaggctcctccccaatgcaaacagcacaaactttccatgggtccgccccatcctctcagtgcacaggcctgtctgtcagagattctccagagagtcctttttacttggctgtctcagtgaagtcacttggtagacagtctaggatatcttgctgaggagtttattctttttctttttgaacatactaggtgataacccgacctgatcaagtcagcatttaatttaattgtgctatgtttcattatgtacaataagattatattttggtagcttttttttttttttttttttttttctgagacggaatctcactctgttactcgggctggagtgcaggggcgcaatctcggctcactgcaagctccgcctcccgggttcacgccattctcctgcctcagccttctgagtagctgggactacaggcgcccgccaccactcccggctaaatttttgtactttttttttttttagtagagacggggtttcaccgtgttagccacgatggtctcgatctcctgacctcgtgatctgcccgcctcggcctcccaaagtgctgggattacaggcttgagccaccgcaactggccatattgtggtagttcttttagtggttgaaattaatgaaattctctggagaataaatatatcttttcttgatggagttttattttgccatagaatctaacagcaattccaggtttttcagaaaattttaaaatttaaaacattataaaacaaaaaaaaggtaaatgacaagcttaattggaaatccattagttacaaactttagagctaattttatatgtcctcatgcccaaagaagtgttatatattttaagaccagagttcagatagtgaaggaatagacaaagattgcagaatacattatggtacttaagtacaaaatcaagacaaaaagtgacttcagtataaaataatcagtgctatcacctgcagtatatccaatggaagaaataataaatacaacttagagattttcttggtacaaccattaacaatatccatagcatattatatttgctaaatatataattgcttttcaattacctctttaaaagctccttcaggcacggtcgagtcaagggaaaatggttaatatacttcctattcttcccaggattatttagtatgcctgtccagacactttcaaacaatggcttatatcactacttcatttacctctggtctaggggaggtggtagagtagtgcagctagtgaagccaggctagctttacgaaagcaggaatttttttttcacactcttgtatccgcagtgactagcattgtgcttggtacttggtagacaataccacatttcggtgatagtaagatgccttcaattattagatatatcataattttaaacgtgatcaagaagaaaacacacttccaattaaattgtgacaaattatgtcttattactttgaattttacttatatatttattcaaaatattattttaggcttatttagacatagatttgtcatatgctgttctagtgaaaatgaaaacagaaaacaagaaaagtgaaactattcctaaaaatcttcacattcaggatttaactttcctaattgtgcattaactcagagttgttcaaatccatgtttcagtacaatattgttctttgtgccacaagagcattgatattgtggcatctctaaaaagagtgctccactcttgtctctgtagattttcttccaagtcatttccacccattctgtgatgctattgctggtcctttaatcttatctaaagttgtaatagaaagttttcagactacaatatcagaaatcatatccccttttcatataatttgaagatagaactaccatatgatctgtcaatcccactactgggtatatatctgaaagaaatgaaatcagttgtgttgaaaagatctctgcactcccgtatttattgtggcactattcataatagccaaggacataatcagctgaagtgtccaactacacatgcatggatagagaaaatgtggtatatatacacaatataacactcctcagtcataaaacagaacaaaatcctatcatttgtggcaacatggatgaacctggaggacattatgttaagtaaaataagccaggcacaaaaagacaaataccacatgagctcataatgggaaattgcaaacactgtgggccaggtggtgggatcctgaaaaggatatgtggaatcctgaaaagttgattcatagtagagagtagaatggtggttgtcagaggctggttagtatagaggagaggggagaatgaggaaggttgggcaatgggcataaagttacagttggatggaaagaagacattctggtgttctacttcacaatagaatgactataactcacaatagtttatggtatatttcaacataggtagaagagaggattttgaatgatatcactacaaagaaataatatgtatttaaagtgatggatgtgctaattactctgatttgacattatacagtgtaatacatgtattgaaatatcacaccataccccataaatatgtacaattatgtgtcagttataaataaagtaaaacaaaaaataacccttaagtatttcattaagttgaaacctcaagagaacggagtcattcagtcatgccagcaggaagagcaatcaagtttgcacatgtgcaggcaatgacaaattcatacatcacaaccaccacctggcctacagtgtttgcaatttcccattaattgaaagatgcatcccaattttagaaatgtaaaaatgtaaaagatgtaatttttcaaattgataaactatgatattaaaatactagagatgccaggaggaagatgagcaagatagatggggattgcatgttttagatgaaataaaatagattaagcattgagctcagtgccttctccttgcatttccatcctagtaaagagctggaagaattcacacagtcatttacaggctcttcccatgtgagaactatcatcgagaaggcagttgactaagagcctcagttaaattttaatttattctaattagtcagatactattcattcattttattaatatttattaataacctgcagtctacccagtactcttctagttgatgggaacagaatcacgaatcaaaaggtctatagagcttatcttctaacaagagaagcccatattgtaaataagtaaaaattaactgaataatataaatccagagaaataagttttgtgatattattgatagagaataactgggtttagtgcgggtattttttagataggtggtcagggaagacctctttgagcagcaatatttattgcctgaggcaaaatgaatggctgggcaaatgagtggaaaggacagttttgaagtactatctcagcacagctttgacttaactttcgtcaggtgggaatgagcaagttaatatttgcaacagatattccctgctacattcctagtcaaaatttaagggaaaacaaccatttctctctgttagaaaagctgctgatacctttttgtctctttgtaagatcagcaaggactaaaacctgtgttatcttcctgagtggacttatgatatgtttgtggtcaaaattaaagttgaatataagttatggtttgttttttatatctagcacatcaacattttatcagagaacgatgaatactgtcttattagtttaaaaatatttgccgtatataattacctgtcaatttttcttcaatatttgattacatttttgttttaatgagggcaatttatttttaaaatgcaaaaatgtcataattgggtctttgagaggttttaagagagattcatcatctttaatttcagcaaaagcttagattctgcagaacaagtggaaacagttccatcaagtgtcacttggtggcagcataacaaaattgctatgagagttcctaacttggggagctaagtaagttcttttaggaacaagctagtgaaaaacaatattatggctgttttgtaacacacaaaaaaacctgccagtgttcttataatttattataagaaaaacatttttaaataccatatcatacatagtaaatttttttcattaatatagcgttcattaacaaatatttattgtttctattatatggtagaaactgagttaagagttagggctagataatttaagcatggtctctacttggggctaaattgtgtccccccaaaattcatatgttgaagtcctaacccccagtatcttataatgtgaccgtatttggaacagggtctttaaaaaggtaatcaagttagagtgaggtagtgaatttagaatgagctaattctacaggactagtgtacatataagaagagaaaatttggaaacacatacatgcagagggaaaactgtgtgaagacagagggaaaagacagatatctacacgccaagaagagaagcctcagaagaaaccaaccctattaataccttaatctcaggcttctaatctccaaaattgtgagaaaataaatttctgttgtataagccaccccatggtattttgtcatggcagccctagcaaactaggcagttttgatgctcatgccacataacgttttaattttaaaaaactgaagcagagaaaagtaatttctctgctataagtaataaggcaatgtgatgggttttataatagatgcatgctcagaattgtgagcatggtggggagtggaagtaattctttaggatgatgttggaagaccttatataagaatatttgatgtgggtttttaagattaagtagaaattttccgggcagagaaatgggaatgagaataaatggtatttaggtaaaagaagatgatgtaactggaaatggataggcagggggtgacatagagtgttgtgaaaatcttgagttctgagttgtttatggtcaggagatggcctggaaatgtaagttgggagtagattttgaagaggcataagccatgtaaaaagatatctttcgggaggctgaggcaggagaatcgcttgaacctgggaggtagaggttgcagtgagccaagattgcgccactgcactccagcctggagacagagcaagactccatctcaaaaaaaaaaaaaaaaaaagatatctttattgtccaaggcattcctttcttgaaatggtaatataaaattatatatttcaaatcggttggcaaaataggttcaaaaagattcactaaaaaaacacaaaaaacgataattgatcagtgatatcatttggatatttgttcccacccaaatctcatattgaattgtaatccccaatgctagaggaggggcctagtgggaggtgtttggatcatgggagcagatcctcatggcttggtgctgtgcttgctataaggagtgatctgtcacaaaatctggtcatttaaaagtatgtgacatctactcccctcactctttctctcttgtttctgctttcactatgtgaagtacctgctcccccttgccttccacaatgactggaagcttcctgagacccccctagaggcagctgtcactatgcttcctatatagcctgcagaagcatgagccaattaagcctctttttaaataaattacccagtgtcaggtattttttttagagcagtgtaagaacaacctgatacataaaatcagtactgagaagtgaggcattactataaagttacctgaaaatgtggatgtgactttggaactgcgtaatgggcagaggttagaagagtttggagggctcagaggaagacaagatgatgagagaaagtttgatatttcttggaaactggtaaaatggttgtgaccaaaatgctgatagtgatatggacagtgaagtctggattgctgaggtctcagattgaaatgagaaatcttattggaaactggagcacaggtcacacatgtgatgccttagcaaagagcttggctgcattttgttcatgacttagtgatatatgaaagtattgaacttcaaagtgatgatttagggtatctggtagaagatatttttaagcagcaaagctttcaagttgtgacctggctgctcctaaaaacctatgctcagatgtgggagcaaagaaatgacttaaatttgaaatttatatttaaaaggatagcagagcataaaaattgggaaaatttgcagcctggtcatgtatcagaaaaagtaaaagccttttcaggagaagaattcaagcagactgtggagcaattacttgctagagagatgtgcataattcaaaaggagccaagtgttgatagccaaggcaatgggaaaaaggccctgaaggcatttcagagacctttgtggcagcccatcacatcacaggcctgaggcctaggggaaagaatgtttcatgggccagggccctgctgctctgtgcagcctggagatactgctctcacatcctggctgctctggctttagccttagctcaagggggtccaggtacagctcaggctgcagctccagagggtgcaagccataagccttggtggcttccatatggtgtcaagcctgcgagtgcacagagtgcaagacttgaggcttgggagcctccatctagaattcagaggatgtatggaaaagcctgggtgcccaacagaagccatctgcaggggtggagcccccacagagaacctctgctatggcaaggcagaggataaatgtggatttggagcccccacacagagttcctatttaggcactgccaagtggagctaggagaagggagccactatcctccagatctgagaatggtagatccactggcagcctgggctctgcacctggaaaagccacagacactcaaatccagcctaagagagcagccatggggactgcaccctgtaaagtcacaaaagcagagatgccaaggccttggaagctcactctttgcaccaatgtgccctggatgtgggacatggagtcaaatgaaactattttggagcttgaagatttaattactgctctatgagttttgtgtgaggcctgcagcccttttcttttggccaatttctcccttttggaacaaaaatgtttacccaatgcctgtactcccattgtatcttgggagtaaataacttgtttttgattttacaggctcataggtagaaagacttgctttgcctcagatgagactttggactttgaactttttggttaatgctagaacaagctaagactttgaggagctattgggagggaatgattgtattttgcaagtgaaaaggacataagattttgaaagggccaagggtagaataatatagtttggatatttgtccctgttcaaatctcatgttgaattgtaatccccagtgctggaatagggcctggtggaaggtgtttggataatgggagtgaacccttcatggcttggtgctgtcttcatgatagtgagtgaattcttacaagatctggtcatttaaaagtgtgtggcacctctccccagctttctctctcttgctcctgctttcaccatgggatgtgcctgttcctctttttgccttctgcaatgattggcaacttcctgaggcctctctagaaagagatgctgctatgctttctgtatagcctgcagaaccatgagccaattaaaactctttttaaaaagtaaattacccaggctcaggtatttgtttatagcagtgcaagaatggcctaatacagtcagtaaaatatagtaaccataagaaccagcaataactgagattaattttaatccttctggagctaggatacaaagaaaaacaggtaagaaagttggaagacattcagttttttagaatatcatcttctcagggccaataaaatattctctgtgttaaataaaaaagacaaagttcatattacattttatataggggaaataatgaataatatctccagcagcatttcacagctaacatagcagcagacatgatatcttttttccattattcccttcagcacaagctaagggcttaacagtgaaataccctgaagattccagtaggggataaattgatgggtttgggcagccttctatgactggagccaggggcagggtgtgtgtatatatttaaagttgatggataccatgtgccttcaacaatcttttctaaatattgctttttctcagttgagctttccacaggagatgcaaaaagatgtaaaattcatgtagtaagcattgggaagccattacggattagtaatcttagggtcaacaaaatcagttagagattttggaaagagaattttggtcctcagtagcaggcctggttagaggattagagactttcagaatagtgcttgacaatggaagcagcatgagcttatgataaaaacatggctacactacttttgggtgtcccaacatcaaacaccacattgcaactgaagaatgttattttaatttccctgacaaaatagctttatctttgctatagcacacacttgataaagatattagaggatgtactggtagtcactaaccaataccattttaattacacatgagtcatactgtttaaacattaataaactgtataaaaatatttctaatatttcttcagagtccattaaatcccaaacttagcaaagtttgatagagtctcacagataaataatttatgattgccatttataattaagcaccatatacaatttcctttaaatacctttcctgctttggagactcagagggtggaaggggtatgagggacacaaagctacatttggggtacgatgtacactattcaggtgacccatgcactgaaatctcaaacttcactatacaatccatccatataaccaaaaaacatttgtaccccaaaagccattgaaataaaaaaaaactttaaaaaatacccttcctgtagaaagcatacattcaataatgttaaattattatttttaaacactttagtaccttgggatatttatctaacagattaaaataatgatgccagttacacatcatttagtttattataggcttctttgaaaacaatcatctgtgccaaagtgttttcatcaatctaagcttattttaaagcataaacctagaaaacatacttctgatagtgaattctagtaaataggaagatatatcttaaagctcaaattagcagtgatgctcagaatttaaggttggtttgtttgaattggtttgttgattttgtcatcagatgatttaatgaatgaaaatccattaatgaactctgacaatgtttaccatatcacttaatctttctgtaaaatatttactctgagtaactatcactggttaatatgtcacatcatgaattgatagcccagagacaagaccttatattgtttatagattaatataattaggaacgacattaaggttagcttgtcttgcgtttcatctaaaataactttgaaacacgtggttaatgtgttgctagatcatatctccttcagtcttagagaacaaatacacacacatatgtatgtacatatatgtatttttgtgtgtctcatatatcctgtatatatgatagtcaacaaaattggtccggaagattggccttcttggcagatgaggaggctgagagagggacagaatctccattcgtgcccttttattgacaccaccagttatcactgaaggataactgtgataaaattatagtgtaataagacctttagcaataattaactggcaggtgagtttctaaagtgccaattttcaactgggatgtgtgtgtgtgtgtgtgtgtctgtgtgtgtgtgtgtgtgtgtgtgtgtgtagatttctagaggttaaagccgttacctatggggagttatgttaaattattcaaggtattcaataatcaagtcaccaaatcatatacaaagtggaagctgggagaggcgggatagagtatttgtattatatgaataatcatggggtttatgaacattgctccttatattacagttttttcttccttagatactctggtgatgggagacggaaggttgaaatctgctgtcctaaaactcccagaaaagataatttggctatattcttggaaaagctccgatatacatagcattttactctttatacttagttctagtgtgataaaccctggagagtgattgtgtagataagctgaaaacttccatgatttagtctgagcccagctcttccgttctggtttctaaggctaaaaagaaatccctagatttacactgcccagacactgctgctgagcactgaatgtcaaatgaggaagatgttatggtgaaacaccaggtctaattccctctcagcttctcaagtgctatggccatctcttagtggggcaaagccaatgtgagcccttaatttccaaatcctagagtccacatgatatggaaaaggaatgcattaaatagtcacactcctgtacacctgagccatgtggttagggaatgtttaatggtgtcaaccaggaaaggtcacagtgcttatgtggctgggtaacggaagtctagtgcatgatcagactctaagcaggaagtgatctgtaactccacagagtacttacaaacaattctcccatcactatggagcgatgatggaaatcagcatgggaaaatacagatgaggaaatgtcaacagaaaaaatgcagagatggagtgttaaatgatagagacaacattatcttacattatcattttcttggccctttggttaagagctgtcagttcttaaagaatttgggggactagtggcagcctagtagagcagatttttcaaaaaattatatttaagtttttatattgatagagcatacatatatatgtatatagttttcagagtatgagctcagtcacttcaacagatcttgtttgttttcttcattggaagctttgatttaaaaattgattcttctctggagtctgttgagtatctaaccacattaaatgaggtaaataataatggtataacacttgaagtggtatctgactaatgaagatcccaaagggagaacattgacgtattaatacctcattctttcacaatgtttatctattcttatctctttgatgttaattactacattatgttagaactaatttgaccatgtaactcttccttatctcattttgatttttaagcattttccatatcttagtgtttactctaaaataattatttaaaaagggatctaggctggtcacggtggcttacacctgtactcccagcactttggaaggacaaggcagaggattgcttgaccaggaatttgagacctgcctagacaaaacagtgagaccctgtctctacaaaaaataagaataaaatacaaataaattctccaggcatggtggcacatgcctatagtcccagctgcttgggaggctaacacagaaggatcccatgagcccaggagtttgaagctgcagtgagatatgatcatggcactccaacccgggtgtaagtaagtaacaagtaaataaataagatctaaaactcctttggtgaggcataggaaaggctttggaaattgaactacatattcctgtagtatcttttttttttttttcctttttggagacgaggcagggtgggggtgtcttcctctgttgcccaggttggagtgcagtggcacagtcatggttcactgcagtcttgaccttctgggctcaagagatcctttcacttcagactctgaagtagcagggactacaggcaggtgctaccacaactggttttaaaatatatatacacatatatatatacatgtatatatatatgtgtatatatattttatttatatgtatatgtatattttatttatatttatatatattttatttatatgtatatatattatttatatgcatatatattttatatatatgtgtatatatatatatatttgtagagataggggtcttcttatgttgtccaggctcatctcaaactcttcggcttaagtgattctcccacctcgtccttccaaaatattgggattaccagtatgaaccaatgtacctggctgcttttttgatttgacatgaaaccacagatctacatttttactttcaaattctttctgtaatatttgcatagatgagcatttgaccttcaatatgtcaacttgaatttgtctctgttgaactttaccttgtcatgatgcagatttttttctttcgtttttgcataaatcttatgaagtggtctggatttcaaactttcaacagtcagtctaaatgtaaacaacaaaccatgacacttcagtggcattgtaagcatttactgtgtatacctactctgagattctatgaagtatttgaagctgttgtcagaattgaatctacgtgtaaatctttgaatgctttcctttgatttctgaagaattttttttttttgagatggagtctagctctgtcaccaggctggagtgcagtggtgtgatcttggcttactgtaacctccacctccctggttcaagcagttcccctgcctcagcctcctgagtagctgggattacaggcgaccgccaccacacccggctaatttctttttctttttcttttttgtatttttactgctctatgcttaaattttgaggctgccaggatgaatttatcctgaaaactccttctgagggtatctcacaaaaatataatgacttacactgagcagcaggagtggtagggaacttacaatctgccttagaacaaaatggacagttactgaggagttagtgacaagtgtggtaccacgcagtgccttactccaggtgattttgaatgaatgctttattagccattgttctcaaaacagcagtgtaaaatcatagctacacctagtgggcccagatggacacagttttaagatatactctaagaagagtcacagaataattgaacttcttaattgctaaccagatctggaagttatttccagagttagtgatacttaggagtctaggtaaagaattacgatatggattaagtgagaggcttcaccagaggctttccctagaaggtaaaatgtgtcagggtgtgagaaaattgctgtctggcaggtctgcttttcctccatccctacctgcatcatctatgggaaaatggtttccctctattgtcacttttatctaagaaaaaagtagatgtaattggatttcttcaccttttttgtcagcaaaaagaaataacgaggatatgatataatcaggaactttggatgagggtttaagataaatgctggaatcctagattcttaacctagatatagctttttggttaaaagaatgtggcctggagcggaacattacattacaggagatttgaaagccaaagtctcttcctactgtgattctttaaagtgtcaaactatcagtacagtcaatacctgggtaaacactttattgaaacaacttttgtatattcttattttaaattgaagattagaaactgccttattctgaaatatgaaaggaaatatggctgtaaggctagttcagtctttcctctttaaccaccatagaaatctctgagtttggttccacattcctacagaaaaatatggctaaatagattttcaagttatgcccattatctttggggagctgggattggaaactgtttatgagtcagataaaagaaaatggatacacttcaggatggcatgtgaaataaaattatattactatatttattgaatgctgtgtgtatgaaaaacagtgtttagcattataaaatcatattgaaatgattttaatagataatagacaaactgttatatttcatgaagacattgtcatggaaatattgacgttgccaacacacgtagctcaatattcccactgctcttatgaaatagattctgctctttctctctgaacaccaacatgcgttctcagtacagagacaggtcactcaaaacagaaggtgtatagcttctcttggagttttcccaggacagtgccctctggtgcaatctttggctatggaagcatgagcgagttcaatagtgcaataaacattcttcccttcctccacatcagtggcccaaatactaatttgtccaagaaattgcctgctggtgctgtaatttcaactccctcttcaactggcagaaaggtattcatgtccacaaacaaataaaagaacaaggacatatctattgagacagctgaacactaaacctctaattgcttaaagtaatttggaaacatttctggaatcataataccaagaagaacatgccttaaagaaattattaagtaaataaggacaatttgaattatttctacctgatctcatttctattgggcatttactaagtatgtgaagaataactctcaaaggctaggcaagccagctgtaaagtaataatcatttcttttcttaagaaaataagggttaaattaaatcagaaaatagtagaaacagcaatgagaataaaatgctttagaatatttatgagaatttcctagaatactaataacctcaaaattaattcaaagttgaacatttttttaaactttaccctgattaaaaaataaaatttttcactgacaaagaaaaataaagcctcagttaaaattatttcattcccacctatcctctttgttctctcttctacctttaaaattactgaagtttatatccccaaatatatataatatttgcggtacaatttccttgcaataatcactttcattttgtagactttttatgctgtctagcttaattcaattctaatgcatttctcttttacctaacagtctcaatatgtgtgatataaactctgattatcccagagattataacatgcaggatggaagaagaataaaaggcaatacatatagataaatctttcaagatttgtgttggacgaggaaactagtttagagattttgtttttgtttctgttttggctacactttccttaaatttcctaaggtgatattatatatattatatctatatataatatagatatgatttagagttgtgcttttacgttaaaatatgtagagttattccattcaattttctgctattgaatatttcttaaagactcagcatacatactagcatgagacatacacttcttttattggaaaacttcagtgagaacactgaaggagaacagtgttcagaagaacgctgaacaatctagtaaaaaattagtttcactagacacggtatataatctgtctataagtatttagcttgcatactgctgtgatggcatgattaaaatatgacataaaattcaacttatcagatctttcatcgtttatgatgtttatctaatatctagaaaaaaatcccttatgtatacttgtgttcatcactgtgaagataatgttactttagtccctctcaaatgcaatcagggaagactatgattagaaaagtatctccatcaggtcaggcgcagtggctcacacctgtaatcccagcactttgtgaggccgaggcaggtggatcatctgagatcaggagttcaagaccagcctggacaacatagggaaaccttgtttttcctaaaaaaaaaaaaaaagaaaagaaaagaaagaaagaatggaaaaaaaattagctgagtgtggtagtgcactcctgtaatcccagctacttggaggctgaggcagaagaattgcttgaacccgagaggtggaggttgcaacaagccgagatcgtgctactgcactcaagcctgggagacagaggagagtccatctcaaaaaaaaaaaaaaaaaaaaaaaaaaaaaaaaagagagagagagagaaatatctccatcagtgttaaatattcgaatgcatttttgtgtacaaaattatctgctatgtacagatgaaagtattctaaagatacagcaatccatggagggatgaaagaacataaggcatttattattgaagcaaccaaaagagggaaagggaagtggtgttcaaaatttagtgtgcatcagaatcaccaggaaagcttgctaaacattcaaattactgaactctcctacctggaaataatttgatatgcctgggatccagagatctgcattttaacaaatactccaggaatttctgatgtatttaatttggggaccaagctttcagcctaagaagggtaataaactaaattattgggtaagtattaaagagggagttagtgaagcagagaacagatgggaaggaagtcattagcaataaagccggtgatcttgtttcctatttcactggaataagggaagcaaccagaaaagaattcccaaacattccacagaacatatatctattcatttgtacctgtgaccccatatcaagtaaaatttatcactatgagcaaattgtgaccctagttgagaccaatcacttcaactgaccagcagaacccattctctcatctactgaagattccagaaattcttgcctttctacagcagtactacatttacctctttgttctctgatcattatcacattaagaagtattcccatatttctctcactttaaaacacacacacatgcacacacacacacacacacccctctccatttcactctcctcttcagttgtcctagttttatttatctctttacaataaaaccacccccaacaaattgtttctgatcactattttcaattttcctacttccatattttcctggcctctctccaatcagaattttcccttttccatcaaaactgctcataaaagatcaccaattacccctatgttgctaaaaccaatgatcaattctgagttcccatctcacatggtctaatactggtatttgaattaggtcatgcctctaaatcaggtgtgtccgatcttttggcttccctgggccaccttggaagaagaattgtcttgggtcacacataaaatacactaacactaataatagctgatgagctaaacataaatcaccaaaaaattctcatagcgttttaagaaaatttatgaatttgtgttgtgctgcattcaaagtcgtcctgggctgcatgcgggctgtgggccatgggttgaacaagcctgctccagattcaatatccccctcacttgacttccaggacatcagaatagcattcctccgtaggcttctttgcttcttatcttcccatccctttccttctcctcccaccacctgcccctatttcccttcactgctttatttgatgtttcatcagttctcataactttacgtaccatctacaagcagatgattcccaaatgtactccagccagaccatttctcattaatgtcaggttcatattcccacagttattgaatgttcaataaacacctcaaatttaacattatcaaaaacaatattgtaaccacttgctctcttctctactaatgtacacttacagagcctttcccatctcagtaaaaggcaactctataccgcaagctacttagacaaaaaatcttgaagtcattcttgccttctctctttttgtcatatttcatatctggttcgttagcaaatcctttgtccctatttttaaaatttgtatatccagaatatcacctcttactgcctctattgctaacatcccagtctaaacctctcatatttttctcctgaggcaactggagtgattctatttaatacacattaaggtcatgtcactcatctgttcaaaaccctaagatccccatctcactcagagtaaaagccaaacctttataatgcccttcaatggaaatttttgtcaagtaaattcaattcaagctatgataagtcaagtcgaagcatgtcaatcaatccaagctgagacaattctagtcatgtcatgtcaggacacaagttaagacaagacaggtcatgtcaagtcctagatgatctccccacccactattactctttgatctgtttccctccaattcttcgtctcagtaggcgccaacaacactggcctccatgctattccagaactccccaatcatgatctttgctagtgctgttctatgtgaaatgcttcccctgggaacctttattacttgcccacttactgattttccatctttactcaaatgtcaccccttcaatcagtcttgcttgtctattctatgtaataccgcaacgtagcctcaccaacacagtctggcttctgtttctcattttttggctttgaattcataactaataacatagaatttacttattcctcttgtttattgtctataattcctctctctctctctcaaaatacaaagtacctaaatttttgtctcacttattaactactgtgctccagagaagtgcttggcacaaagtgtgcatacaaaaaatagttcttgaaagatggatgaatggcatgaagagcactgtcaaaacctaagtattgggatctcctcgaatctggataaaaatcttagctaattcttatcagaaggtgaaatggcagctgatggtgcagtaacaataaagatgcagttgcaccgtacaggcaccctcctccccctccacccaccgccttcttccctttagcttgtatgcaacactatctagtcctttgtaaatgaacatttctaaatacctggggagagttttggtgaagtcaacattttttattacatggaatattttctaaataatacattttaaacatgtaagagaaaattcaatcaattatagacttcctccttttccctctccctactttaaagattgttttaggtaaaactatatggctcacagaatatatttggggcttatcaggacacaggaatactactactaaaattattatttcttgtaagcctttgtaagcttgatgtggcaatgcaaaaaatacacaaaaaccaggcaaactttattttctgaagcatcaactccagttataattagatttccaaaattggttttaataaaattagggctgggcccatatctgcaggctctctccttgttcacagctatatgtccaggatctaacagagtgcttgataaatagaactcttcctgtttcttactgtctcaatctctctcttctccctcccgcccttcttcctcccctctccctctctctctctctgagagaaagaataacggaattaaattgaatgattaatctccaactatacatgatacaatcgattcaattttggcattgttgccttaaagggtatcatttaggccaacttaaactcaaacaagatacaaaagattacaaaaaccaggataaagataataaggagagccaattctatttgttcgtttataaaagcccatgttaagagaactgttagccttacttttatttttgaaattcttcaaatcaacctactaataagataaatgttcatactttgttctactcattgtgctagccaatttagatacattatttacattatttaatttacttttttttttttttttttaagatggagtctcactctgtcatccaggctggaatgcagtggccctatctcagttaactgcaatctccacctcctgggttcaagtgattcttctgcctcagcctcctgagtagctgagactacaggaacacaccaccacatcctgctaatttttgtatttattttatttttagatggagtcttgctcttgttgcccaggctggaatgcagtgacgcaatcttggctcactgcaacctctgcctcctaggttcaagtgattctcctgcctcagcctccagagtagttgggattacaggtgcccaccaccatgcccagctaatttttatatttttagtagagacggggtttcatcatgttggccatgctggtctgaaactcctgacttcaagtgatctgcccgccttggcctcccaaaatgctgggattatgggcatgagccacccttcttggccttattttagtatttttgtagagacggggtttcaccatgttggccatgctggtctcaaactcctgacctcaagtgatccacctgccttggcctcccaaagtgctgagattacgggaataagccaccgtgcctggcctatttattttactttaaagagaagtcctatgacctggaaatttctctgacccatataattcaaactgcttatcagaagtctatatatgtcacacgcattaagccctgtagagtcatggaatattatccttgagacagattttagtggattttcattgtttcatttttttcttaagaaacattactctttcctgctaaatgcattgcagtcttcctcctgaggatcaatttttctcacactcctagtccttggtcttctgatgagatagttctaagtcaaccaacatggctcattttcctgagtatagtgagaggtttagagatgtacatgtgaccaatcaaactacataagataaactgtgacttttattgggacatagaaaaagaaaattttgctgttctcttatgcactcaaatcagaaaagttttagctatgggacctcttggtagaattttggagccaggtagagagaagtgccctaaaatgaaactcagataaggaaatgaaatgtacatgaacaaactgggctctaattatatcactggaaatttaaacaaagcctagccaatccctggactgctctcttatgtgacataataaatcacttattgtttaggctggtttgagctggattttctatcacatgcaatgcaaagtttactaagtgatacaaaattcttcacatttgcaactctacgaatatcattttaaaaatgcgattttgttcataacagtagtataaactagatttaactcttttttttttttttaaggtgaagtctcgctgttttccaagctagagtgcagtggcatgatctcggctcactgcaacctacacctcttgggttcaagcaattctcctgcctcagcctccagagtagctgggattacaggcatgtgcaaccatgcccagttaatttttttttttttttttttttgtatttttagtagagacggggtttcaccacattggccaggttggtcttgaactcctgacctcaggtgatccacccgcctcagccctccaaagtgttaggattataggtgtgagccactgtgcccagcctaattcgttttttttaaagtaatgatctgacccaccaaatttccaccagtagatattcaacgttagataatttggtgggtaaaatttggatgcatgtttacaagttcaaatgatatgacaacgtaccacagctgtatcataaatcctgtatctatttcttaatttgaagcagcattcaagtataagcaggatgcccacaggaatgtattgaggctgggggagggaaaggagatattgttaatggtggtagagcataaagtccagtaactctgggcaaaagcagagagatgaaaagaggaggcaggaatggagtcaagactgggtggagacctgagatgaggagacaaagttgaaatttgacagggaactgtgatttttgctatgggcaaaagatatgtagtagagtttctaaaatgaaggaggagtgggaaaggagctaagttggaccattccagtgtaggaggcaggtcaaggctgagaagctactaaatagttacatggccctgggcaagttatttaactcctgtgagccttgatttcctcaaccataaaatgagaatcataacactcagcacacagggtaattgtgaggattaaatgtaaatataacgtaagcctcaaaattcaaaaaggatggggggccaggtcaaggctgagaaggaagagacttgagggcaatgtatggtagttagatggatgtctcctactttgacttttggcaaattcttcccatcttttcaatgtctttctcttatttcatcatcatttcaaactttaatttctaccaccaccacccccccactccaagttactctttgtttttctctgtcactttcaaataaatgatattttatagaataggaataacaacaccagtattaatatttaaatagtgcatcctagtttataaaatagtttcatatccacagtttcatgtcgcccactgaaaaatatatgctattttatatatatacacacacatatatgtgcacatgtatatgtatacatatgtatatattcatacgcacatacatatgcatttctgtatttgaagaaactttttagctttgttcttacaaagaagctaagtttgtcagtattttttcagtcttgagaagattttgattttcttattcggaaggtcaataaccttgattcattttcttatcctgtccctccatcctcttctaattttgagactaatgttgtatcagaccaattccgtctcttttaacagaattatgggttacacagtaaggaaagaaggtaactaacatttattaagtgcaaattatgtggtgggcactctgcaaagtcctttatatccacatttaatcctcacagttatcctgtgtggtgagtcttatgattctcattttatggatgaggaaatcaaggctcacggaagttaaataacttgcccagggccaggtagctatttagtagcagagctggatccaggagcccatgttctttctactataataaattacatttctaagttaatgtagaaaaaaaaatgtagggtttttttttttctttttcttttttttttttttttttttgaggcagagtttctctcttgttgcccaggctggagtgcaatggcatgatctcggctcactgcaacttctgcctccccggttcaagctattctcctgtctcagcctcctgagtagctaggattacaggcatgtgccactaatcccggctaattttttgtatttttagtagagacgggttttcaccttattggtcaggctggtcttgaacgcctgacctcaggtgatctgcctgcctcggcctcccaaagtgttgggattacaggcatgagcctgcacgcccagccaaactgtagcttttagaaaggcttctgatttcccctcatatgttattgtcaaaaattgagatgccaaactgaagtcagagtatataatgcactgactgtccaatagaatacactgagccacaaatgcaagccaaaggtgcatttcgtaaaaatcttagtaacgtgttccaaaataaaaacatacaggtgaagttaatattaataataccttatatttcatcagggatatcaaagtaatcatttcaacatgtaatcgatataaaaatttcaatggattctttacattctattttttcatactgagtctttgaaatccagtataaatgttacactcacagcccaattcacgcaagctacatttgaagtgctcaatagctatatggccactggctctcatactggacagcacaggtgtatataggccttaatagacccaatactgcctcatttccttcgcttgccatgaaggcttcttggggagtactgtgaactcaatgactcatcctcctttgcatttgtttacttaactggaatgtgcctggtttcagccagcagcatgtcagttcagttaagatgacacattttctcctggcttcctaattctccagcttttgctgtacttaacctctttgctgctctttgaccagtattgatcactccctctgcctcaaaactcttccctctggatttctgtgaattcactccatctccatgattctacttagactcctcccctcttacaccgaaaaggtagcccacagccaccttctttttgctctcttttctgggattgctaaacttcacctatcatctatacactgaggaaagcaaaatcaaatgccctccagacctttgacataaaatcacctctatatattcaggtgccaaaagttcatttggatacatagttaaaacatcatttataaaatgtcaacaccacaacacacaccacttcatattaatcatcagtaggttgaggaaacatttattttcttaaaaaaaggtgctggccaagtgggttataatttatttgtctcattaagtaaattgaaaaaattaagaaaaggaaagccataaaaaacacaatgtaagttgattgatagataaatggaataaaattccttttgtggaattacatctgtctcaaagtgaaataatggccatccttttgaattctatattttctgtaagtttgactactatcagcaatactaccatccaaggaatgtgacaataaattctgaataactatacttatcaaatttttactccgacctaatatattaggcatgtgttaaaaactgcagagtgaagaaaacaaatacaacagagtatttatggattctcttgtactacgtattagttttcagactcctttagtataatatttgcttttgcacaggaaacaaagaccatttctcacacgacgttgaaaaaataattaaacaaatttgctgtagtttttctctttttccagtaagttttccttccatctttaattctacttaccatcagttcaagcacactactgctgctcatggggtacactctctctgtatatgaattacagtaagagagctgggtcatcatcatttccccatatcccattaagtatttgcattataaatatgcattaaatagacttttttgcttgggagctgctattcgcaacctcttttttgccactgtatctcagatttactatatgaaagggttcttaaagcgagatgtgaatctattggtatctcagcgtctgcagtcaatctctgatttttgaggctagttttagaatatttattcaactttctttcctgactttcctgcatttgactatctaccctcagtttacagacaggtaagtttgggatgtttgccaccatttttccttcatacacatccagactcataaagtcacctagaaagaggacactaacacatacaaatgcttgagtgaatatagtgcagtgtaatgcaataaacaccctgtaatttctatggcatgactatttcagatgcttgcttttcatgctaattgtctttcaatatccagttttacttcttctttagtaatagaatcctggacaatgtgttctgctaagaagctcccagcctcaccttcatagttggctatggtcatgtaactaagtctggccaatcacatttaagcagaagtatgtatgtgtctatgggaaattcttaaaagggagtagcgagcacagccttgaatgttgacataataggtggaactctagtcatcatctcaacccttgaatttggaaagcccaagctaagaatgacaaagcagaaaatatgagccatgataacatagttaagtggtcataggaggcctgtacagcctacttatgaattccttttctgttagggacaaataaacttctaccatcttaaaactaattttattttgctcttcctgttaaatgaagtcccatctaagcctaactggtacacacaccataaatggcttcctgaaacctagcggtgccagatttcaaggagatagacatgattgacccacgtttcccaggaagattcataatcataatgttttcatcacctaaaatttagtctcaagtgttatttgttagtattatatttgcctgtgtactttgcaaagggcatgactgactacttgactgcattttcaaatgcataggttaagtaacagaattgattggtgtttttccttctttgtgctactgaggaaattcagtggtatgtcttggacattcctggtgctgactgttacatattctaaatgattatcagatcacaatcccagtaattatttaataaatctgtatttcttattgctttagagagtaaaagaatgttactttatagtactatgatttcccatatatacaaaaaatccctgatatacaaataacacacacacacaaagaatacacataattgctatatttttaataaaatatatgggatctagcaatatttgagagcaattctaaaatcaaagtcgcaaagaaagcaatatattaaaaatccatgtagaattattaatctaattttctacaaccatagtttttaagacaattttctgtggtatgaatatttctccaatttgcccttcataggtgtaacatatgaatgtttaaaagttgttttataaggtgttgaaatttgtattttagatttcttgtgtgaccaatttatcatatttgtttatatctacagccatatatatgttttaagtaatcttgagaaacttcaataatcaatgattattctttcaagttaagttaaaacaaattaggtcatagaacaatagatggagctaatgcctgttttaaaacagtagcatttttgcatagatattttggaagctgacttggatctattgctttatttattctttatttttttaatttcaaatgttgcaggccaaatatcatgtatccatatgttgatgacttcttacacatcacaaaatagggaactatgcacatcaaagccaaagttactgctggattcatgtaataagttactacagacccaaggcatttcaaaattgaagaaaacccactaaaaattctttcttgtgggtttcaaagttcttataacaaaaactgctttgaaacatgctgggagaaggactgaaataccacacacataacctgttcagaattgtatactgtgggcagattaccaactgctgtgagtatatttactgggagtcattattgaatttctgtcattagatggacataatttggataacaatatgcagtactatggtcctttttacatttgcattactaaagctgttcatttatttgtagtaagtgagatgttttatattcacttaataacactgttaataagtgaaaatagatttacaatttaacagatacatttacattttactaatttttcatttcatagcaagaacctactttcaatgtttgaccactagggccttggtttttcaaagaaaattacaaaaagaaatgtgacctgtaaatttattaactttttttagtgctttgacataatttaatattcaatctttagacatagccatatatccatgttccttaaaagtaaaagatgaggtcgtctaatatttaataaaacttgctgattccctcaagtagatccaaccacgttaacattctcacagaacacgttggaaagtagtgtctactgacaaaagataaaataggacaaaaaggcagtgcttccataacagaacaccttatgtgagagaacaaatttttttctttctataaatttgtttgctttcagttaagagcctgggtaccatggtgattatataataggaacatgtaccaaattagctacaatgcttattagttgtcctttttcaataagtgttgttggagactagaacaaagtgatataactgaaaactcacaagaaaaatacaatctgtaagaatgaactagagagctaacatttcctgaatgcctactatgtgctagccagtggactaggcaatgacctacatttctcatttaagttactattgttggaaatagtgtgcccaattatcagtggagactgactttaatctcttaggtggctctaatgtggttactgagtctcacagccttactcgaatgcaagtccttgatcagagagcaatgggatgagattatgaattttcaaaacagtggcaataaaagcctgaagaagtctgcagaggggacctagagtacctattttagttcatagtcatttagtaatttttttcaatagaaaaaaaattaaaggcatagaagcatttaccttcttcatagcagcataaaaaagtagctggttcaaatcatcctcatttagagaacaaggacctttgagatcactcagtccatagttttccaattttgcaaataattaaagtaaggtacagagagattacaagaatcacataattgttagttatagagacaagagcaaaaaccagcttccatgttttccctcttgtcaatgtcctgaagtgccactagtcacctagaaacattgatctattgactttaaatcttcagaaagccagtgtagcagaagttaggagtccagactctgaagccagactgtctaggtccaaatgcaactgttgccactgtgtgatcttgggcaagctatttaaactccctgtcaagcaattgtctcatcagattgccacaataatgaaaaaaaaaaattagggcttagcactttgggaggccaaggtgggcagatcacctgaggtcgggagtttgagaccagcctggtcaacatggtgaaacccgtctctactaaaaatacaaaaattagccgggccatagttgtgcacgcctgtagtcccagctactcagcagactgaggcatgagaatcgcttgaacccgggaggcagaggttgcggtgagctgagatcatgccactgtcattctgggtgagaaagtgagactgtctcaaaaaaaaaaaaaagaaaaagaaaaagaaaaagaagtcctatgtggatgaaatgactttatatttgttaaacacttaaaattgtgcattaagtgttaccaattgatttttgcccaggttggagtgcagttcaggctggagcctctaactcctaggctcaagttattctcccacctcagcttcccaagtagctgggactgcacgcatgcaccattactcctcagcttatttttaatttttgtagtgacagggtctcactatgttgtacatgctagtctcaaactcttgggctcaagcaatcctcccacctcggcctcccaaagtgctgggattgagccactgtgcctggccccagttagcttttaaatgacgtcctccttcattcacttacacaacaacaattttgagctcctactgtataccaagtattgagggcacaagtatgaagaacaggaccacatcctcccctctcctcaatgaacttacagtcaaatggaagataaaaataagtaatcagacattcagattgcatgatattctatgacaaggtggtagaaaatgatactagaatatctaggggaaataattaacccaaatttgagacttcaggagcaatgtcttacagaaagcacctagaagtatggagcagtttaatgtgagaggcgagggcagagtgttctagttagggccggcagtgggtgtgaagaccagctggaatgatcgtggatctggagagaccagttgtggattgtgagagtggaaagaaaggagacaagagtggtgagtagagtccagagaggagtttatgagccgcatggcagaaattaaaacattcagaaagaaatggagagcccctgaaggatataaatgggaaaatgatacaaactttgcattttagaaaactcacgtaagctagggtaggaaaaaggggttagaagtgggtaagatggaggcaaggaaactcaaaagccaattggtacagtttcaggtgagaaatgatgaatgaccagacagctcaaaggtgtatatgggagccttgttttctaatggagcacatgtgataatccctggacagcaagagaatacctggggtagacctaagctttcccttagtgaagaggcctctgcttaacaccaccatgtggatcagttttaaacacaagaatggggcatctagcctcctggggatgctcctgggaagctagagacaaactacctggactctgataccttgagattagattctggctccactacttcctctggtatgtgatttagggcaaatcctcttacagcaaagcactgttattatttcatatttaaaaaggagataatagtacctattttatagtgctaaacgaaacaatgcatgtaaagatctttttcaatttttcaaatttttattattttctcttctatttttatttaattacaagggtcatgctaatctctgttttgttccaattttagtgtatgtgctgctgaagctagcactatgtaaggtctgtgcctagcatgtattaaatattcaataaaacttaggtcttacattaaatgtttcaatttatgtatgtatgtatgtgtgtgtatgtatatatatacagtgtgtatgtatatatatatacacacaacgtatctatctataaccatatatatataaccatatatatatggttatagatagatacgttgtgtgtgtatatatacatatatatacatatatacacatataaccatatatatacaccatatatatataaccatatatatacatatatacacatataaccatatatatacaccatatatatataacaatatatatataaaaaatatatataatatatatattatatatatataaaatatatatatattatatatatataaaatatatatatattatatatatataaaatatatatatattatatatgtatataaaatatatatatattatatatatatatatatagttttcaggatgtcaagtttccaaagcagtgatcctcatttttaaaaaagtcagggaaaaccttagcatcttcaggttacaagtctactcgtccttcagagtacaacaaaatgccttttcagtatacaaagaaacaaacaaaagaaattccactcaggataacttatataaaataggaaaatttgcatttttcagctcttcccacattcgcacattatttccatcataacctcttaaatattttcttgtatctaaggtgtagcttggtctataagatgagagacaaataactaaatgtattattactcttattttcccttcctaattacaaaacataaatacgtcctgggaatcttcagcaacttcagatgctaagcagtctctctgcctccagtaacttctagcaggatgctgtccatccaacatccttgaccatcctttctacaacatagactttagcatgccactgtcgcccagcccctaaccctccactcccaccatcttaccagtccctaaacataaactgtgtgttatcgtaaccctccctttgctcatgctcgtgcctggaatgtccttcttgagactttctgaaatttctatagaaagtgtggagaagcaagtttctaaagatgccagtcctaggaaaccagctgcatttactctatttcttctagagtatttctagatatactctagaatgagtatttctcaaatcacaacaacagacttttatgataaaaccaataggtgtatcagttatggtgcaaagcatgagagataggtataaagaagagttaactgttgctttcaagttgtccatattctaaggggagaaagcagatccatagagcttcatttattacaatgtgaaaagtgctacagcagcagatgcaccaaacattgtgagaaaaaacatgaaagagttattaattccactcggagggtgtaatgaaatcctcataaaagtccattttggaaccggtagtttatttggtttgcatgtgtataaaatgggaatcctccaaatacgcattcacaaggaaggcaacattcataggaaggcattatttttaaaggccattaaagtctctgtttgagataaaaactgctgatactacacctgataccactattatcattattgtgaaaactcaacaacatgataattaaccacattgagtgctgggaataggggggttctgcacttcaactcgtgaacatttgaccatctccccaaacttcctccaattgtgaatcacccccaaataagcaccgaataagaaattaccaaatgcacaaaaacattcacacacacatacacacacttggaagttagtttcttaaatgttaaatgttttaatacatacaaaacatttactacactgtggaaccaagtggtgcctttccttcaaagatggtgaacaaagtatatagaccagaaagaacaaagaacaaaaaactatggatcttaattattaaagcacggcttctagatttttaaaatatgacgcttgcatggtcagttctacaggttttcaaacaattataatcattgttcataaccataattataaacctggcttaagaaaaaaactagactaccacattaggattgttaacttagctcaggttacactatgatattattagcttttattctaggctttccctccctagggttgaaactgtgtaagaaaaaataagtaaaggagcctatattttgatgttttaaaacgtcattaattgctatgtgctatcttgtaagggaagaaaagtatttttaagaagacctatgaaaggtatactcccaaaagcataaattatgttgtagtgataatacgccttggaaacctcttagtaaaaatattagtcattcagagcaaattgagttcagtgtcagtgatacatttttttttttttcagatactatgtatcctgttttcctttagttactgaaaagtacagggccacatttaaaagcaaaatctctcctgacatcttagcacaaccaataatgaaatggagcaactgagaatttagctgctgggacagatgttcaagatcagaatggcaactccctcgtgcaccaagtcctcttttcggcatgatgacgataaatactaggatcttaacaattcacagagctcactggatttacattcagacaccaaacttctgagagaagacgaaagaagatgttttcactctaaaaccacaatcatgagttcagggtcttttcacattttcagaaatctgaggcaggtaaagtagaactataaaaggaaaatcattttacatgatattaagaaacagtgcagactctggagccatacttggtgggtttgaatcctgctttcaactcttctcatctgtgtgacctggggtaaactgctgaccagctgaaggcctcaatttttggtctgtaagagtatgcacgtcaaaagatagtaatgacgattaacgtttagacagctcctggccatagggtaaatgccataaacgtgtttgatagtattcttctgaggatttggtcacaggtatgaatatgggtagcatataaactcttctcttagaaatattttctcaaagatggtgtttgtaagaaatgcttatagacagagtagatgaagtgcccctgagacgagatagcgagattgctcaggacacacaggttccactcagatggctgttctttctcttccctttacctggtaaagggaaatcctgacacataagaacaaggtctaacctgtttaggaacactaacagttatatgtatcgcaaaataaaatcatgacaggattatggttacataatgatacaaaggcaaaccacaactgtcagttgcagtcaaagagttttttcagaagcgtcctcatatgctgcctaaaggaatactatatgggtaatgtctctctctctatttcacacacacacacactcactcacactcacacacacctttttgtcatataataaacacaacacactctttagatggaatttgtaaaacacagtcaaatgcaaagagaaagtaataatttataatgcagaaaaatctactgttaatgtttggtatatttttttccaagcattttcttctgtatgcttagagttagaaagttgaaacaaagttttggttttggtatttttaaacttgtatcaaatattcacttatatctttaagttaccttataaattatgatttcaataattaaatggtatgaaaatttcaatatatatcataacttatttaactggccgtcctctgagatgtttcaactacatttcagtagtttgttatttaaaccaatactatcaaaaatatcaatgtgtaactatcttgcacatctttatttcaatttctataaattgaccacaaggaaattttgccaacatgatgggtaagttatagcttctacattattaataatcaaatagatgcaaattaaaacaataaacttgaatactgtttttcataggttcatatagttttagtttccatgattgaattttgctaaatacctatgtcttacttatctttcctgtaatatcaagaatatcctcctgtccaaagacccatggatgtcagtggcccaaccttagtgctatcaatggtcagaaccatctttgtcaccctcttcagacttggacacagaaggaagacaaataggaaaatatttataactaccaattatgcactaagattaggaagagggaaagaagaattttggtgaagtaagcatagggatcaaaagaaatatgcaataaaattgaagacatattatgtacattaaagcaaaataacatcaaatgcaaattcagctccacagacactggagtcatttctttttctctgttgcatgcaagcccctactgcataataagtgctcaataaatatgtgttgaaggaatattaaaatgtaatgcaaacagcagcctaggttgagagtgatcttagaattggtattaatatttagccagagttaacattttcctttttgaatagaaatagcttagttttcttctctctctctctatttttcttgtgcttaaaccatccagaacactggttggcacgtaatttctatgtagttataattatctctttctctgtaaatggaaaagcagaagtttaattgattgtatcgctggttctcaaactcatgatggtttagcatctttagcaccaattaggaatttgcagaaatacaaatgtgggggccctactgcggatctactgaattagaaactctaagggtgaaacccagcaatctgtatgtttaaagagtcctaaagatgattctggtgataagatttcagaaccactgatataatccagggctattctccttccaacatactacatagtcacacactgggttagcccattttctaggacacagaggaaaagtggagatgaggtaagaaacttatagtttgagaatcaccatttcatcactctacagatcaatattttccatccagaaaaggcaaccatgcattaaaagcatctcaattcacaacacagtaacattatagtgcctgctttttcacattaaaaatgactgtttttaaagataaacattgtaacacgtaataatttgttttattgccttagaaaatatttagaattataattatttagcacatgactgtttacaatagagttattaaataaaaggaagtatatgtgtataatatttaaacattgccaaggcaaagtaaaataatacaacatagtatgacttcttagtatggttactattgattataaagatggctggaagaagccatccgtattactttgactgcataatgttcacattagtagccacatatagaatcagtgtcagttttaatactggcaatataattacgagattagatttctgttctccctgacaaagccatttttagatcccgtcaaccaaatcctctgggctccatggagacatgtgctacataaatacaaagcattatttttgctcatatcacgttattgtggagattggtaaatggaggagcactatatcaaatattaatagtttttaagcattgaaagctgttttacaccataataaacagcaatctagcaaattgaaaaccaagatagaaggtcatctttcacttaatagttctgaattccaacccggttattctagagaaagatgcttctctttataaaagactaaacttatgcaaagacctacagctgctaaatataggattgattttaaaaatatccaaaactaataaagcaccaccctaatagatgggctttagcagatactccaagtatagttgcatattaaaacctagaccattatccaaataggaagaaaggaaacaaactaaacgtgccatgaagaatgatcaaatacctcttgcctcactatagcacatcagtaacaaacaatctgcatcttttttttttttttttttttttttttttttttagaaggagtctcgctctgttccccaggctggagtgcagtggtgcgatctcggctcactgcaagctccgccttccaggttcatgccattcttctgccttagcctcccaaatagctgggactacaggcacctgccaccacgcccggctaattttttttgtatttttagtagagacgagatttcatcgttttagccaggatggtcttgatctcctgacctcgtgatccgcctgcctcagcctccgaaaatgctgggattacaggcatgagccactgcgcccggcccaaataatctgcatcttattcctccttaaaagagagagtcactttatactgaggattgctttcttagtcgatgctgatttatttaagttttttgtaaatggtggtcagtagtagttacatgtatgggtcttgagtcaaggttttacattacactctttatttagcactcattttttttaggtgagttactggttgaagcctcacttttctcatacactaagtggaaattttatggccaaagattgttgtgaggattaaattatacataatatataataacatattaaacataataattttaggagtatctggcagagtataaatatgcaatacaagttgctattattaaaacataatctgaatttaaatgaataacaatttatatttcaaataaattccttaagcctacttctaccctattttatttgatgttgttatttagacattccttcacgacaatttactctggggtgaatacaactgggacattaattcattctttaattatttttcaattattagtactacagagtatttgttttgctgtctattaagagctgccactcacacaaactgggaatggtttggcagtaggtctagaggatgtgagtgcgtacttgaatttcaaaataaaagataattctatttattagaagttcttatcctttccattttcaggcttttgcagagaaaacacagaattactaaatttaaaggctttgtggtccagctaaagttatttatatgcctcgatgtattgttaatgagtccataatatgcaaagtttcaccagttgtaaaaataattatatatattatgcatttttatgtattccatgtattatttcaggaaaactgtcaacctcagatactagtaatagttggaaatttgaattgaaatgtcaataaaaacatttgtacatatcacatttaactaaaataccaacgtagacatttgggaatatatagttacatgggaactataggtattaacttattttatatagattaactcccacacattgactattacatatagattgcatattaagggtctatttacagaccagaaagaccaaaatgtttgcctcaaaatagtcataaccataatgcaagtatacttaagaaaactgtagaaatgcaatgattggcctcacaatgattcatggatcttttgattttgccatttggaaggcaacttagtctagtgccatttctatatgacagaagcacgttttcttcagtattctccttggaaattggtcatgtagtagtataaaaggtcaactagtaattttttaaaaaggtatcatttttcgcctaaaaaggcaacttagagttgtctagttccatctctttatgataaaaattgcagcgcaccagcatggcacatgtatacatatgtaactaacctgcacaatgtgcacatgtaccctaaaacttaaagtataataaaaaaaaaaaggaaaaaaaaattccttttctctttggaaattggtcatctagtaacaaaaaggtagcatttttgagcactttatatgtgacaggggctgcattaaacctttaacacatagtatcttctttaatcctaatattcacttcgttagttaggtactattaacattcccactgaatttctcagaaatgttcacttgagtgatcagatccacaagggatgattagtgcaaaagcaggttctcatacaagacagctcaggggatgaaaagcttgtcacttaaggaagtaaagattcaattcctgttaatgtggtcttcctgaaattcagatgcaattggtcactctaccactttccctccctagtgttttgaattattaaattgcgtaagcaactgcaataatccaaactatttcctttatccctggtagctctttagaacttagtaggcagatactgtgttctgctttcttcttcaaacaactccctaattcttcaatagttttgtggcacttgatttccagaccatttaccatccttattgcccttttctgaatagactccagatttctcctgatcctattaaatgtagagtcaagaagaattacgagatcctgggtaggatttaataggtagggagtacataggaaatattagttcctttctttcaaacaagtcatattgggtagagcagtaaatcactatttatgcaggtatgtaagtcccaatactaatttgtactgtgcttgcaataaactataattctaagcattttatttatacatacactcttggtaatttctatatccctttgcctatatttaatcagttatttttgtgaacctaagttcatattttacattcatcatacccaatctattatttttggttaaactcattcatcatccctttagagttctaactgtaggaagtaaacatagggattaattgtctttctcagtgtttgatgcgcataaatatgaaaaccttgttgattatatcctcatccaaatattttatttgaaaaaaataacaatgtagacttgggcaggctgacgaaaagatacgtgatttgtcagtatagctctcatccagtcccactactgcccacttcctctcaacttgtaccaatctactaataaatttactttagatacagtggtttcatcagatcttttttcagtattcattttttcttttttctttttctgtagcccaggctggaatgcagtggcacaatcttggctcactgcaacctccacccccggtcccagttcaagcatttctcctccctcagcctcatgagtagccgggattacaggcacgtgccaccatgcccagctaatttttgtatttttagtacagacagggtttcaccatgttggccaggttggtctcaaactcctgacctcttgatccgcctgcttcagcctcccaaagtgctgggattacaggcgtgagccaccgcacccggcctcatttttttcaataatgacatcaaatgaccttcagttcataaacagcatatctatagaattcctcttatctataagcctaccaatccattttacagtatttggatttattcttgattattttacaatttcttattaagcagttgctaaataagggtttagaattttgttgggtattcaattcaagctctgaaacctactaccttttcttttttaaaaaactttcaaaacatgattcatttaaattactgatgtaggcataaaggtgattttattgaatgtttaattaatttgttaaccagagtcattttcaaaacattttcacttgatacaaaaataaaaaagacaatggagttaaaatacataaatataaattaattgaaaataatagcacaaacaactcaagtggaagaaaagtattttttaatagtagcaggtcactgtattcttctaggaattttataagtaaacaacttttaaaaaatacttttctaatatcctctggaaactttcccttgatgaaagaacacttttactttccaaaaatatttagtattttagagttaaggatgacattacactgcaaaagaacaatgaaataggtttgctatctaattattcacccagcaacccatccgtgtcatctctatacacatctagtaaacacctttgagaggcagctgtgacattggactgaggaaaggacttgaagttaggagaccagattcacattctatttctgccagttcttatgtaacgttagtgttccatttccttatccataatacagaattaatactaccagcctcactggggtgtgaatattacataatataatgcatttccaagtgtctggtataatacttacatattgatgatgtcagtaagcatggttaagaatctaataaaaaatggttattttagttctcaggttgagaaatatcattttgaattttaattgtatttaatttaggacttttccataatcttctcttttttataagtcttttataatttcattaaaagcccctgactttgatctctgcataatccagttacaacaaagcaacatctggtaccactggaggccttggctgttaaacaatttgaatattgccctgagtcagactatcaggtgatcctctacttaaaccatatctatgtatgcccagggagtacagtccctattttaaagaattatggtatacttttagaaatagtaatgttgtattaccatctttacctctagccatattgctcttgcaattttggagagcttagttgacaatttaaatacaggaaatataaaaatgaaaactacgtgatgcttccatcaaagatttgtaattgataaagtgtaatgatgacatagtctgtcctcaagactgattaaattctagtactctatccatctatccatcttcatcagattattcttgaaagcataattcaattacatatgtatgacatgtatcattataaacaattttcatgggctacttgaagaacattcaaatgtggtccgaaaggagtggtttttaaatactaagaaaaagtctctatggtaacattcatgttgaaatttctcaagcataagtgctttggttcttggtttacatggctgagctacgacttggtgaatcatctttgtaaaagaacaacataaatataaatgtaaattctaagagtcacttttacagtggggggagatccccctctaaagcatgaagatattctgaagattttacacaattgacaacataaatcaccttttcttaacaaaaataaaaaggtctataatgactttaacatagtttatttttagcagagcagagcgtttaggttgtgtcttcaagctgcattttacttctttgcacagtgcttgagtgaacatcagtgaccatggtttatgtatagaaaagggaaaaaatgcctgctgtgatatgagtggcatttttagatacagtgagagaactctcaaggtcaaaaatagaaagatccttggaaaatgtacagtataaatattggatcaatggaagaaattataaaggaaaggcaagatatatgcagtaatgtaaaactgcaaaactttagtacaataaccacaacacttaatatcagaaaaatggtaaatatataggaaaatatatagaaaaatggtaaatctataggaaataaaggagaatccataatatgtagtaagataattttattttctgaagtacacagcaacatccttagtggacaaaagatgggtaaatctttttgacaaaattattttgcagatattaaggtagaaatgaaaaaatttgagctaaaagctattgagaatttcagtaactagtgcattactctcacatattattttaaatgttcaatagtttggaagttaattaggcaatatatatctccttggtctacattttttaacacttttactttctcttctgcaacactatatttaaatataatgacttaatgtaatgtctatcttctcttccaaactgcaaacacctcttatttgggggcctcacctgactgttcaccactttctttcagcacttaacatagagtagacattcaattatattatgactaaattaatgagtctccaaatcatttaaccaatattctcattcttgggaaatcaactcaaattgataattcagaaggacaaaaattgttatagcaatagctaacaactattgagcatttacaatatattggtttacataggtcatcttatttaattctcaggatagatttatcatgaagctactattctgtatccatttaggacacaggtgaactgaggttcagggaggttaaatagcatgtctaacgtcacactactattaagaggctctgacaggatttgaggcttattctgcccaacttcaaagcccaagctcttaaacatcagtacgttggatagtactataaactgtttatgatagagttacttataaaaataaaactaggatgatctatctaacaatatggaattaaatactcttataatttatacaatttaaataatgaccaatatgaaaataaaaacaaattatgtataagaaaaaagaaggcgcttatgcagtacagtatttcatttataatgtacgtattgataaaatcaggatagaggaaattcaaatagtgtgtgtgaagatgactgagtaaatgatatatttggattttaatgctaacagtggcttttaataattaaatatgattatttgacttcttttaagcttccgcctgtaagtgagattatatactatttttctttccatgtctggctcattttacttagtatgatgtcctccaggtccatccatgttttggcaaatggcaggatctcctttttaaaggctgaataaaaatacagagatcgagaataacagttgttagggggataaggagaagacagaagatgtaggtcaaatgatacaaagtagcagatatgtagaatgaacaaatctagagatctaacacacaacatgaggactagagtaaataaaattgtattgtaccagggacttctgttaattacattttagctgcttctgtcacagaaaaaaaaaaactaactctgtgagatgatagatatattaatttgcttgactacagtaatcatactactatctatatgtatcccataacatcatgttataacctgagatatacataacatttattttaaaatcatgacatctgaaattgaaaacagaagtctattttcctcagtatttaagacccttagtaaagaaacaccaaaaagtctatccagttcactttatttgaatttacaaagtttccaagcgatctttttactttaaaaggtgtgtgaaattgagcacattttatattgtacattccactgtgaaattcattgtgaattctatagaagtgcaataacaaattggagcatgtgagactctgctgcattggccctgccaggcacagactaccaaattaaatattgtgtgcacattcctatacatgtccagagtttcactttatatgaagataaagaaaattgcaaagagaaagatctacagcataagtcagcagtgcagaaagagatgcactcagatttgaatgaagtaatctgagcagttggttcaagtttgtgaacaaaattccatcagtcttttttggtacaatgaaaagtgatgattttaatccataaatcctgacattcctttatcttaggtatctatttgatcacctcttaaaaaaatacaatagtgagaatctgctggaaaaaaaagtgctttgtgttttccaaattgaactacaatgcccatagagataaccacatagggcaatgctcattcttaagacatgttctaatctctgactaaaagacagaacacagggctccatcctgcctagctgccacatgggtaattgaacccttaattgtgatgtggtgtgtgcctactagtcagacatccgtgtatgcttgcttcagcattgccaccatgctgagctgcatgcaaatgagtaaagctagtgacccgggaatatcttcctatttttaggacaagtgatgattgagcagcaatgaacataaaacatcctttgtgatagcgtctacctgcaggtttggcatgcggtaaatgctctcaaaatgttagtcgctttaaaatagaaaaaaaaatacttttgcacttttggatttgtaacgattaattattccccttggcaacctattgcagcagctctggaatgtttcattttagaaggcagtgagactaagggtgaggttgtttatttgttgctgttctacatagagtttggagaagcaggggaagctttgctgttgcaggtgcatctgccttctctagattagtgtgtggtttagaaacagacaaatccacctccatttttaacaggaatccaggtatttctaaattaggtggtctggtgaccagactttgaggactgtcactcataccagaataaataagaaagataccttaggtggattgggaatgttattttagcagccttccttccataagagcatgcagtaacatgtgtatttccgaccagcaagctcaacactgaaaattctgatcgaaatccaaagaacttttaaaaccagggtctttaacctggagtccgtacatttcgagagtctctctggatgagcttctgggggttctgtgagtcccataggattataggcaatatgtgacatgtacgtttttttctggagaaagatcctactgctttcgtcagattctcaaaggtgtctaggacccctaaatatgttgtatcccatgttaaatgttgtaacatatttttgctcccttgagatgaaagagccagaagttcccctaaataccaatgtcagtgatgggagagcctcgtagccacaccttgagagagaagacttccctgtcaacctacggggggtactcccacttcctgctaagggataatgcttccatgattcttgattcagcattcagagtcaaggaaaagaaattgattctacagccactcaagtggtattagctaccaaaagtcagtagacattattgtactattattttctttaggcttataatcttcaacttggcggtcatactttcattcaatataataaattttctagaaaataagtacaaggaggagcatgatatttattttatggttatgttttgccgtaagttattttaagagtatcttcttgggagaaaaaaatatattcacctcattactctatttaaagggctatgcaagttttagatgtaaaattttaaaattcagtattgccatgccaaattgtcaaacatttctatttttagctatttagtaacagtgtatgatttttaaaaataatgtttatttactgttttgtactgttaagtgatacaattgtactatgttacaattctattacttaatgtatcagttttaggtaatatactttgactccacactgttacagatgatgcaatcagtcaatattgtacctataggtttctacatatggtagttacaggtttgtttgtttttgtttttgttttttttttttttgaggaatcactaaaatttgtcctgcattactctcccaattttttgttatttgtatatttttaattgccagggcatatacaatttattctggactttttcttctaatccacacatttcctttagtcttagttctactacgtatattaagtgcttatcaccagccatttgcgaaagttttccctgtcatccttgattggctgaagttcagtctctagtacgtgagcagtatttcttgagttgtggcacattctatattgtttgtggctttatacttaatgaatatcttgtctggacatgaaatccctggcttaaactttgtttccttgagtatttcagaggtgttgttccacaaacatctagtgctgaatgcaaacaaggagaaatcaaacgccagcctgagattttttcctcctgtaaataatatgatctttttggttggccatttaaaagatgcgtttcgtatcaatttgctagaatatgtcttaagtacatatatcctgagtatgtagcagaaagatatgtctcagcattgactcagttttactgctatgtaatatatgctttcaatagatacggttattcttttctgtttttaacattttccccctcaaattatattttcaaatatttgttctgttctattagctttggttttgtttttcatggactctaattatgaatatatagcttctgccttgtctggtttatgtacctatcattcttccctaattctttatataatccattttaattttgatttcttgccttgcctcatttatatcttctatctccttgctgtgttttcttcagtgtctattctcatgtctcctctgtgtaattcttttatatttctgtgattttagtttgttttgtttgtggttttagtttgtttcttccacttcactgaattctgccagttgaaattctatttcctcccactgtctggagttcttgcacttatgattcatggtcttccttcatagtagtaaaagctttattacaatattcaatgcatagtaaaactttaggtgacagctttcatatctggcctgtagcaacatttttcttataaatgctcatctattgacaaatttgttaatttgttgctttctttcacatttttttctaataggattttggtattaattgtctgccagtttttaaaaattatttgtctattggaagagttgttttttcctagacaagcttttgtgcacaaatttcctaggtaagtgtacatatggctggggaaggcagaatggggtgtgtatgtgtgaacgtgtgtatatgaatgtccagaagtgcctttgggcttcataactcaataaatctagtcttctatcttaaactctgatacaaacttgcatccctaggatggccatttacctgaggtttcaggaaaggagccagcacgagtcctggatcctggagaagctcttagccattttgttgaatatgggaactctggcacagggtcatccttggaagttagaacctactgtatgaagcaaacacctattataaaaattatttatcaactatagccagtgaacttgaccatttgtctgcatctgaatacacaggactctagtggaaagatccttaaatctggagttacatagaaggtaaatttgagcacatagcacttatgttgtaagtattgggtcaagaaatgcctgaaatacatatagggtcagagaaaattactttaatttttgtattgggcagtaatactcagtggaaataaatgttttggcattaaatggacctggatttgatccaagttctgagcataagatcatgaacaaattagtaaaattactggctggcagcatatctgattcataagtgaagtttaataaatgtcagtttcctttattctccatattgacattggtagaaataacgagttgtgtttatttaaaaaaaaaacagcacccttaagcaagaggtgatagttcttgggttgagtatttgttggacaagatgatagaagaataaaagtgaagaacaatttggttaatatctgcactcagaatctggtgcaaagagggctttaccaacaaaaataaaaagaggccatattttcctgtcatttgagatgcctttaccttagaaaggtgatagttcataaatatcaacactcctatttaaggaagcagtgcgcagttatctgcagtggccaatagaggctagttcatgaagaccaggatggggatcctataacaaactgtgattaaacctagtcttggtctttcaaccacttgaaaatcccacaagttgaagttctaacaggttgaaatcttcagttgaatttccaacaggttgaactgatgtgcacttccaatgtctgtcttaacttcttccccagtattttggtaagcttctgggtaccctacattattttgctgcagaaaggagaactgggtaacttcttatacctactttcatgctatcttggccctgggactagagttctgttcctcagctccagatccacttgttttcactgtctagttagtgaactaacttttcttgaacttgtccatcacctttctggtttacttgtactgtaacggaggctgattctcaatgagaactccacaagagggcatacctacttaccaggttcctccctctcttggtctcacattttaaactcactttaaaatgatacatttaagagtgttgtaaggcaatttgatggaaacattaatgagccagaaatttcaattcttcccgttaaaccttgacaaaattggatcatcagaaagcgaagggcctaggccttgttattcgttctctgcaagaataactcggtcccctgtgttaaaatagagtattatgctctcagtactgttagagcctcagtaaaagaaatgtccattgaacaaagtgcatctttttcaaaactgtagttgaagacatggtctgttctgtgtcccaatatcccttacagaagaactaacaaagtgggttttatctttaagccaatgtcaagatagtttttctctgtaaaatgatttagatgcttttttattatgcaattaaaaggatatagccaagaaactcttcttaatctgatattccagaaaatttagaatcacatacagtgcgtactcacttgtaatttagtcaattcagatagtaagtaccacatattattttgcttttcttaggttacttgtttattttactttttcttcatgttcaaaacactagtctcttcactaattattatgaggaagcactttatcttattttatttatttatttgtttgtttatttatttatttttgagacagagtttcgcttttgttgcccaaggtggagtgcaatggtgcaatcttggctcactacaacctctgcctcctgggttcaactgattctcctgcctcagcctcccaagtagctgggattacaggcacgtgccaccatgcctggctatttttttgtattgtttttagtagaaagggggtttcaccatgttagccaggctagtctcgaactcctgacctcaggtgatccacccatctcggcctcccaaagtgctgggattacaggcgtgatccatcatgcccggcctgaggaagcacatttttacatttacagctttactgaggcataattgaaatacaaaaagttgcatatacttatttttcacaattttatgaatttgaatatatgcaaatactcataataacatcaccacagtctaagtaataaacatattcagcacctgcaaatgtttccttgtgtcactttgtaattttggggggtaaaatatggtaatatggaatgctttacaaatttgtgtgtcatccttgcacaagggccatactaatcttctgggtattattataattttagtatatatgctactgaagtgagcaccatgaggaaccactttgcatatcctaatatgaaaggacgcgaataaagctatctatgtatttcacagacacttttagatttgacactttgcatctaagtggaggaatatgaaggaggaagaagacatttatatttatttttattattgattttcaccagcctgatgtattttctttaaaaaaaaaaaaggcattggccccaaattggctaattattattttttaattttgaaagtaatatatattctgttaaaaaaatattaaactgaaaattccactacctgtaatttccccgattctgctccctgtagctaatcactgctaggaatagtttcttatgtaacattacaggaattgccttcaaattactttttagttttcattttcaatagatcacttcaaaactatttacaatgtagctaaagtatggattataaaaccaaagaaacaattgagaatcactaaactgacagtcagcactaacaaaaaagcaacagcacttaatcaattacatccatccatgtatctgtatacaagcttgtcatgcccgattaactttacatagagattgcattttaaaaaatataatgtatagactttgaaattgtggaattttagatctgagagtaaccttagaactaaattagtgttacttcctaattttataggtaaggtaagtaagtgagaactggataaactagttcaatgagatgaatccaaatcccctgacccccaactatatgtgcgataatgtcaaactctgtgaactagagatgtaacaactaactatggatgctcaacaatttaaaccaaataaaaacacagctacaaaacacttcactggttaaaaaaaaaaaggtacaatgaatcaatactaattacatcaataacatctgaagaccagtattacactatgaataacataattacttactcccaagatgtttacaggctagctagggaggtaagacataaacatgttttagaaatctagcaatgcaaagagaaatgagtacaaaataactcataagattgctacataaatgagcaattgctataggaatgagtgctatagggatgagaggcaggaataacttgtgaattgtgatggtgtcatagaggaggtggcatttcagtcaggtttacaggccacataaaagaaataggatttcttatgccagcaaaaatagatataaacaaaggtgcaaaaataagaaagtttctggtgtgttcagaagacagtgagtacctaaatttagctggaacttcggatttgtacatgcgacagttgacagtattaaatggcagggatgctttggtggatggaagactaaatggcatacttaggaacttgcgttgtaccttgagggtaacaagaagccacggaaagttattagggaacagggtaatataaatgtggcatttacctgggtgactcaggtaaagcatacgctagagaattggggttagggtaagagttgatattaggggagtcagttaagaggtgatccccaatagtagcgcttgggtacttgtggaaaacaatccctcttctgatgaaaacttccctgtctttaatttctctgggtaactatgagagacaaatgatctcaaatgagtagataatctgcaggttgactccaagaatgtccatatccatctatttaatacatattgttatgggttgaattgtgtcctcctaaatgcatatgttgaagtcccaactccaagtacctcagaatgtcaccctgttgggaaacaggatcactgcagatgtaattagttaagataaaatcatactgagtagggtatgccccaatccaatataactcatcatgtccttatgaaaacgagaaatgtgggcacagacacatatatcaggctaacaccatgtgaagatgatggaagagatcaagttgatgctcccataaagctaaggagcaccacagattgacagctaactagcagaagaggcatggcatagattctttctcacaggactcagaaggaaccaaccctactgacagtttgatcttgaaattctgttctctagaacagtgagaaaataaatttctgttgtttaagccactcaattgtggtactttgctacaacagtccgagcatactaatgcatgtatgaacactagaatctaagaatccaggaagacaccaagtcttaaggttagattttgatgttctcttgagtgcaaaaaatgctattaactaaatttgctaagtttcagaattgagaaattctcataatacttgtttcttggatgtgttctaaaaaaatctaagaattatgaagaagaaaaattggcaatttaaaataaactttgttaaaaataaactttgaggctaaatcacttcttggttctaaggattctgtgtgatagtaacagctttttgaaatatgtagtcataagtagcatcttaagtgtatgcctgagttcaagattttcattcattttgcattcactatttcctagccaagaaaatcaccccttatccattatttccactgttgcacagaaaactgccaaatgtgaagaggcgtattaaatgtaaaaatattaccaaatgatctggcaataacttccattgttaagaatgctcataggtaaaccatttctacatttttctcttcttaaaattacattttactagtcagattaaatgaagaatagacctttaagttagatgggatgaacaaaagaatccataatttttgagggaaaagtaatatccaacacttagatttttttgtaaggttgtcattcgggcctaattagtaaaaagaagccatcattattgttttcattttcttatgagtccttccttcagctcacttcctacttaattaagaaatcacttattaaaacaagtagcttcatttcttcccaactatccttgcaaatactcatataatttcctatgaacatttcaccactcataaacatcaatccagttttgaggttttgttttcagagtataaaatttacgatgaaagtactttaccatgagtttttcccttcttgttttcaacatgtggtgggataaatttccctaaacagcttttgattctgatttatcctgctcatcagcctgttactgcctcaatccttttctaggcactattttatcttgctcatcagactattacagcatcaatccttttctaggcaataaggctctctgcaactgtactgccctctgtactgagtctttcttcagttctctgatccactaattctctcaacaaagtctgtgcttctggtagtatatttatcttatggtttgctgaaccctctatactcctgggttattgctcttcctccagtttattactgctggaatactttccattcctatggccgggatcccatgttcaacctttcctcacaccttatctggttttcttaggcagaaatgatctctccttttgcattcttagagctgttcgttcacacaattacacaatggtttgtagggatgtgttctatacaactgattattgctcattgaattcacatctgtgataatagctctaatacactattatagtagatcttatgtgagcatagagactctggctgtcttgaacatcctgagtcactgtttttcagattccctggaaatgttgtcatttctttattcgcagccatgatcccatcaattctcgactgcaacaatcctcaccttttttatgttaattcgagagtgttcatctttacctttttaattttgccctaacatggcttgaacaatgttttattttacaaggagcctgttccataaatatttgttggttgaaataatgaataactgaatgtctttctgtcatgtcgacgtcttgcagaaaaatagcacgctaaaatcataaccaaaaacatatgtcaaatctatatttaattctttataattttattaaattatgtgaatacatgatcaacactaaatgacttcatttcccctcaatcctgccttaattactcaagcctctctgttcttccataatcccatgattctttctgtgttatcttttcttctttgcctctgccacactgtggatcgtccctatcttaagcaattttttttttgtctgcacagcttcattgacattgagagatcagttttgcttatatttttaactaggcctatgttacacacgaattatctcacagagctctggtcttcttctcttgtcactttcatcttatacttcttccttgagctccgttcctgcacttccaatgtaccagacttgccatgtggaagagctgttttccccttaattttaacatatatcatactaagaagattccttacagatatactctgtttgtctttttggtagacttcagctgaaaagtccaagaaacatgaataataaaagcatggataaaacttaagtacattattatttggaaatatttcatgtatagctttgtgtgtatggccataaaccttaaactatcccaggattatgtcacagaaaaatcttaagtaaaattactagtgctgtattatttagagattcaataccagttagtatcacgtatacattatcttctgttgacaacaaattatccttagaaattatcaggggaaacttgcaccataaaatctgattataaagcaaactagttggtaaatcctttactctaaaaatgtaagtcaagtatattaagatattgcatttgataaaaataaatacacatataagatccaatcttattaatgaaataaataagcatttttataatctgtgaacaatgcctacttaagagataatgaattttccagaaatgttttatttgccccaaagcaaaatgctgtcatttaagcaatcttatttcagctctgttttaatgtgctgcagatcttctagtttaattacacaaataaagaaaattacagtggtatttttgagtgaaaattaaccatacctctggtactatttaatgtaatcagagtatggtagtaaggggagaccatttaatgtgtatataagctctgacattgtctccattttatttattaaattttttgatgctagtacataactatagtttggatttgtaagtcagcaacatggtaggacaaagaatataactagtcattataatgaccttgatggtcaaatctgccttatcaatttcagtgtccccagtaactagttgccttgcatgtaagtgctcagtaatttgtgtgttgaatactaattttaaaggaagtctagaaactatttttatctaagtttctacaaatcaaaaagacgagttttctgcttttttttttctggccatcagagaaaatcaacttctcaggtaaagtgaagcattcatcatttacagccacttttgatttttctatttatgtagttcatcactttctttccagaagcaaaatatttctaatctgttgtgaaaatagggttttatcatttttgaagctttaacaacataaaatatatgtgcattaatcactgtgctctcttctcttttagaaaaaattatgcaatgcagaggaagccaacctatttaagacaacaggagagaacagcaactctgctccacatcattacttttgacaaatattcaggaagtcttaaagtatttagctcaaaaaaagacatctctgttatgtaagtaaaactatttgtaccattatttttcattcactttctatgtagtatattatttgtacataaaagaggctatctttaaggttttatggatttataaaacgtaacagtgtgttcataatttgttgattcattccttttatcaatatccataaaaatttataattaggtgatattatttctcagtaggaataggcagattgtagaaaaggcttagggatttgtaaaatgatacaaataaattctaaatacagcattagcattcattatcttgcaaatgttgtttttgctttcaagtataacactagattggatattaggaaatctggttgctatttctatcttgctttgtaaccctggacaagtattctacttcttaggatctcacctcttacttagaaaaagaagggattaaataagatgaccttcaaagattcttttagttaataataataataataatagctagcacttactatgtgccaaattctgattatttattccccacaacactctttgtggtgctgttattactattttacctaaaagaaaattgaatctagagaggttgagtaatttggtcaaggtcccatggcttaaaagtggcagtgctagaaggcgaacccagaagcatggaataatctgcttccatgcttataatctgtgctcttaactgccacatcctactgacccttttcatgaagaatattacatgtttctgcttatggtattaatagaaagttttatttttccccattggttctcagggaaatttagaattaactttagagccaattattttgactttataatcctaattctatcacttaccctctctgtgaccttgggctaggtgcttacactaagattctctttcctcatctgtgaaataagaatactcgccaccctcacagttaaactaaagatgcacagtctttagttaaagtcttgagttaaaactaaagatgcacagtctagcaggcattcagccaattttgttttctttcctaatgtttaagtacagaggctgatgctgaggccagaacttgaaattaagaccacatagtaggcatttttaggattcacattcctagtaactcagatgacacttaaaatcagaccactgctgaactgtgaggagtcatgaaataaaattaaaaagcgaaaagcctgcatgttcctttagggtgtacccagtgctccaaagcctcagaggccggattttctggaaatttgttcatttcaatctttaacctcagggacacgcaaatagtcaagattgtctggtaatgatacaacagtttttagaatctcagtttttggtctgcaacttcatgccctctgcctttttaaaatgaatttttaaacaagcacagaatttattttagtctttcaaggacattttgggaacatataatttaacatgtttcatattatgaagaaaaaaattgctgtgagaaaagtgataataaggaccttgcctaattttcttataattacagttaatcaacatcagtccctcttccaccttatagttctgttttaattacagatgttaaaaaaaataaaggaatgaacacttgcatacatcttcctttgaatttttgtgtgatgaaggcttaaacaaatatttaagaagatgggctgaatggaaaataaattgacggtagaattaagtttgaggaagattcaaggatatggattaaacagtcattcttcttattaaaattttgaatttagataagaatcacatctctttgtttttctactaagttctaaattctgtggtctgttactgagaaaattattgttaaatattttggtgtttaagaaaaggacctcaaaagcatctggaaatgagggaaatctatgtccctttgtttaattgattgtatgaaacaaatggacaaaccaagtttaaacagtgcattgagaaaagttctagaatattaatttatttcatttaataaaaacagctctattaagtaaatgttattatagagcagtcctacatacctaaagagtatcttcagatttgaaaatgaaaccgttagtttgattctaaaaccaggaaaagttgtataaagcaaagaaataatatacttcaatttttttaaagtagaccgaactgttagaatgcatgcttaacgttaaagaatgattttacattttcatatatgtctgacatttgaaaatattgtagggttaaagaatttacactaaattaagtaggatttatagtgaatcaaaatatcataggacattctgttttgtcttggtatgcatctggtaaaatgcacttgaagttaaaattctctgttcacaaactttaatgacttatagttaagtaaaacaagacactacagaactgtaccaacacagtgattccagccttgctattaacgagcatgttgggacttcaatgaaaataatactagaagaaaaactgaataatttgcttcatattttatgcatgcaggagaaaagtataaataaagagagcaagctattctaagtataattccataactactacagatgaattattatagtatgtcagatgtatcaatctaggttgaagtagattattttaattaaaatgattaaaacatcaaatttagctctggtattgtaaaaatgtacaaaattattacaattcatggaatatttccaaactttaaaagcacgtcaatgtgaaagatgaacactttctaaaaacatggatcagtctgtgctgtgcagaattcacataagccaaagcatttatcaattgacatgtaccttaaatctttcttccattacttcaatattttaaagtgccaggcattgtggtgagtgattaaaaatgtccactatttcactgctccagtgattcaaacttgtatggtcatagggcacagacctacaggtagaccaaaatcattaattcatttatttaaatcaaaatcacaataattagctacactttgtttttattgaaatgcgttcccttttcaggaatgttgtatacttttcccgtagcactagagggtacagataacaccatatagaaattaataatgggaagaattcacctattggtaaagaataaatgaagcatcgttatcttttgagcaaaaaaagaaaaaccacattaagcaacacttcaggattataggactactaaaaataaacctttggattttcataaactcctcacaaagctcagaatatcaattatgcgaagttagacatggatgactcggagaatgcacaaacagctttgtctcatttgggaaaatattaactgaaaggaaattttggaaatggtggtcaaccaagcagagaccactttgaaaacattctctctattggtagagtccaaaaagacagctttctaaaagtcctggttttcttgaaaatgtttcagactggtcagagattggtaggaaggtctcttagaggtcatgtagctcaggattccaggcagttctgaaatgtgtaaacaaggagaagcccagactctgctaagcagaagcatgagggggaaggtgcagtttgcaatctggctgtaagccccactcacactgggatctctgttcccatagtgctattattactggaggactaatctgggcaacatataatgtcaggtagaatttaataaaacattattcacaaagaaggtatagtaaccattggtctcagatccaagacaacctcatcccaacagatgaggttaagagtacaactaatatgtttagattcaaggaaaattcagcttagataagccagtctgcaaagtataagctataccaagagtgcctcatgctagctgagttttagacttttgagagtctaaaactgggagcagagtgttgcaaattgtataataatgccaactaagtaattttgctaagcccttccagtatgccaggattagtatttagtatgccaagtgcctttacgtactttaacttatttcatcctctcatctaccctgtgaggtaggttctcttatctctattttaaagttgaggaaacaaatacttggagactagaaatgtgttcctctggaaaggagctgcaaaaataacaggaggccgatttagcttacagagtttgggctatgacttgcaacagtttagggggcaacaaacatagtggtcctggaaatgtcttctaccaactgccccccagctgcctaggacctccaggtggggatgcggctcagagtctagggagcacttccaccccctcctcttctcagccctggcagggtggtttcccaacaccctgaacacattcacgatgaatgagaggagctgacactgtctgtgaccactttctcttcagtcatggaggaagccttgctgtctctggctgtggcatcttctcccagatcccttaatcaacaactcccagagcttccagacccaagatacattttggaaccccaggacaatcctgaactggcacccgccctggtgtgtgccctttgctgctgctgctttggaatcatctcctgcagctatggccaccactgcttcaaggcagtgatgtttctctcaggcctgctgtctggagctctggtgatcttcctgctctttcacaaggagcaggtgctggagatacagctgagattgggggtgagcacgggcatcacactgggcattggactcttctgcagcctggtcaccatgttgatttgcagtgttgggctcttcctgattagtctccttctaggtctgaacctggatgctgggactctgctgggcactgagtccatctaacaaccactttcactgggtgctggcagggggtggtggtggggctggaactgctgggagccctgcttatgcttcagtggccatgtccattcatagttctgggcacagccctgctgggtgctacggtgctggtggcttgtgctgacttcttcctggagggtctggcactgggcagttggctgggtcaatgctggcaggcacttccagccttgcctcctttctgctggtatagctagattttattgaactcctggccagccttgggggcttctagggccctggcccagtggaagctcatggctaaggaacatggaggccatgctaatgtgaccttgagctaccagcaaaggggtctccaactcctttggatctatcaacaagagaccaagtagcaccagaccgcctctggggtggggctttgtgaaagtagctataggtgtcagctccctgccaacacccagagccctgctgacagtctggctccaagttatctccagagtctttgagagcaccaactggaaccagtccctgaggccacagtcccccacactcatctggacctgggttctgattgtggttccactgttcccctcacaacaccctctagttctatgcagacctaagcctaaacttccaattttgcctccacccctagttagagcctgagaatactaggtgggcagggtttgggcccatagaacccacacacaaacttacccacttcttggattggggacaggatctgtgcttcaactcagaccagccctgtaggaatatgtttcaggacagatagagaggaatcttgtggggaagggaagtgtgagtacctacctctgtccaataagagaggtgccctggtccccaaagaaactccctccaaattcctttcaaattccctctaaatcaagtagggcatttacccaaaaagccttttaaatgctcacctcggtgtgcctcacaatggtaatattagagggtttgtttttgaatgatctacagaaaatcagggtgccttaaaggcatttgatagcttactcatggggagaagggcacagaggagctccaggatactccaactcctaagccgctccttagtgagtagctgggtttctgactggctttttcccctggacccaataggtgtaagcccccttctcctacctctgttgggatcactatctttcatggtgcttccctttctctccttctctacctgaggaataccacagggcattggcccacatgccagagtcttgcccttttacccaaagcagcctggccttcagggctgcatgggagaaaagtgccttccatacctctcactgtgggtgatactcatttcctctttaaccaggacttcgttcctgccactaacccattcagattcttccccctctcactctcctgcccaagatctgtcctctggttccccaggcagcataaaagaagacatattcttcccctggggagcaaggctatgatgggagagaggaaaaacatgggagcatgtgaataaaatggcattgaatactgaaacaaacaaacaaataaacaaacaaaaaaacaaacaaaaacaaaacaggaggggagagagtaggaaaattaaggaaaaatcactaaggtgttagaactttctctgctgatctttgtggccttgtagctactagttttatggtttccatcactttctagtggtgttggaggtatacattttaaattataactacatttaaagaagtaagttcactgcaactgatcaggacacagtcagaacccacagtcaactcaatggagagacgttacttgaaaggcaacccagatagttgcagggcctttcacacaatgtgtttgtcactgccacgactttttgttttgttttgttttcctaaatcagatagacagatagaagatagatagagttctacctatttttatcaatctctgtctattgctttaaatacaacaaccactgtgattatcaaaacccccttattctttgtgaactaattagttatacatatgataaaacacaattgtcagatatacaaatattttaagatatcaacacttcctattttgaaagagacaattaacatatttgagagattaatattttctgccttttgtaggtaaaatgatgtctttatgtataatcatgccatatagaagcatattaacatgtcattttaaaattaaattctttgtagcagatattacaaacaatatctaggaaataaccagaaataaaaatgtccatacatacatttacagcatccatcttgcttaaaggatataattttgttttgtctactgtactttgacaatagtattcataggaagtatacaataataatatgtgaaataggttatatgaaaaaaggttaattcataaagcataattgtttagagtatctaggaatttaaaatatcacatgtattatagagccagaacttcaaacaatcattagttagaatgattttctgttgagttcttattctgaaattgctaataaataacatgctatgttacgaatctctcagcccccacaataatctacatcagcaatcagtattaataagaatagtggacatgcatctatattcagtaagtcacgacttctgcagtgtttgctctctaaaatttaaacattaatgaagaaaaacagaaaagtatttagaaatgaaaagcaaaaaaagtttccaaatgtttcctatttacagcattaatttttagaaaaaacatgttgatcttgatcttagaatgttctcagtttccaaagccttgatattttattgaccttcaaaaaagaaaataaatacaaacaccagtcaagattaagtgatactatcttaaacaatttctgatgaaagaaactgactataatactggcattcatagaaaagaaacacagtcgaagtagatctttatttctagaataaaagaaatagattgggtcactgtgtttaaggaaaccacgttataacccacagcatgactgaatataggactaaatactagacacatcactgtggggttttgtcatcgggtcttactctattaaagagattactctttacatcaatgagtaatactcattctctaggtccaaaatcaagaagaagaaaatctagcaaatttcaattttgcttgacagtcctctcaaaagaagaaaaggagaagaaatttccatgtttaaatctgcaactctgtctataaccctcatgtttaaatctagagatgattacaatgggtattataaatgatgctcaaggttattttactcattttgtagattccttcagtattggaaatctgacagtcaggcttgtttaactgttcaaacagtacagaatagccagaagctgtgatttcttcagattagtaaagaataacccaaaggactggaaagtcaaagaacagctaaagaaagagtcaaatcgccaacactgtacctcatcaggcttgttgacaatgcatcctgggagacatgactttatcttcaaagtgacaccatgtgagttttgctcactgaaccaggcatcttatgcagggctcacagcagagtaagctgccaactcagaaagggcataaatgctgactgcaattatgctgaccctcagaaagttgtttgcctaccaaggaaactatttgttccatcagaaaataaaaataagcaaacaaaagtaagtaccatcactttaatgtcctctcttaaggctgccctgctttatttttaattttagatacaaaaaataaagtcaagcaagccctcagtcttttaatgaattgctaaggaagttaaatgcggaaactaagagaagctggaaaagatctatgacattaatcacaccatgcccttccatctctgtccaaaaggggcataagtcatctattttgacttaaaacaatctttaagaaatggaaccccatcacttcccacaagcctaaaataggacctaagtgtatatacctaccattgccatttactggcttagaaatgttgcatatgccatctaacctctttgaattttattttttaactataaaaaaaccttgtctcctatgtttatgtaacgtaactaagtatgagcatgtgcatgaaaatacttgcaaatcataaaaatgcaaataaaattattaagctggatctcttatttaattacttatttatctatttcaaattgagtgcattctgttttgttcaggaccttgatttgtaggacaataggtgagccttgaaaccctatttaagtgtttgaaatcaacatattaatatttaaaagaaatgtattattaatgagctactaggtccctacattaaaaaaaaagaacctttctctatgaaaatatcctctgctgttgtagttatagtaactttcctctttttttccccacctaacgccaacacttccccctacccctgcacacacaggtgagaaaaaacaagtgcaatgtgcatttgattaaataaggaatattttaatgttgtgtaaatacaaataaatggaatttttctgaattctatttttacccaagtcaactaatctttcaacatcagttttatgataatttcagatgctttctccaaagcatcctaatttgtgctaggtaacttaaaggcctatagcactcttgcacaagggagcaagagtactatacctctcgaggtaactagatgcaatatatatggtagtctatagataaaaggttctgaaaatggaatgaaaagtcttattagagacagatagcctgaagaggaaatagagatgcaatcacagaaaatgacccagtctagaaaacttagctttccctatgatctgaggatctccttacctacccagacatatcagggtagtagttgagagttagggggaagcactggcagaaggatctcaccacacctgcatcctcctagtgatacttggaagcctagcttggggaaacaccttttactccctctggaaccaacagcaagaaggaggagaaacttcagtggcactaacaaaccaagtagaccataataataccacaaagactctgaagtttgaagcatagtccacaaaagtatgtcaagacacatgggcaagacctaagcaggctgactttcaactaaaattaaaggatccagagtttgctaacctaatagacaaaatgccaagaatacagtcagaaatcacatgcaccaagaacataaaatttcacaccttgaatgaaaagacaatcaactggtgtcaatactgatgttaattagttcttcaaattatctaatgaggattttaaagcaacaaaataaaaatgcttcaagaattaactacaaatctcttgaaacaaatgaaaacattaaaaaatctccaagaaagttgtacataaaaatagtggaaaatattaaactaaaaaatacaataacagaaatataaaaactccctggatggacttaataatagaatggacataaaagagaatagaattaggaaatatgaagacagaataagataattcatccaaaactaaacagtagagagaaaataaactgtgagaaaaatagatccttagaaacttgtgaaacaataaatgatccaactttcataacatcagagtctcagaaggacagaagaggaagtgaggctgaataaatattttaaaaaataatgcctgaaaattctccacacttgataaaagacaaaaaccttcagatacaagaaactgggtaaatcccaaataggataaacttaaagaatccattccaagaaatcattgctaaacatttgaaaattaaagacaaagaaaaaccctaaatcagccagagaaaaataacacattatgggacggaaaagccaattcaaatgacagcagagaccaaaaggaaatgctcaagtgggaaacacacacacacacacacacacacacacacacacacacacacacagaaaacaaaaaaactaccaaccacaaattttatatccaattaaactatgtctcaggaaagaagggcaaataaaaacaatcttagatgaaggaaaactaaaataatttgttgctagctgaccaacccttaacccttttcccatttagaaaaaaaagaaaagtgcagctcactgtcagcgctcatttaattttatataaacatgctctttgaggctgaagcaaatctgactgattttcaaagtgtaaataaaatataaaacactgttcttggagttatttccaaacagaactaacatcagaattgtctgagtcatcagaattatccatttcaaaaaaattaaattcatcaaataaatcttcagccaacaactgctcaagaacaatgttaacatcacacaaggtattctacattttctaggatatgaccttttcagcaatcaagaatcactatattttgtaagtgtaaataccactacctaaaacagaatgttataaatagaatgatgtcttttgtttccaaagtcaacatactagagcaacacaaaaataataataaaagtaaggtatttcatggcaaggttatcttggggtaaacactgcagctgcaagttcctctgacaactattcttgggacaaacaaaaaagtggttaaagattggctaaagtagtttcttcaaatagaaaggaaataataaatgaaagaaaactagaacatcaaaaaggaagaaggaacaacaaaagaagctgtaacataggtacgtacactatatcaatttttctcatgaatttataaattatacttgatcactgaaacaaaaattataacactatatgactctgaagacaacaatatttaaaagcggggtaggaaaaggaacctaagtggaagtgaagtttccacacttcactggaaatagtaaaataccagtagactcttataagtcacatatgtatattgtaacacccagagcagccacccaaaaactatgcaaagagatcaactcaaaaatgctataaataaattgagattatatccttaaaattgttcaagtagccaaaggaaggcaagagaaaagaaacagaggaattagtaacaggaaagaagaagcaaacaaaaacaaatagaaaagaagaaataaggtggtagatttaaatgctaacatattattagttatgttaaatataaatacaaaataaaaaatgaggattggtagtgtggataaacaaagaaaaatcaactatatgctgcttacaagaaactaatttcaaatggaaaaacatagatagatgaaagtaaaaagatggaaaaagataaatcatgcaaactttaattttaaaaatcaggaatggctaattaatatccagtgaagtagacttcacagaaaagataattactacattcaaagagggccactgcataataattaaagtacttttctactaggaagacttaatgattttaaatatgtatgcatcacacaatagacctttaatgaatgtaatagaaactgatacagctgaaaagagaaataggtaagttcatagctacaggtgggaacttcaatactgatacaggagtgctgggaagggaagagtgtggtccctttaaatgatatggaaggagggaagggaagagtgtggtccctttaaatgatatgcaaggagggaagggaagtgctgggtagaggagggccccctactgacataggtgaggacaggcacttctgccttcatgcccaaatatcgtattttccaaggctaccttggcctgccaaacccccatcctgggcctataaaaacccaagaccttagcaaggcagagacacaggcagctggatgtcatgaggaacatatctatggaggaagacacaagtggctggtcgtggaaagagagaatactctatccaacaacagcagaatctgcttttcttcacattcccataacacactcacaagagagatcatgctatgggttataaaacaaatgtcaatgattttttttaaaaaattaaaatcatataggatatattcttttaacatatgtaatcaaactagaattcaaaaacagaagaacaaaggaaaatctctaaatacatggaaataaacaatacacctctaaataatccatggatcaaagaggaagtttcaaaggaagtaatataaatgaaaacaaaaacataacatataaaaatatatgggaagcagctaaggcagtgatgagagaagtttatagcatcaaatagttacagtttatggaaatgaggaaaagtctcaggtcaatagtaaaatttctaggaaaaaatctggcaaaataagtccaaagcaagtagaaacaaggaaatagtaaagataagagcagaaatcaatgaagttaaaaataggaaaacaatatgaaaaatcaataaaacacatagcttttttttaaaaaaacaataaaattgacaaacttttcacaacactgacaaaaataataggcgatatcaccatagatgctgtgtgcattaaccagatagtaaggaaatgctatgagcaacgttatgttaataaattcagcaacttagaagaaatgaaccaattcttcaaaaactgcaaactaccaaactcaaccaaaatgaaatggacaatctgaaaactctcatcaaaaagtgaatttataattttagaactatctaaaaagaaatcttcaggctcatactgtttcacttgagaattttactaaacatttaaagaattaacaccaattttaacgaatccctttgagaaaatttagaagagtagggaatacttcagaattcattttatatggtaagtaataccagacaaagaaaaaaatattaacaaaccaaattcaaaaatttataaaaatatgtgtataccattaccaaatggaattcatttcaggtatgtaaggctagttaacattcaggaatcaattaaggtaatctatcgtatcaacaagctaaaaaagaaaacacgatcatatcaatgaatgcagataaagccttggatgaaatccaatggtcattagataaaaactctcaaccaattaggaatagaggggaattaggaatagaggggaaatatcttgacttgcttaaacacagatatgtaaacctaaaactagcatacatacttagtgatgaaagactgaatgttttctccctgataatggacacaagtcaaaggcatcggttctcattactcttattcattatagtactggcaattctagctgtggtaataaggcaagcaaaaggaacaaaaggcatagagattagataggaagaaataaactgtttctagatagaggtgacatattatctacatagaaaatcccaactaatatacataaaaactccaagaactggtacttgagttcagcaaggttcaagggtacaaggtcgaaatgtaaaaatcaatcacatttctacatacgaacaataaacactgaaactaaaatttaaaacagtacaattttcaatcacttcgaataaaatgaaattcttaggtatacagtttaaaaatgtatgctgaaagcttcgtaatgctgatcaaataaatacatgctgattaaaatgctgatcttccaatacacgaacagagtatgtctctgtacttaaatcattctttgatttaaagagagagacatactctgttcgtgtattggaagactcaacatagtaagaatatatattctcccaaaattactatcaaaattccaccaaggcttttatagatataaaaaaaaatctattctaaagtttatatggaaaggcatagccccaaaatagctaaagtgattttcaaaattaataaagtgggacacctggttaaaaatcaactcaaaatgcattaaagacttaaatttaagacctgaaactataaaattgctagaaggaaacaggggaagttttccttgacataggactagtaatgatattctgaacatgactccaaaagtactggcacaaaactgaaaattaaaaaaaaaaaaaacagaattgcatcaaactaaaaagcttctgcatagctcaggaaagaatcaacagagggaagagacaacctatggattgggagaaaatatttgcaagccatacatctgataaggggtaaatatccaaaatatataaggaactcaaacaattcaaaatatcatatgtatcccacaaatatgtacaaatattacatatccataaaaattaaaaataaactaggcatatcacctgagtagacattcaaaagaagacatacaaattgcaaacaggtatataaaaaaatgtttaacatctctaatcctcagacaaatgcaaattagaaccatcatgagatatcacctcacaccgatggaatgtctattattaaaaagaaaaaagataagtgttggtgaggacacaaagaaaaggaaacccttgcatatcgtttgtaggaatgtaaattagacagccattataaaaaacagtacagaggttgcttttctcaaaaaactaaaagtagaacaaccatatgatccagtaaacgcactataggttatgtatccaaaggaaatgaaatcagtacatcaaagagatatgaagactatggttaatacctatatatgtattacatttttaaaattggtaaaagagtagattttaatgtctcacctgaaaaaataagtatgtgaggtaatacatatgttaattagctcaaataagtcattgcaccaatgtgatcatattgtaaaacacaatgttgtacactatacatatataacgactttatttttacatacaaaataaataattttaaaaacaacatgagaagaatcactttagttaatattaaagcttgctacatagctagagtaacttagactgagggtcttgggtgaagagatagacatatagatcaataaaacagaataaagaatcctatattagatcccacacaatcatattcaactgatttttgacaatagtgcaaaagcaattcagtggaggaagaataacccttaagtaaatagtgctgaaggatctggcaaaaaaactgatgtgaactttatactttttataaaaattaacccagaatagatcataaatatatatgtaaaatataaaacaaaaacacttttaggagaaaatccttgggcaaagaattcttagaattgacaacagttgcaaaattcataaaaaaattaattagacctcatcaaaattaaaaaaaaaatacttttgctctggtaaaacccatgtgaaaagaatgaaaaggcaagctagaaatttggagaaaatatttgcaaaccacatatctaacaaaggagtaggaaaaaaaaaacctctcaaaatataacattgggaaacaatctaattagaaactgtgcaaaagacatgaacattcatttcaccaaaaaggaaatacagatggcaaataagcacataaaaaatgtccaatattattagctatcagagatacgcaaattaaattcacaatgagctatcactatatacctttcagaatagctaaatttaaaaatggtgacaataccaaagcgtggagagaatgtggagaactgaatcaattgaatattgttgaagggatacaaaatggtacagctagtttggcagtgtgttataaaactaaacatgaaattgccatacaatcttgcacttgcactcttggacatttattccagaagaataataatttatgttcacacaaaaaaactgtaaatgcatattcatagcacctttatttgtaatatccccaaactgaaatcagctcatatgtccttcaacaggtggatggttaaacaaactgacatatacaatgggatactactcagcaacaaagagtaacaagctatttttttaaagtaacaaaataggccaggggcggtggctcaagcctgcaatcctagcactttggggggccgaggcgggcagatcacttgaggtcaggagttcaaaaccagtctggccaatatgatgaaaccctgtctctactaaaaatacaaaaaaattagccaggcatggtggcaggtgcctgtaatcccagctactcaggaggctgaggcaggagaatggcttgaacccaggtggtggaggttgtagtgagccaagatcgggccgctgcactccagcctgggtgatgggtaatagagtgagactcttgtctcaaaaaaaaaaaaaaaaaaaaaaagtaacaaaatagtgatagatgtgtcaactggatgaattgccagtaaattaggttgagtgaaaaaaaaaaaaagttggtgcgatggctcaggccttaatctcagcaagttgggaagccgacacaggaggatcacttaagcccaggggttggagaccagcctgggcaacatggtgaaaccccgtttctactacaaatacaattagctgggcatggtggtggtgagagcctgtggtcccagctactcaggaggctgaggtgggaggatcgcttgagcccaggaagtcgaggtggcagtgagccattgcactccagcccgggcaatgggagtaagatcctgtatcaaaaaaacaaaaaacaaacaaacaaacaaagaaaaatatatatatatccaatcccaaaatgttatacactgtatgattccatttatacgacatttttgaaataacaacattttcaaaatggtggatgggttaatggtttgattgcctggggttaaagacaaagggaaagagggcaggaggaggtgggtgtggtcacaacagggaaacagaagagatccttgtggggttgtaactgttcagtatcttgactgtgatgaatatgaaaacctactgagctaataaacgttatagtacttaatacacacaaataacctcacataaatgattccaaatagaactggaaaaatttgaataatattggtggattgcatcaatgtcagtatctggttttgatcttatcctatcattttttcaaaatgttattattgaaggaaactggcaaattaaacaaggggtctctgtattatttcttataactgcatattaatttataattatctcaaaaatgtttcaattaaaaaatcctattaaattccagattcactattagtgtccttttctgtcctataactattgaaacagaattttttcataggatatattatgatgttgggtaaaacacatacaagcagataattaattcctaatacataataatttatttcacacacaaaattatctttattaaatatgacagttcacaaaactgcattttatatgcttcttagcaacttatagaaattactgacccaggtttaacagaaatattcactccttctagatacaggtgaacttcttgactttgaacatagactgctaagaaggctgagggtgaacccttgcaaattaactgatcctggcaagtcaaaaaagagcgtaatgggaaagaattaagctacagaccaaatccctcttccttccacttacccatccgtcgcaagaatttaatattagaaactgcaagaatagtgctgctgctaataactagaagaaatgactatgaatatgtggaaatgcatggattaaactaatggggtacatgacatttgacattggccaattcttctagaggactttttaatcagtggaaagtcctattcagggagagaatcttaatgcatcattgatgttgcttattttttattttaatagtgagatagttttaaacaaaatggagtgattttggagggtggaaggaacagagctgatcaggcaatgcagcagagagttaaagcacaaagcattcttggaaccagaaagacctggcttcaaagctgaaatttttcaccagtgatgttctgtgctgttggttaagtcaatttatctaaaccttagtttccttctctgtaaaatagtgtttgcaacagtaatgactttatagagtcatggaaaataatatatgagataatctgtatgtttttagcacagtacctggcataaatatatgctcaatacaagattcttatccatttgattcacctagttttcaggtaggttttttataccaatttattgatgaataagcatttcaaatgactttttgtaaatgttttaacccaagacaaagttggatggatttggaatactcttccccattaagtcatatatatatgcttatatatgtgacatatatatatatatatatgtcattgactggtcagtcttcttcagaattcatatctacttcagataacaagggctgaatagagccccaaagccacaagggtgtggaatcatcaccacgccttgacccaagcttgtcttccacaggataatttcctatgaactggccaccaggtttgagagtactcctgaaactttgcaaatcaggagggcagaagattctgtggatgagacacggcccttataagatgactgagcactatatactatttagaccaaaagttttccaaatgaagcctgagagtccttttcatcataatcaactattgaatggctaaattgtgcatctaggaaaacatgaggaataacagagacagcataatagagctagacagggaatgagaaccccaggaattagcagaaatcctagtgaaagctttgtactttccctagacagaaactggctagggtctaaatcaattagccctcagaaaaaccccacccaggaaagactcagatgatacacatttgcagcatagttttgacttcccttcagatcaatcaagtcctttgcaacatgagtgggttagtgttattttttagagccaaacaatttttgaattaacttctttcagaagactagggaaaaaaatcatttccacttatcactggatttaaagagtactacttgacttttaaaatgtctattgtaggccaggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgtgccactgcactccagcctgggcgacagagcgagactccgtctcaaaaaaaaaaaaaaaaaaaaaaaaaaaaagtctattgtaaaatctattagtcacctaagccacaaaatagaaagtgctaccccatcatcaccatttctgtgacctgtgtggtggtctacttctgaaggctaaatatttttaagatcatttttaataaaaatataagacgaaagcattcatgtgtgaactgaaacacttaaaaatgccaaactttagccaggtataattctgggtctttttaaagagcaaatggaaaccatttctgagcatctctcctgtaaagtgtagctcctacacttcaaataaagggcttgagagcaggctttagataaatacctaaaacttagaaaacgacttcttatgaggtcccagtgaataaagacaagagcattgtttttataagtatttggcaattctattgcaggtacctaattcttctatctttactccatttctacaggttgttctgcaggcaagtctttctcagttttccatagcattaccctaatgaaaccactcaacttagtcctctaaccaaggaacatacatgattcactcaatgcagacagatgcaaagcctttttccatttttgctgcatctacacatttgatgtccagtcaggaaagcccagctgaagtcagtataaaaacctgttgtagagaatgcaagaagctcccatgatgctaccaggagaaatgaagacagtagcaggcattgaaacttacctttattatatccttatcccaaatctattttcccaggcttgtagaactccagcacaacttaaaattggaaatctatcagatgtgatgaaggatgagattgttgtgtgggttgtttttagtgatgcatgtagaatatgtaatgtacatgcacatcgatacatatgtgtgtttattgcttttcaggtgtttgtaaaattttgaagagtattaatacatcatccactgcacgaattaatagttaattatatttgtgttttataaataaagatgaaaaaacatcatagataaatttgaggttttactccatttctattcatattcccctctcccaattccaagaggcaaattctatagtaaatttagtatgtcatacctaaaggtatttttatattatatattatgtctgtttctctgtggctacatttttgcttttgtttcttaaataaggcatgcatgaatataaatcactctttttagtggtaatcataatacaattggacaaggatagatgtgagagctaaataattttcatctagttctaagttagatatttatatcttatatgttttagcttttatttattttgctaaaaatccctaaacactttattgtacatatgtccaaatagacattgaaaatatatacaaaatatagatggttattaaatatttttaccactagcattttctcatgctttcatgcccttacttatgaaagtattgaataccttactgtattagataatcttatcacagtttactaaggataaatgaattgcctatacattctttgtgtagactcacagaaatagaaaagcctaacatactgctttggaaagcatctaattcctcttagcacaatgtaagtaacaaaaaaaatgcatgtcttactcattttgaatcatcacactcatatcaatagggctacaatgtttccatcataagcaagaaaagtaaaggatcaatttacacaaaaaataaagaatcattttgggaatattggaaacaatgggccagccaggtttcacgtttcagaaagaactaaattgctcactttggggattccattagttcttttttttttatgaactaatacaaccgcttcccttataatgaactaatgaagccattatagaaaagatagatggataaaaaccctggctctgctttgcttgagccttaacagaataacccaatcttcacgctattgcctcaaattagaaagcataatatatcagtgataaagttcataacagaaacacggcactcccctaaaatattcctctttcacttctgaagaatggttataaaggtcaaaataaaatgaaattacttggttcatgggcatttttttctcactcttgaatccagtttttcagggatctcatggcttccagataatatagatatccttgtctagtctaatcaaaaatactggagtaagaaataaaaaaaaggaacatgatgcttttatcacatttctaccaatgtctaatgatattccagttttttaaggaagtcttccccgatcactccagagacagtaatattttcttcttctaaaatccgataacagtttatttattcctctacatttttttacttaggaattttaaattaactttcatgttcagtctccaaaattaaagtgtaaaaaactatcttaacatctcagaatctgcaataaatagaaaagtacatttaagttagtaaatgtttaaaaatatttgcaacaataaatgaattgtcaaagtaatactctaacttacatcaacatacttcattcttaaagaattgcattactaaaaggaaaaaaaaataacttataataacacaatcatgagccacatgacattcctgttaactacatatatgatagtggtcttataagattaaattatagtatttttactgtaacttttctatgtttagatatgtttatacatacatctatttaccattgtgttacaattgcctatagcattcgatatagtaatatgctgtacaagtttgtagcgtagaaacagtaggctatgtcatatataatagcgtacatatgtagtagacgacaccatctaggtttgtgtaagtacattctatgatgttcgtacaatggcaaaattgcttaaagatacatttctcacaatatagcctgtcattaagcattgcctgtattcgtttttagaatttttgagtgcttatagacagttctcaaactttagctttcataatagtcacctagataacctactaaaaatgcaattttagctcatattcccagtgattttaatttaacatgtggcagccaagaatccactttgttacaagcacccagagtattctgatgcaggtagccctgaagcactctttgaagagcattatactgaacattaagttgcatgctttacaggcattatattacttaatatcccattacagagcaaccctacgaggtagctactagtgtatcattctattttatgggtaaaaaactgaggtctaactaaataatcgaaatctgcattgccttcttccactctcttgtacttaatctatagtgctttcttggtggacagattagcagaccaacgcatgggagatttccggggcagggccaaagccctgtcaagtatggagagggttagtgttttgtcttcactggagtatcattctagaggaaaggttatgacagtcacaattcaaagaatgaaactatcccaggagatgtatgattattcaggtagctaacaggaggatttcgcaggaagagatgtaaagaataacaaagtctggtaatgggatgaaagagaaataaaacacaatcctctagaaagttgtaaattacagttattgaatatatagtagaatagactagacttagagtagaacagacttagagaagaaattttagaatgtaagcttcatgataacagggatttttatctattagttgattgctgtacctcattgcctagaacaaaagacggcatgtagttaggtactcaaaaagtccttgctgaatcaattaatgaataattatggaaggtgattttggaatatatcagaaaatacattttaacacccaattttcagtcattcctgggtcactgaccatcctctcctcagcaattcttcactttacttcccgcaccagtaacttctttttattttgactataactaaatatagacttctgctggaggaagtactgtttagtcaagactcaaagaaaatagaatagccttttgccactctccctatgagcagattcactgaagtctctaaatatatttgaagtcattctatgtggaattcagaagccactctgctttgggggagttcagaaatgcttaaaaaatcaaatgcttaaaacatcaaactcttctggttgaagagtttgaagagattgaagagctatctacagttgctataagtggataataaagaatacttcatttaaaattaaatgatttcaggtcaacaggagagagtaatttttggttaactgctgaatttgcaactgaaatattatcatttggtaatcttaaaaaatcctatctggaaccataaagggaacaatctgcagatattacatttgtttttctttttttaataagtggtactaatattattaccagggtaataactcacatgctacattaaagttatgtttatttttacatgtacatatttaatcattgaataaagattaattaaaatattggagttgcctgttattggcaaaatatctaggaagaagaaatcaaatggataaggtgaaagaagaaacacaataacctgattttctctgtttgaccaatacagttcccttctgaaaattgttaaatatcctataatttaataacatgtcttctgctaaaaataattatgtataagaagaattatctattaaatttgtgttaaagtatgaggaatattcaattaatgtattatctagcacaaaataaacactcaatatatattagccagcatgattattattccacatttaaatgaattttattcccaaataaaaatatcctaattttaatttgtggttgaataaatgaaaacccaataggtaaacataaaatttaaaaatcaggacattatttacaggaaagagtgacaacttttaaaattttaatttgataatttcaagtattactaaagataccaggaaatgctggtggaaataacactggcctgtaagattggcggtcagatgataatgggcattcaaatgtaaatgtgaattgactatgacctaaaaattctactccttgaagaagtttgttgtgctgttaattgtaaaagtaaataacagcaaaaattttaaaattttatcaacaggacaatttcttaatggtaattttatgccatatttgtataatattatgcaccagtgtaaaagaataaatttaagctgtatctactaactggaaagctcttcaagacatataactaggtgaaaaaacaagttatggaagcaaagaatatgatatggtacacaaacacacctacataccaaacaatgctatttagttacataaatacattgggaaatatgtatgtgagtactatgggttgaattacttctctcaaaatcaataaccccaggacctcaggatgtggctttttttggaaatagggtctttacaaagtaatgaagttaaaatgaggtcattagggtgaaccctgatctgttatgactggtagccttatcaaaggggaaatttggacacacacccacacaaacacacacacacacacacaaaagacaatgtgaaaatacacacggagaagatggccatgtacaagtcaaggaacacctgagactaccagaagctgatatagaggcctggaaaagagccctcactctgttttcaatgggagcatggccccgccaacaccttgcttttggacttctagtctccagagctgtgagaaaatgaatttatgcttcagccatttagttaatggtacttttatggcagccctagaaaacaaatacagcaagtcatagaaaataatcttttatacaatatacatgtaatataatggcaacttatgggaaatggactgaattcagatatggtgtttaaagaagaaatgcacacttttactacaataatatattacctgtatatttacaaattaaaaaattagaaagaaacatttctttatgggtataaagagtctatgctgtgacaactcagcagtatatttagcctacataaaattgtggcattaggaaagttttcccttaatcttttgaagctccctctttgcattctcatctgcctttctggtactcatgggcatcactactgactttgattgcccaggttcaccagttatccacctactatttgcaaagcactcatcaaatggccatgtctgctgagtgggcactcaataaatgctggttcccttctgctttcttcctccttgcccagggcccaaacatcccaaactcacctctctttaaatttctacctattcataatgttctcacttcttataagattattaaaaaggaaacaactaacttttgaatagttgagaactctcactctttgtgttgttggcaaataaaaataatatttcaggaaagccaaataaataccgattgagtataatttcattctgtatgaaaaaaggaactgtagagcctacagtcccatcagaaagattttggcattaggtctctagattgtgcattcagcatgtaaacctggttctaccaataaggagttcattgagcaaggcatttcaaatgtgtttgtaactgataatgctcctaacttcagaactgagagctctcttcgaaaaaacactcttcctactgtgcatatagttagaaaacctaaagtaagaccaatagaaataagatacaaataatttttttcatcaaaatagtctaatgacttagtttatccttcatgtgctttaataacaaggcccaaatatatataacattttagctgtaacagtataagtttacacacattagcccatttggtcttcaggaaactcttgtgaagcaggctagacagatctaattgtcctagtgcctggcttgataattcaaatgaacttcaattaacactgcactgactacaagaaacattgaggaatgcagaaagtgattaaaagatgaataatatagggattcatatcatatgggaagaggccagtctgaaaaatagagaggtttgagttatcaaattatagaacatataagcagataggcttgaattatcagtatttaaaatattaaataccttttttcaaattaattgaagactgcttctaagcaattattggtcttatcagatatatgctttaaatgaccagagaaaattaatgcataacaatcgtattgttggtttaattttttttcttaaatgattcttttatataggttaacatgattagtttacctaggaaaaaccttttttcatttttggtccaaagtatacttttgtgataattctcacatattttagatgagcaacctacccgtgaattaatcttattgtatatgtttatatagtagttccccttatcattgggacatatgttcaaagctccccagtgaccacctgaagcagaatcctatatataccatgttttttcctatacatacatacctacgataaagtgtagtctgtaaattaggcaaagtaggagatcaataactaacaataagatagaacaattataacaatacactgtaagaaaagttatatgaatatggtttctctctcaaaatatctcattctactgtacccaaccttcttttttgtgatgatttgaggtaataaaatgcctacatgataagatgaagtgagatgaatgacagaggcattacaacatagcattaggcttctattgatcccttgacaacatgtcagaaaggattatctgcttcaggtaatcctagatcatcaagccatgaagatgtcgatggttggatttcaggagaaggtgatgtcaatgactaatgggtgggtagcgtctacaatgtagatgcctgggacaaagggatgatccacaacctaggtggaacagagcagggtcatgcgaaatttcatcatgctactcagtacagcccgaaattttaaagttatttgtttcaaataaatgaattaatttctggaatttttcatttaatatttatgtagttgactgtggataactgaaaccacagaaagtgaaaccacagataagagaggatttgtgtgtgtgtgtgtgtgtgtgtgggtgtatggcgtgtgtattcaacacaagagaaacatcaaaagttattcaccatccatatgcagcttcctgtgtatgtgctttgggaaatgcaaatatcaataagaaaatattcttctgcttggtagagtctactaggacagaagaatcacataaaagagaaaaattataaaaagtaaaatgcaacactatagaggtttagggagcttttccacatataaagttaagatttttaaaatattttttgtgttttacattttagactcataaaagtacacttcttcataactaacgactacaactttaaaaagtcagatatattagggctggtctttgaaatgggagttatttcatcctctaaagcaaaattacaaatgaagtccactcaactattaaattatcacaggcatgacacagtaccaaactgaagaaaaatgtgcatgattcagcacaataggaaacttgaaaaattgtagcacaacaagcctccagctcaaactacacggtagtcttgtgaaatgatggcctcccaaggagccctaatggccagagagttagactcatttttaaaagcattttccgctggaggacgagattcattgccatccattatcaaacagcatcaatatcaaaatcaataatgatacttctgaatactattaaaatattggcaatgaagccacgttcttacatttcagggagtaaaacaaatgaaagataagaaaagaatgccaaaacagcagttacatgatgaagtgagcaacgcaatcaagcataagatggacagccaaaaagcttcaagggcaaactaaagtaaaatttgaaccaatgtaacagcaacatcaattgcttcagaacagcagcagcagagaggcatcactggagggaacaattagtgacagtgacttgattgtggaaaattgagtgcctacaacaaaagtaggagataacggacacaccaacaaaaaactacaggaggaatagctttaatcatcctcatcaaaataatagtatatgtaggtcgaatacaggtcacttttagctttcctcatcctcacagaaaacagcaccaggagatattattaatgaatgcacaaagttctaatgtgtgtcaaaaaatacagttcattaagctgaacagtgcgtgattcagactagacatgttttcacagataattaagaaatcttgggttaaacagatggagaagacagatgctgttccttctaagttctcaaattttgggggtcaagctatcccattatttctcttagccagctgtgatgtaaatatggaaaacacacctgatttggtggatgctgctcaggctattataaaagctaatgtagtaacaacactttgatataattatctgaaactgggagacaacaggaaaaggtcattttgaaattaacacaagtttcaataatatcaaggacttatataacactaacaatgttccagtcacttgtctaactgcttcccaatattaactcatttaatccttgtaaaacttctgtgaggtacaggtaaactgcttttccgatgaggacactgagatactgggaggacagatggcttgaccaaagtcatacaactaataagcagctgtactttagaatataaagagctcctgtatgactacaggaagaaatttaagggatacatgatttcattgtctggcagggtttttttttaatggaagaatcattttatttacatccataagatttcacaggaaaaactatcaaggatataacaaattaacatcaatttttctacatattctctaaccattaaattcataattccttcaaattagaggaggataaagctctttgggcaatcacaaagtatattgttaatgcagttaacaaagtatttcaatatacatttattaagtatctttattatctgcaaaatattgaagaatatggaaaagaacagtgcgactgaggcatctagggctgactgcctgcatgaacacctcacattgctgcatgatcccagtggggtttcattctttctccttctcaaaaatttcttgtaaactttccaagtcttcttttatatatatatatgtgtgtgtgtatatatatatatatatatatatatatatatatatatatatatattaaactttaagttctagggtacatgtgtgtgcacaacacgcaggtttgttacatatgtatacacgtgccatgttggtgtgctgcacccattaactcgtcatttacattaggtatatctcataatgctatccctccctcctcccccccaccccacaataggcccaggtgtgtgatgttccccttcctgtgtccaagtgttctcattgttcaattcccacctatgagtgagaacatgtggtgtttggttttttgtccttgcgatagtttgctgagaatgatggtttccagcttcatccatgtccctaaaaaggataagaattcatcattttttatggctgcatagtattccatgatgtatatgtgccacattttcttaatccagtctatcattgatgggcatttgggttggttcaaagtctttgctattgtgaatagtgccacagtaaacatacgtgtgcatgtgtatttatagcagcatgatttataatcctttgggtatatacccagtaataggatgcctgggtcaaatggtatttctagttctagatccttgaggaatcgccacactgtcttccacaatggttgaactagtttatagtcccaccaacagtgtaaaagtgttcctatttctccacatcctctccagcacctgttgtttcctgactttttaatgattgccattctaactggagtgagatggtatctcattgtggttttgatttgcatttctctgatggccagtgatgatgagcattttttcatgtgtcttttggctgcataaatgtcttttttttaagatttctgtttatcttttataactatactcttacaagttttctcattatttctccccccaactttttttttttttacccacttgttgatggggttgtttgtttttttcttgtaaatttgtttgagtggaaaggattccctatttaataaatggtgctaggaaaactggctagccatatgtagaaagctgaaactggatcccttccttacatcttacacaaaaattaattcaagatggattaaagacttaaatgttagacctaaaaccataaaaaccctagaagaaaacctaggcaataccattcaggacataggcatgggcaaggacttcatgtctaagacaccaaaagcaatggcaacaaaagccagaattgacaaatgggatctaattaaactaaagagcttctgcacagcaaaagaaactaccatcagagtgaacaggcaacctacagaatgggagaaaatttttgcaatctactcatctgacaaagggctaatatccagaatcttcatgtcttcttaagtccttcacaactttgccttcttttgataaccgttttactcctctttcattttcccttgtgcttcccttctgctctataacaacaatgctgcatattttgtcctttacagtctttgctagctgaatagaacatcctttctggtcagcaaaaggacgatgcacattacagaatggccacacttgctcttgcccattagttcttgaattcaacatgtaacacctccaagtttgttgccccacttgacagctgagggcaggaaagagttattgttaatcatcctagtgatttggcataacagctgaatttgaagcctagttctgatcttctatcattactattttggatttgcaaataatgtgactctaaattctttgtttaatcttttaaaaatccactacaattttatctgaattgtcttatttgtcactaaatgagaagttgcaacagtaaaggtgtacacaggaagcagaactcagaaactcagattaagagaggtggctgctgtttggcttatgtaagaaaatacacttctttaaagtacttcaaagtaattatttgtatgccattagcagaatactcatttaaaacgatggcagtaaacattgttttaaagtaattaatttttatacacacttggtatgtaatttttgtatatacttggtaacaatgggctactctctttttcaaaaaaactgatactttagactgtgccactgaacaaatctgaattagtgatgccttccagttataacccttcacaaacttctttccatgaatctcaaatcaccagtttggctcaatgtctcaagtctaaggactcaatgccatattaccatatcggtgctgctcagctcagattaaactgtaatcttctggcagttaatctgcatctctgcatctcctttttttgttgttgttgttgttgcttactgcctggatgtaaagcagacattctttctcctttataatctttcttctctatgtcaacaccttttttcttgattttctaaagggaaatctataatattctcttttattatgaatcccaaatcctacctaccattttctggagaactcagttcatatgctataggttttgctatataataaaaggtttgcttatgtttagattatgtatactctcaatttgatatatagagacatttctagttctttcatccttaaatattttcctgcaaggactaaaatgtacctatcttcaagaatatatattagaactgtgatttcctctatgtagcgtctattaatgcaatctaaataatggcccataaaaatcagcaaataattaacaatgctggtggaaatacctgtaatcaaccagatttgagattaggcagaactgagtttgagctcagattcttttcactgaagctccataaactttgtaaaatgaaggtagaggtgaagactaaacaagataataaggggaagattttgaccaagtacagtgctgtgtgctcaatagaaacataactacacagatatagcctttcttttttagtttcaaatatttcccttgcaaatatatcattgtattataaacatgttattagtaaccttagttgtaacaaagcacatttacaaatatcactattaaactgaaatagaaattttcataatatttgtctgagctcctcacttattagttattttctaaaagtacagcttaagtgttccaccatgacaacattggtgctggtcctgatactgctggggaatagggagaagcagtatttcttttattccaccctctgtgacagtctaacagcttttggcaggcagaggaagaaataattcccagtctccccttaagtcttgaatctaaatcttacatttttatgctcaaccataagttatttatctagacagggatctcactgtctctcacattcattttatgatgaatgtttcactgggaaaaaaagagatttctttgaattataatccagtgggaattctattatagttcaagttcactattgagaagaatgcatcaaagcaggtttattaacagcatatttttcttcttatattctcctggaagtataataaatttctacaatttaattatcattattagaatctcaggatgtaaatctcattgcatcataacatctaggttacatgttaccagacatacagtacccaacttggggttaagcctacagtatctggagtcaatgcttgggacctaaatcacagctctaatctgttacccactgggtaatctggagtaactatttaacatacctgtgcctcagcttcccatttgcataaggggaaagcaatagtgctccacaaatgtgtttttgtaaggtttaaatgataggtatactgataaagaggtacctggcatatggtcactgctaaataaatattacatattatattaaataaatatacgttgacaatataaaaactctatattggaataggttttttcattttaggacaacagttattgtgcaatgcatgagtgtagaactctggtcaaattgctgaccccttgaaccttaggtcttctcagattataaatctctgagagatatctccacttcttaaacattatcttttaaaaagtgtcatacattatgaaagacctgaaaaacaaatctttgtagtttgctaaccatctttagcaacaatagcaatataaaataagttctcaattgtttgcaaaagacttaaaaaaagatcagaaacttgtttcttaaagatgacaggaccaaaagaagataccgaaaacatttgtttttctacatttaaattctaatgagcatattaaaaacaaaagtgaagacacaacatggtgggtctaggaccattggtggctttttctctttgcctcagagtattgttctgtaaatccattatttttatcattctggcctataatgggattgggaagttgtttggcctagtgtttctcaagaaggaatgtccaggatgctttacttcactctcttagaatttacattgcaaaatcaataatgatagattgtttccttatttattgaacctagaattgttagaaataccatagacatggctagtaaaaacattcacaaggaaagtttaggaagggttcagtaatattaaaatgtagttaatacaggtataaaatgggattttaaaatacctagtcatatggataaggacaaaaatactcttttgcgatacatggtctataaattattttagtgaatttttgtgatttgatcaatttcttagttatctctgagaatgataaaaagtttataaaatatttaaaatgtaatgttcacataccacaaattcaaaattgtatttattaatattagaatcatatttatgttgttaatattaaacaatataccatgatcaagaatccaaagacagtttaatattaggaaatctgttaatagtaaaattcaacatcaataagccaaaagaaaaaatacatctttattttgtcagatagcaaaataataatctgactagcaaaggaggaacacaaggatacttcgctaacatgatacagcaacccgaaagttgacataatttcaaataatgaaatactacaaggatttccattaatgataagaataaggcaagagtaatattttagatataccagactgcaataaaatttaaaaattaataaatgttataaatatattctaggaagagacaactgtatatcagtacataagttatgataaagccattcaaaagagtagcacatgaatatttatttaatggtttgggggtaaacaatgcatttaaaagagaaacccaatgtattcacctaacattatatatgaagattacagatacattaaaagaaaattatcaaaacaaaacatcaaaactcatggcaagagaaaaccaaaggtgaatatttatgcaaatacaggctaagaaaatcatttctataaaatataaaagaaagaaatgatgttagagaggtgttgataaatatgaccatataaagcttatggttacaaagatggattgaagtgaccaatttgcttcttggaaaatatgaaaactggaatgcttcttgaaagcaccagaagaaagtctgttctgtgaactatttttttaaatgaactcctaggataaatgggatatacttttataaaagtataaaaacaatatattaagtcaaataacttagatcatttgctatataactttttccattaattttctttgaaaatgtaagcaatttgttataaaatagcttaaatatgagaattcagtaaaatttccagggtattaagaatagataacatactatggttttctcattagctattgaatttcacttgtggtgatggtttcacaggtaaatatttgcaaacttaccaacttatatatattaaataggtaaaattttttgcatgacaatcatctccataaagtagtttaaaaattgcatccaaaatgttttcaaagattcaatggacaataaatgaaacttttaggacactttgtgtttttgtaatatgtggaatgaaatgttttcatctgtatgactatggaaacttcaaagttggaggaacaaactgaatatttttatacagatggaaatctcatttttccacaaatatcttagcagtatactatttcacagatagtttctgttagactctgtcactatgtaccttcttaaaggtatagttgtattaatatagtaattagcatgaaaaatattccatggaaggttaaagaaaatgggggtttcaaccaaaccaacagcaccattattttctttaaagtcttatagacagaaggtttaaaggatcttttaaaagatctgagcatactgaaattttcatagtagtacaaaacagagcatgtacataaagtgtaataaatggaatgttgtaatggactagaaggcggtaaggtgattatggaagctatcatgtgcaagctcgcataaatgtaaggctgtaataaaaaacataagtggatggtttctgaacctggagtactatttaacaacattagtaaatttggattatacaccttcaggaccaggaatggaataatggttgaatatcataaaattgttttaagataacatgacttcaaattcgagctagtgtttgaattttaaaatattttttctccacacttttattataaaaatagtgatggtaggaagtccactgtattgcatttaacaatacttttagttctaagaattgtaatagtactctctcatcacacattgtagcagaaaaatctattttccttacccatttttgaccttataaaagtacttttataaaaaaaattccacatataagtgagatcatgccgtatttttctttctgtgtctgcacacagaaaaagagaatgaaagagtggttatcacaggtggcgagggggacggaaatggggagatgtaggtcaaaggatacaaaagagcgaatatgtaggatgacaagtttagagatctaacatatgacatgaggactaaagttaatacaatcctattgtattagggatctttgttaaataagtagattgtagctgctcttgttacgaagaaagtaactgtgagatagtagatgttaacctgcctcacgatagtaaccattttactctctctatgaatcccataacattatgttgtaaaccttaaatatgcacaataaaatttatttttttaaaagacactttatcatcttttaaaagatatccttctctggaaaagagggattctgataacattaaaattactttaactgtgttttaaagctataagaaataataaaaaattttaatatagaacaaaaaaacccttatataatgtttcctcaacaactctgggatctgaacaccattaataatttatactaatggttacatttttaatataaaacttattaacaaaatggttatctgtaggtacgtcaaaattgacaaaaatatctgaaaggtattaacatagatatgcatttaacaaattagtgttgggaaactgtcagaatttatgcccagtcacttctggtgattaaaagaatattccattcagattcaaaattgtgaaataaaatatctgttttaacagttatatatgaaatttcagagtatcaaatcaaattgtgtacattgggattaaaaacagagacattttggctgtgattgacagcagagctaatgcaacaagaatcattatgataactaaaaaaaagaatattgatacttagttactcttcttaactaacaggtggggctgatactcaatcagccaataagatggaatagccaagctatagttactctaagttgtcaaggtaacacattcatccttgagattttctcattaatctcctctcatgcttaggtttatggaataacaccgaggacaattccactcctttactacttggctgctatgatctgaatgtgtgccttcaaattcaaattgaaaactatccccattgtggtggtattaaaaggtggtgcctttgggaagatgactaagtaataaaggctttgccctcatgatgggatcagtgaccttatatgagaggttgaagggggctgttttggcacttcagccatgttgaggacacagcaacaaggagccattctgaagcagagagtaagccctcaccagacactgaatttgtgggcccctcgatctttggcatctcaggatgtgtgtatttttgtggatatatatgtatacacacacacacgttatatataaatagtgaaaagttcatatgcctcttcaaaatttatttacttcaacagagatggctcacaaatttttatgcttgtgtgtgtgtgtgtgtgtgtgtgtgtgtgtgtgttaacattaacttagaggacatttgcttctgaattcagctctcagctgtttggagcctctgggtatgattcaagtcttagaattggcaaggaattctctcctatctttacatcagtgggatttccatttgcttactttggaattgtttacttttctactttcctcttgcttttctgtgtagaccatagtcacttcctccacctctgattcttcctaaggctttcgattaccacttagacgttcaacttttaacctcttctatcatatctctgtattgcaacttgttacactactttctaattctaaaaaatcaacactaccacgaaagtaacattgtttactatcaatggcttaaatgtgcaaactattgattttattttaaaaaatgaggtttttttccagaaattattatgactcctgtttatacttctgcaattttggtccctactctctggtattccaattttgttatttgttatattctcttttgtcataatcatatgacgtgctaaatttaactgttggctttcaataatttaattatcaacttggacttttccctttagtactcacctatataagcatttaaaacaatggtgatgtgttctagaacaatatattctaatttcatagtaggtctagatgtcttccttgccttccttctttatttcttctttttttaaatttggaacatgatggaaattttaataaatttttcaaaaaacaaactatagcaataatcaagtcaaatatttaaattcgtattgatttaaacgacctgatttaaaacttttgaacacttttaaatgaataatttacattatttaatctcaaaatcataaaaatcattttgtagatagtaaataatgatatttccccaaattaaaataataatattcctgcttgcttaatgattatatacatagaaaacctgcaatttgaaatttacctgagattagcatctagcctagtttcattttcaaattcagatcataattatagtttttcctttggctctggtataattctcttctattaagaccattcatttttcttaacacaacattgtttgctaaaaaggcatgctaaaacatgccttttaaatctctgacccttattgttgataaatacctaacttttctattgcattcattgaaatgtatcctaagcttacttacttttagttcagactacagtgacacctctgtatatacaagtacctatcaatacaggtaatcagagagagttcaacatataccaatacttagaaaactgttaactgggtttattttatttaacaatgacatctataaaacatgatgagacttttatcacgtaagttattcttagttcattagagagtcagttgaggcttacatggacattgaatgggcaacttattttaaggaaaagaatattcaaattatggtaaagtatgtaaatgtaattaaaattatttttatttttattttataataagaatatttagagagttgcctcaccctttgacaataatgaatcttacagaaaggcaaatgatttcacagagtgggaggtcatctagttcatattgtacattccactcttaatgagaaaggtgaaaaagaaaaataataatcaggctaaatcagagacttaaccaaaaaggcagttttcaatatatgtcttgaaatcaaatcagactcaactttatgaaccacatatatgtagtcattaaaaaaaaaaaaaacacagtcttgacccaaagctgggtatgagtaaacaataatttcaaaagagaatcacagcaatggtagcattattaaaataagtatataacctttccataatttagtatattttgggatgcttcttagaaattcagaaacgtcaaagttttactgtgcatactggagaaagagtttttataaaatacctaaaacacttcttttttttaaacaaaaagttgatcttaagatttcttgagatgttgtggcataattgtattgattaagtaagatacctaatgtgttaacaaataaaatgcatatcttctatccacatatccttaattaataaattaagataatctatatttttaattttaacattgacagatatcaaggacaatttcaaatttgtgttatttcataaacgctatggtcagtatgccataaaagaaattacgtacgatgataagtatcataaaatttcttatggaatagctaaattgcaaaattcctaggaaataaaattaaatttctgagatgttaactaaaaataaaatatacttgaaagagagaagactaacttatgaatgtgctgtaattattttgcatcatactggcatttatggtgcttgccttttctgtctttgactctattaactgtttagtagcaaatgccacatcataagggatatttttaaataatgcctatgtaaatagcattattctattttaaaagttacatgtatcagaaagtttttcttttctaaccattttgagaaaaattataaaagcttttcccagatatcaagatacttatttctagccaacctggaaataagtcattatatttgacttaaaagttgcaatagattctatgagaataaaaggaatcctagtgtatataatggggtaggggaaggggagaaatggtttactgtctgaatccccttttactcactagaagactagggctggctgggaccagtttgggtttcctgagtctagagctatccccatggttccaatagcttagagaagttgacaagggacctaggggagactcctatgcaaaactgagattcaaatgctatgaggagttcattatttccccaattatatatgggtgctttttaagtaacagaaactgtagggtttttatgaaatttatattttaatgcaatcagtatatattccatgcccaacagtccagaaaaacactgaatataagattacacagtttagaatttagatgtgtgttcagagaagacagcaggtataaataaattaggagtttcccatatggccaccagtcaccttggcctgatgaaatttccgtttataagtctgggtttgcatggctcctaaaaatgtctgaatgactagaagaaccagaaactcaggacgcaattccactctggatggaaggagctgagcagaacaaaatcttcaggtacagtattatttttcttgaagacaagacaactctgtatggctttacccaagtataatcttctccatttggaaagttttagaattttatagacaaaataacctgaacatttcaaaaaaagagtaaatattaaataaaacattaaagcaaattatatagcaatagaaatagagcagcaatcctattttatttagaagtcagttataaatgacattcacaaattatatcaagaaggttttattttcagtatgagatgctggaggagggtgcatagaagagatggtcaggaaaaggtagagtgttgagtttcgagaggaggtgaagaaattgtctttctgcaattaaagtatgtgggaatagtcaaatcaaagcactatctgtaaagattttgatcccagggcagagttccgtgcaatcccctcttcctattcttcgaagcgtggattttatgaactcaagtcatattgcagggcaagaaagttttggtagagagcaaaaacttgggaagagcaacattcagactaagggatgcatttcaggagagataagtacttccaacctttcctctctgaattagcagaaagagcctacagtacattgtgtgacagcctccctcttttgagtccccagccatcatctgtgtagaggctcatggcccagaataaacagcccaattcatagtatcctaaatctgtcaaatatcttactctgagagtgaggaaagcgtggaactcaatacacgaaatgtagctacagaaattatgatatattaatactctatcccagggctctgtttatccctgacagtttttacataaagaactttgagaaatttcagaagttgacttcctgagtgaatgaatgaaaacatgaatgaagataacaaattaaagcctaaatgtctcagatactttggaaaatgagtagaaacaagctcttttttgtacttagaggaaacagggaaagctggtttaataaaataatccataaattttgcaaatgtagattaatataagaaaatgaactctcataataacaaagattcaaaacaaactaaaaggtaaaaaaatatacagaaaatgacttcattctggctttagactccattcttattacggacaacttaggattgttgtaaaaatctgttaaagaaacggttaaaagaaggaaaaaatgtattctaaaagcaattacctttaacatatatatatatatatagacatatatatatatatatatatatatatatagacatatatatatatatatatatatacacactttactgtaagttccaggctacatgtgcagagtgcacaggtttgttacataggtatacgtgtgctatagtggtttgctgcacctttcatgccgtcatgtaggtgttttttgtttgtttgtttgtttttgtttgtttgttgagacggagtcttgctctgtcacccaggctggagtggcgcgatctcggctcactgcaagctccgcctcctggttcacaccattctcctgcctcagcctccccagcagctgggactacaggcgcacgccaccacacccggctaatttttttgtatttttagtagagacggggtttcaccatgttagccaggatggtcttgatctcctgacctcgtgatctgcccgccttggcctcctaacgtcatctaggttttaagccctgcatgcattagatattcgtcctaatgctctccctccccttgactcaccaccctccgacaggccccggtgtgtgatattcccttccctgtttccatgtgttttcattgttcagctaccacttatgagtaagaacatctggtgtttggctctctgttcctgtgttagtttgctgagaatgatggcttccagcttcatccatgtctctgcaaaggacattatctcattcttttttatggctgcatagtattccatggtgtacatgtgccacattttctttaaccagtctatgattgacaggcctttgggttgcttccatgtctttgctattggagacagtgctgcaataaacatacgtgtgcatgtgtctttatagtagaacgatttatattcctttgggtatatacccagtaatggcattactaggtcaaatggtatttctggttctagatccttgaagaatcaccatgctgtcctccacagtgattgaactaattaacaatcccaccaacagtgtaaaagcattcctatttctccacagcctcgccagcatcttttgtttcctgactttttaataatcacctttcttactggagtgagatggtgtctcattgtggttttgatttgcatttctctaatgatcagtgatgattagctttttttcatatgtttgttggcagcataaatgtcttcttttgagaagtgtctgttcataacctttgcccactttttgatggagttacttgtttttttcttgacctttactcaattttaagtggtattttaaaaccaaccttatgagggcctaattctgattttccaaatttaaaaggcacctcctttttcacttatagtaaatactttgccaaggcaggaatgagagctaccctgagagttctcccaggacaaactaaacgaccattcaccaatatgtactataggtggtggaagaacaaaaatgattttaacactcacgtattttactaggatttgttaattgtcttccctccactctcagaaattccaacacagagatagaacatgaactaaagtagaaaaatgattggtactcatcaaaaaacaatacttcagcctttattctccactagtatctatttgcagtgtatatttggttaggaaacttgatcataatctttaaattactgtgtgttggtagttgaaatctgtttcattaaatggctgcaaaggtgtattttcccattttctgatttattgtaaagacttaaatggtagtatcctataataatagactccagtaacaacagtttaagaactctacatcagagagactgcataagtaaaatggtaattactaaatatgcacccaaaatttaagggaaaaaacaagcttcttataaagatgttttaaaatttgattttttatttctctacttttcatgcagtgattcatctgagtaaaacaaaatcaattcctaattttcagaaaaattagaactctataacattttatttatcctttgatatgattattctgggatggtaagtcaatgatacaaattaagttttataaaaaaattaacatatagctgaacaaagccagaaaaagtaattctcattctcagttgcgtatatgaaacttcattaacacttatttcagtatattaacatttggaagcaaatttcttgccacatgtgaaactttgtttccttttattggaaatcccacaggtattacttgtttcatatcaataatttaatttctaagagcaatttaatggcacattgttatgtgaacatttctaattctcctcctccaataagttgaatatgtgaaagtattttacctggccacattttactattttaactgcaaaaaacacaggcagttcccgcttccctaaaatgacccagatgtccaaaatacaacttttaggctccgctctgcttaaagcccaagaaaaacagagccaggtctgggtgtctatagagctactagggagcctagccttaagatggaattgtttgtgtgtccagcttgaagagttaatgatcatcaactcatcaacatcaactcatcatgtactgttagaactgctgccaagtcactggtgtacaagagttcttctaagacttggagccacaagcttgtctcccaattcaggatcccagatggaagtagcccggcacctcacctggttctatgcagactctaaccctggtattagacctaagactctagacgttgattctgacatgtcttgggcaactgaagtgaactctcctgaacatgtgacctaacaacatgagcccctatgcttagagcccatgaatttatgccagtctcaactggaaaaagagcttgggctatttgttgcacctgtaaagacataagtatgtgaaaataagagtgaagggttaggcagccttttgtcccaattactcccactgattgtgccgattcctgtttactcccattggttgtcatatccaggtgggatgtccttgcatactgtaaaactggtaacctgttatttctgacaattttacacaaatgtggcataccatgaataaaatcctgccccaagatacataattacagtagagagagcaaacagttctcattgtacaatgaaattataaattaggtgtttcaaagagctgactagaatgtctcatatatgcagccaaccccaggcatggccttcttcctaaggctgtgccatgcttcttttcttcattctacaaacagtaatcatgttgttcctgttgaaatagactgcttaaaatgacactatttgtttttaatgacattatttgttttaatgtttttaatgtttcactatataatttcaaagcaagtctttctcacttgctattgattttatccttctagaatgaaagcaaatggaatttctaggtctccagataaaaattaaaacataaaaattctttcagactataaatatcagtcctttgaagaacaaatgtgctctgaacaatttacgcctttagattttgcacttcaattttctgaatagatacagaaatatgaaattctgagaaaaaattcagtcatagctgtagtactctcagaggcatacacattatgtgtgtgaaaatatgtcattgaaaaaatgttattgaaatcaattggcccagcttcttttaatgggttataaaaataagcccaaagtttaaagaaaggagaggaaaggccaattagaaaagatcatattttcttacaaataaatgtaaaagtgagctatttaaagctcttaccttagataaaggaatataacattgctgttaaacagaaaccatgtaattatacaatgaacacaaaattgtagttgtgagaaatgatataatcaaaggaaagtgtaaaattataacagaaaatgtgttaatgattatgaaactgcagaatgttggttttcagaaagcttataattggtatctgaaaacaggcaggttcctgaacatgggaaagtatcatcatcccgtaacgtgatataagaggaacagaagcaaattcttataactgtgtctagtggtttgacttctccacatcttccagagagccccagagaggtctgtggtgggactgtatagtgactcatattattctacatgtttagaatatcagctcccattttcatctctaaaagtttatgttctacaattccatcaatttacattgaaccatttttattaagatcattctgatatatcataatcattacattatttccaacttctgcagaacatatagatacaaacctcaatgtaaaatcatgtatgtgattttatgacacctgcagctagaccctgtttgtttcatgtatatgtttgtttttctcactccttccatcagatactctagaatagctatgcagaccattcaatgtaaggagaatgctggatgaatgagtgaattaacaaaggagaccgtctaaaataggctaaaacatgaatatatagatattgctcttaaagtagaagaacatgtacattgaggtatctattgatttttttaaattaaaattatatgtgtgtcactttctctgtcctataaggctggggatttcttgagcctatagaatcttgaatcatttagctatgttatcccatcatttagcccagcgactgttgtaatagactgctagcattcaccaaagatctattttttttttctttcttgggctcataactagattgcatttgccagcatcctttgcagttaggtccagccataggacttgttctcagcagcaaatgtgtgtcatttctaggctatgctctgacggcatgcctgtccattctatgttctctttttcctttcacctggtggatgcagaagacaatgaagccccaagggtagcagagccatagaacagaaggggatcagtcccagaatcagctgggaagaactgcccactgaccaggaaaatctgcctggtgagggagagccaagagatgcacttaaggaataaaatgtaaggaggcactttctctccagtttacttttttcttgagttcacttctttaaacaacatttttaacataatatggttattgagaaagatccctactgagaaacaagaggctctgaaccatttcatgaagtttccagtggccctatacagctctaatctgagttgagaattaatcttaattatgtcaatttatgtcctgcgggtttgcagagtgtgtgctaccataattaccactggataggtagaaaactaaactctctgacactcagagttcaaaattcatgggcagactgtggaataaaagaagtagctactttagagcctaatacgtattacttttaaaagacttattatttaatgtaaacatttacgtgattcatatacattatacttcttaaaactgacagcattgacctggaagacagagtcacatttcacatatattaagtgaacaccttgacggttagtagcttgaaatgcatcttaaaaataaaagtttttaagtataaaaatgttagagagataaaaattaggatgtaaattaaaattctttctttatatccccactaaaaatgcaaacattttttcttacttttccaataatgttttcctttattttgtgattagaaaggttttacatatatatgcttttttaaatatgaaaatcatagaataaactgatccataggattcaccgattcactttttaggagttattatttatattatatatatatgttattttagtatatataaatacattgtttatatatgtatatatgcgtgtgtatatttatgttaaaaataaaattggcatcagacttatcaacatagatttgattattttttcacatttaattataatagcaacactttttcatgtcattaaataatctacacaattatcattttaataggtgcctaaaattccctgtttgaatttcccccgtttagttcctctcctgtttaaatttacattatcagttttactgtaatagtttaaagtaaatatttatgtatatttctgattatttccagaggtaagcattctagatttggagttaatgggttacaaaatgtgactatctctaagctaatttctaaaaattaccttatattccctcaagcactgcataagtgtactggtctccccatactctaaccagcttttagtattaacatttcttgatatttgttagtttgataggtaatgactatctcatatacttgtttttgttagcaattctttgcttattaaccttaaaaacaattattttgctttcataaattgcttcttcacatcatttgctcattctgcctccccctccaaccttttctttattgggatgtatttcttttgtgcaatttaaaagtactcactgtatattaaatgaattagcttttaagatatcatatatatttcaattatcttagttcaagatgccacttattttatcatatagtttcaaatttttggataatcatatttatttcaactttcctccctaatatatttccttgtttttatgtttagaatgttcttctctaatgtaagataacagaattatttattctcatatgttttgtccatgtgccttttaattttcttttgttttcctttagcttttaaaatacatctattttagcataagaactggtcatgtaactcttcatgcatgcaagtcccttgtcatatgtattttccaagctcttctgctttgtggtagagacatagtgaccagcacaactaatcgaacatggcagcaacatgtgatctcaatgcagtgaaattaggtcatcaggagtcatctatttttacaccaaaatcttttttcttagaagcttagtatagagcactatccattcggcctgtgtctcatttcccttgttttgttcctttagtctttgtcttaaggcccagattttccttttggattttactggctgaaaagaaggctgtcatcttctcatattcagtgggctcaagatgtttgtgagaggcatgtcctgagacaaatccccaaatctgtcaatgtcactgtagcctgtgatttcctggataaaaagcagccaagaataattgaacagtgtaagctttggagaagtattccgtaatactgtttttcatcagtgatgaattcatttggacaggaagttgttttccctaaacctaaaccaattactttcataccaggaaaagcctttctagcaccagcaaaatcccacccatggaaaattcatgttcataatctccctttaaatgattgtgaaatttaaatgtaggttttctattagttcatttaaactgtcaatctaaaatactgagattatctaatttttttcttaaactaattattctttgattcagtgcacatagtattatggaaactacaagtaaaaaagaattgattatagcaaaatacagatgtaaggagataaaacactttatgaatatagcttacttgttactgccttagggctcagatcaaatttctttatctaagaaccctaaattggccaagctattccatgttcaaaatatttccttcacttaacaaatctcaagaaactgctgttttcctaccaccttattcagaataacaaaatctgacatcttcaattcactagtattatttcttttttttttcttttctttttttttttttttgggagatggagcctcactctgtggcccagactggagtgcagaggcacaatcttggctcactgcaaactctgcctccccggttcaggcaattctgctgcctcagcctcctgagtatctggaattacaggtgcatgctaccatacctggctaattttttattttcagtagagatgtggtttcatcatgttggccaggctggtctcaaactcctgacctcaagagatctgcccacctcagcctcccaaagtgctgggattacaggcgtgagccactgtgcccgccatagttcactagtattatttcaattcctacaggaattaccaggactggggcttatttcccaggggctgggttcagttgcttcactgccagggttgtagagagcatcttgtggctaggaaaagattaggtacaatcattatattataggaaatgcacaccctagatacacaaccgaaaagctgtagatacaagtgcagtgcttctagaagagagcctatcagcagaggttttcccaatgtatcttttgggaatttgtagattatactctagtttaagaactctgaattatttaaaggaccctaattcttgactgctgaaactgtggttcctctatgtgctagtaagttgtattttcaaaattcatgcatctaatccagtcttagaatagaagctgcagcaaatattaagcacttgccttaaaaagatcctaggtaaagattaatagatcaaaatgttctccaactatcatacatctggctgaagattgttcatttgtgttaatcatactaatattgtattagtgttccatctatttacatattcaaagtctttagaagaatattttagtcgcatatatttgatcaaatgaaaaatacaggaaaatatatgtgagtgcagcaaaggctgtcagagaaaatagaaattgtgaacttgtgttcatgaaccacgttgctttatcttagtaaaagcccatttttctcgaccctttccttttttcccgctatccttctcttcaataaacagacatgcctatggggaacaggaagaagggctcccaccaaatgatacatattgcagaactacagaacaactatgttaccaatatgtgtagtattactgaattagtacaatcacatttcaactttctgttgtttgtatataaaaaactttataaggtatacatacacattaaaataaatgtttatatgtaaaaataaatactttgaaaggggaaaatcaattatgctttgaagagtaatcattctatttttttatccaaaaaaacaaagtcatagtgctgactttgcattttatctttagagttacaaaagctatcttcaaaggcaagcaatttacagctcacagttaacatatactccaaggaatagatgtacagaacagcagcataataaaatccttgccctgtggcttcactgcagaattccctaaatgcaaactgcaatgattaatatagcattccttaactgattttcagaaatagtatattcccttgtcatgatatacattgtaactcctagtacttttaaataaatttgttccattggattcaagtaaatttaccttacagttaaaaagaattttactaaaatgacacatgaactatagtgtacatactataattatatggtatgttctaatactatagttatgtggtatgtcctacatactgtagttatatagtatgttctacatactatatgttgtacaagcacagctatcctgatgttgagcagttttttagaagagcctgcctcagttacactggtcacattcaatgtaatgtgaagtgccagctctcaatatgacagatcttgattttaatcatggagatacacaggattagttatgggtatatttaacatatttttatgtattttgtttaaagtcacataatcctaggatcatcagaggatatttttattatatttaagtaggaattttcaaagatttttacatccattcttcacagagtattatgccataacaaatacaaatgtttaaaacttacagtgccataacaaatacaaatgtttaaaacttacaacaccccagcaaataatgttgatttgtgtatagatacacatgccacatgcaatcttttccatttgagcataggccatggttaatacctacacaaatcagttctcaagtctattgttttaatagcacttgctatcaactgtgcagtctcacagcaaaatttattgaataaataattggaaggatatgctgtttctctcattctggcaatatcagttttcaggcaggagatagaatgtccaaacttgaggagtggcaaagaatgtgggcttgtttccagctgtcattttctaacacgttactgtgccatattgcctgtttgttatttgttgacttttaattaagttggaaaaaaggcacatgccctcagtcttttgaagttggttggatgccagggtagctttagggataaaagtccaaacttagatacaaagcacaaataatgacatatccaaaataacagtaattaaaaaaatgaatgattactatattggtactctattataaacatggatgattactatattggtattctactgtaaacatgctaagattttttaaaatgacacctatatagaaacaataatataaacttattactacatgtttactgatcagtttgggcctccacacgtgatgaacagaaagtctttaaaagttaaagatataagaaaaggaataaaaaatggcttttctaaatacaaacataaaaatttgataaatgacttaactaaatttaattaaagtatgcctcaaccacactaaatatcccccaccaaataaagaataaacttaaatttttaaggaagatttaaattaaggataaaataatattcatggttgcaaatattgtgaacattagacatggctgtgtcaaaattttcaaacacatgattctacaaaactctgacatacttttagctgtcctagaactttgtattaagcagatatcctttttagttctttttttaaggctctatagttctaggaaaatagctataaaaatataatcttaaaaatctaagattatgttttaatgaaatgactattagttgcaatgaactaataaattttttaaaattgcaattttaatagtaaccatgaaattatagagatattagaaaactattatctcatctactttggtcctcccatttttcattgaaaactgaagttcagagacagagggagggacataggaaggccaaaactttcatttcatgtttgtctgttacacaaattattgtaaaaatagcttacatgatatctgatttaatcctcctaccacttatttaaacaatattactttccatagtttaaaaatgagaaaatagaagctcagagagggtaaggtaatttattcaatgtcacacagccattggcaaaattaggaccagaatcttgtatcctctaagtccggtgttttttaataaacctagtattttaacaggaaaatgaactactactattatttccactatttgtttcatttaaaaatgttttcaggctgggcgcagtggctcacacctgtaaacctagaactttgggaggctgaggcaggcgcattgcttgagcccaggagttcaagaccggcctgggcaacatagcaagaccccatctctaagaaaatgttttcagtgtctattgacttacagtactctataaattccataactttccatgggtaatattatagagtgaataaaacaagaatggcttgttcaaactttggttctaccccaggctactgtgtgaccttagataaatcacttaggtaccctgttcctcagtttacacatccataacatggagataaaaatgccacctattttattgggtatgaagattaaatgtgattaaccatataaagtgcttagaacagtgcctaacacacagacacacactcactcatctgtacatattatgcacctgaaaatattgtcattgttcatgttgctagttctatccaatgtataataaaaattagaggaaatcttaaatagtgttaatgcagcaaagactgaagtccaaagaatagcccaaaagttttttgttttcatgtattcattacttgtatgtttactgctttctctctatgtcaagtttattagtagtatgtaaaaagggagatttagtgcatgttttcttcgtatttagtgactcaatatatcagctgttagttttttgaatacatgacaattttcatatataacatgtaaaatacagttgaaatgtagacatcttggaaaacctttcttgctttttttttaaaaaagaaaacttgatagtaatccctttaaaattatttaaaaagcacttctggataaagtatagaaatatatattttaggtgcaaaaaaataaccacagtcaaaattttatgaactctttccagaaagcacagtattgaattccagttaaatttttgtttcaaataaacattttgaaactaggccacatcctgcactatgcctgccaaaaatgaaaatttcaaaatctaaactgtgtgttctacttccgaagccacacagaaatcatcttacatttaatctagtcaacttaaaaatgactactgagactttagagaaaagatattttcaaaatataaagtaagtacaaagtaaatctgataagtcaacattaaatccgacagatgactatattgtataaaacaaaagcagctgcaatgacatagagtagtgtatgatatgaatttctacatgtgaaaactgcgatattaaacatggaaacctgcagcattttggcacctgctggaatttagtgacaagaagccagaggtattttcaagggccaagaagataatgggaaaaggctctacttaactctcctgtctatagggatgacaatgttaatgtttacataaagaactaattatagccacctgcttctcgaactgtctgacagtctagccctatgactacaacagctggaaaaatgacacctggcaaggatacagcaaccatgcgtttcactcctaatttttctacctatcataggtagcctcttatatagtcttattaatatttgtattgataaacagaactttgatcaaggcaaatagtaaataagaccaaatagtcttccctgttcataggcttctgcattaatttatgtctcaaatattcctctccttccccttctcctacttatttctgtttagagacaagatctcactctgtcacccaggctagagtacagtggcacaatcataggtcactgcagccttgaactcctggcttcaaatggtcctcctgcctcggcctcccaaagttctgggattacaggtgtgacccaccgtgttcagcctttaacatttcttcttgagttatatgaatacatttttcttttcagaaactacagtgccattactgtcttcatcacacaaatttgtatatttcccaagagcaatctctcattctaggaaacatatgtttttcaaaaaagccagaccacccttagacccaggcccctgagctaggcccaatgctgttctttctcctgtcacaactttccaaggagttaagaatccatggggcccaggatacccacccaaagctcatatccctctatatagactattctccaggtagctggaactcccaaattccctgtctaattaacctgggcattacttccaagcattttccttaggtccaccttcctaaggggaacgttcttacccatatgtgtcctcctaggcccaaaggagaccaaaggagatattttttagagatctttagtatggttggagactggtcatgcaggctcaggtgccgacatgagtgcatgggtctcctcctggtgctagatgaagccaggataggaagggaaaaggagctggccatggaccaaacttggggcaggagggtcatattccagcatgaatctaactacaaggtgtcagaaaattctaaatttgaacctagccttcctagtaattggaaagttgtatttgctaagacaagagacatatcagatataattttgcagcttgttagtttgatttataactttaaatatttaaacttacaatatccttatagtatccatttgttcttgacacagccatgcaaatgttaggggttagcgtgaaggaggccaaagggtttagctgttcaaaatgttatcattcataaagtaaatcagggaaccttgttcttccttctctgcatgtcaaaattcaactttttctctcaggtttgagtgaatatgaaaagaatagctgagtattcagacagcattggccaaattccatagtgtataattcagaaaaagagagtgatccttattaatacttactactatgagcttcacctttggaaacaaaagttcaaacagtaccctaactccactgtttactctacagtccattgcacattttcctccatgccccaagagtgctagtatgtttcttgttatatttgtagagagattaccattgtacctaggcctttagcaatgcaagttctgaacttaaatgagttccatgggacctgaagcaaattaaaaaacaaattcaatgtcaggagtaattttagactctaaacttttaagttccacataaatcacttaagtaaactgggtcagagaaaatatccttttcttgatgattgactgagctaatatatttgagagcccaaaatatcctttgttctgataagagacacatcatattcccctctagggtgctccaccctggagcaaaaatgaccttgtaaccacaacacaaaaaaaaaaaaaaaaaaaatggagccctttgcagtttatgacaaaataagaataacttaagccaccaaatcatgttgaggataaaagatttctttcctcagtcttatgcatttgactctatagaatactcgaataaatatttaagaattttacaaagttaataacctcaaagtttcctgtgtaaattctatcaatgagtatatttttaaggaagttttccgggttgataggtttttttggcaattgaaatccctatttaacagatttaaataaagacaaagtacaaataggagactgcaaatagtagcatgttagagtacaagaggatattgcagccaagataataagagacctggaaaacatttcaaataatgtaaaatatttgaagacttataatgcgggtgaagtgttaattttgcattatttcaatcataaatgtaactagagcctgagaggggcaaggtacaagaatgtagttctttcttaactatatttcaacaactagagttattgaaaatgagactactattttctaggcagtcattgcctatcagtgaaagaatagagatttggttgcattgtaaattgtcagacacatttagaaaagaatctcttcaaaggttgggaggctgaaccaggaaactttgagtttatgtcaataaacaggttctgtgattcatagctaatgagttcctgtaaaaaggcaatataatcattttttcatcttccagggtctgaattttctacttttgagttacataaggatctcctatattcgtctttatcttcccttgttcaacaaatatttattgagtgccaactatttgtaaagctctgcgtaaaaggctgtgaagaaaacagaaatgaaccttatttagactttttaataaagatgccccaaagaaagctgaaaaggaagttaaaatttaaatcagttaatgcaattttccagaagtgtctattaaaggcaggactgaggtgaggatttatgggataaaaaagtaaaatagaagtcacatgttaataccagctttctaaaatacctatggtctcctaattgtccaagtacccctcccctatgtcacagtaggaccaatgattttgaaataattttgcctcttggcttagaaagatggattattaaagaaaaacacatacattttactaataagaacagggataaaatttttctatgcgttttgtaaaatgtaataacagtgcaaaaagaacttgcttcagaatcaaaatgatgaattttacatttgtaaaaccttgacctgatattcatacccatgcctattcagaactgatgactggctagtaaagataaatcttggagtgaaactggcatctgaactgccacgttaaagaaaaccttcacatggctatttttccagatcagccacgtgattcttacaaaccctgaaagatatattatctcagctcctagccttaatcagtccctatggctcactatgaacttttccctttctagcatccagatttttgacatactaaagagtttctgatgtaaaaacaagagttccctctgaaacatataagttagcaggatcacctgaacttgttcgttctaactggtgcactgttgtgaatgtaggcaagccacttcacatttctgggctcagctttcttatctgtgtaagaggttggtatgacgaacattgctatgagcttgtattttgtgagaattttggtcagttgtaaggcctttcccaatcaaaacttagttttgttaagaaaagcaaattctgtccagacctacaaatatgaccataaatgtgtcataagatatgaacttcaaatagacctaaaatccaaacatatttcttgtgagagcaatatattctgagttagttttgaaaaaaaaaacatttgacacaatacctacaattttgggttttcatttatacatagcataaggattgtacatacaaatctgtttctatattgacatattttatattattaagcctttaaattcatatgtgccaccctaaccatagatagtagactaaaatgtacttttgtaacacttagccctcaaatgatatttgtacaattaaactttataagttttcccatgtaacttatttactttggtacagcttctctgagatagctaatattatgccccgttttaaatgctataaatagaaatagtctagcttggaaagcttgattttactacagctaaattttattactgctaaatgttttgtgtactgttagaattaagacaacagaaactattcatgtgctttctccctatttttttcataatatgttttctaaggatgatgaaattattactaggaacactctaatgagaaatattttataattaatttcatttgtaatctgccttataaaatatattttaagaagtaatatatcaatataacatcactaaaatataggaaactaatattgaacagaaatcattgaaatcaaagttagcaaaaaatgtctagagttgggtctttggagggttacccagcacaaatggtaattacatgggtaaggagatactataggacaaaagaaaaaaaagagaagcaggaaaaaactatggcctattgtttccataagtgagggattaaataaatgtctaaatggaaatgtgtatattgaaaagaattaataaatgaaagtgcaatatgtgcatcaaaagtatgaaactagttagaaaatttagttaagtaacatttaactcagagaggcaagtagaaaccaggaacaagttaaatggaaatctgtggaagattttggatggcgtgatttagtctgggttaaaaaaagagatgggggggtcagtatttccttcaaattctacatttaaaacccataggttattcatataagggtttaagatgatactgcctcatttaaaaagtaaagatacatcagtgaattctaaagatgtgaattctaagataaattcaaatcaatgccttgaacattatccagataaaaatggaacaattaataaagtacagtaaccaaggtttaacatgcacagaaattgtatatcattctaaataggtcttgcctcatagatggaacttgatttatttcagacataaatccaaaataaccctctacagaaatataggctgacaagtattcagacacaagttttagtgtagcttatacaacattttttcacagatacctgaggggaaaaaataaattcattagatatactaagagaaaaaattaaaacaattattcctgcaaagcagcacaactaggaacttaatagaggggccaaagaattaaaaaaattttttttcagagaatgtcagtaatcaaaatatcttttttaaaatgttttgtctgtctctctctctccctcttatttttttaagatggtgtctcacaatgttgcccaggctggtcttgaactcctggcctcaagccactctcctgcctcagcctctcgagtagctgtgattacagacaagcacaagccactgtgcctggcttaaaataccttttttgacttaacatttttctttctgttttttttttcgtttcctttcttttcttctcattacattaaagtgattgctacaacaaatattctatttactgagaactgaacggttattaaaccaaagattgctatacgtacatgagcttggggacatgaataaagtagattatttcagtataattttaacaaagagttaagcaaaacactttcataatgagtcctaaggcaagtggcaaaaagggttatatgtcacaatagatctctcccattatgtctaatataggatggagtcatcagatacgaggttattttagtttttacaactgagatagcaaggaaagtagaaagtttactagcattatcacttgcctatatgtcctaggtcaatttaatcattaattaaatttagtattttttcttatgaaaacaaaggataacatttccaataaaattctgctaaaagttgaatcaattttagctgtttgacatatgttagacatggccaaatataaaatacatactttctttttgtaatatttgatgggaagaatagaaatcacaatttttcaaaggaagtacaaataaatagaaacacatataggaattcaggagttattatattatcaaaataatattaaagtgttaattttctactactactactactagctctatgtaatgcttactctgtacaggcgacattctaagtgttttccatagtttttccagagtgttttccaccaattttgatgaaatttagtgttcatttaaattagaatgtatttatacttagtgaaagctgaaaatctggtaaggctaaattatagaagctatgattttcagaatctgaatcctaattatttttgaatccggggctatgtttggcaggtgagggataatttaggagtgggaagaaattgaaaagataaaaggtaaaatgggcatttatatccatccaacagtgtgtttcacattatgtgtacattgtggatgcttaatccacacaaatattgagaagccacatggtgtttcactgccaaagaattctctctcttgagtaaagaatgacatgggtggaagtacataaggaacagggatgccaaggaggagagccacctgctcaacagttggcatgactaatctcaatgatttgtcatgaaaacctgtgtaaaggaaacaattaattgactagctttctataaaagcaaaaaaaagatatttagtattacctcatatgcccactcaaataggtttatttgtcagtttcataggagttccatcagtatattttattctgtaaaaaaattactttccaacttaactactatagtgattgccaaaagtaaaatttttgaatgcagatatcaaggtgttgaaaggaaaaaaatggatatggtatttacataaactatattttgaatttggctatattttcagttttgttcaaaatgatttttatctgaatatattagctgcctactacttatatacattcaggtatattctgatggaatcagctcatataattagtagttaactcattaataacattcagcacagacttagctgctaggcatcctagcctgtagcgaggtgaggggaaagtactgagtctcattctatgccttagagaaatattgcattcggcccactaatcacacacactccagcatgaagttttcagcagggatgcaatgatatcctcaaccacctgtcatcaagtggcagtaacagcttttcatcttaaccttcttgagctttgtggtaggcagaataatggctcccaaagacgtctaggtcttaatctccaaaatttgtgaacgtaattagggtacaaagaagaattaaggttgctaatcagctgacctttaaatagggagattaccctagctacacaggtgagcccaatttaatcacaagggtctttgaaaatggaagagagactgaagagagagtctgaaacatggcaatgtgaaaacaacgacaacaataaaaacttgtcctgatgttgctggtttggacaatggtggaagggggcatgagccaaggcaaacaggtgttctccagaagctggaaaggcaaggaaactgattctcctctggagctttcacaaagctacatggccctgtcaacaccttgattttagcccagtgagagagagttcagacttctgatttccagaactataagataataagtttgccttgttttacacctctaagtctgtggtaatttgttacagcagcattacaaagttaacacaacctcctgttccatgaatagtaggtaggaaaataacacccctttctttaaagggaacaatagaatcgtgattgaagtcttttattcccataaccatttttagctcttcaactgaaaatacataaatggtgtataaatacctattgacatgaaaggaaaaattgaatactatatattcaattgaatactgaaattcaattgaaattcaattgaaaaattgaatactatatattcaatttttgacatgaaaggaaaaattgaatactatatatgtttatactttcagttaatcagggtcatttaaaattaaaagtaagcataaacatttacttttaaaataaaagatttcatcactttttcattctggaaagttgttttatttcctaaactaccaatctacacacctggcaaacactacttagaaaaaagctcactcatttcataaattagccctgtattttttcttacctcactgaaatattaacagttataagaaaatacagacttgtgatcaccatttttcactcaaatgagttaaaaaagcaccctaagttgatgttgtacagtagtatttccaagggtcgtatggagcaatttcactgcaatgtaaatatataagtatttaaaattagaaatacagcttgagagctggagagctcctgttttctacaacagaattgaaagagctatcattaagtgtaaaatctgcattactgtcctgatgctgcagaaatgtagggctatattttgctgtgatgctaggtcccattgtgtcgtggctaagctcccacacaagcttgtccccaagcatcacagcagagacaagagctcatttttgttgtccttcacctttctcaggttgttcttcctccttgaagctccctttctttgtcctctctttgtactcttgacagagggctgatcctgaacaaggtgtggcatagaggaaagactagtggtgagagtcaagagatacggtactggtttgttttggatttgtaacacaataatttcacatttgtgtacaacactttaccactccaggactcagcctcctcatctgtatgttgaaaacaatgggttcagtgtttcagaatctgaaatgctatgattttctgagctctaagatacgtatccagtttacccttcaggtgtgtggccctaagggaacagccaaaattaaaagcttatgtcactgctactttagacatgttcacatcttatcaaatgccttttgagggagaaaatatcctcaaatcttctaatgaattaatgaatctctaataaaagaatgtcagaatacagtgtaagatttttggtgttttctctctgaagccaccacttggaaaataagcatagtgctgcctattgtcaatgctcatgaacaactcggaagacaaagcaatttcactattgaacaatccgatctttcatgctcatgcaaaggatgaatatggataaggacagttgagtttacatttaaaaatattttacagacagcttagatgttatattgcagctttgatcttatgaggccaataatgtacatccccacacaaataaatccagttcctcagtaattcctacttcctattctatcctttaaataaagagggagatttttctatatgctcactagcaagtgcaatggaaagtcctgcccactcatataaaagtggcaggaattttgatagccaagccaagaagcactgtgaatcagaagactttactgattcatctgagccccttttcaccccaccaaaactatcacagaaaacagaaccatacagtgctgagttctgctagtggcacaaacaccccttttaacagctgaactgactgctggggacccaccactcctttaattatacctcagaagtgcacataatgagaaaagagccaactgcactgcctgagcccctaatgtgggctggctcaggaccaggtcctttgtgtctgttatttcttctttcatcctctctcaaagtggtgctggtctataagtttccctgcttctgctttctttcttattcctttttatataaatttcttcctacctgccctaccgttcctcagctaacatctctttgccaattttctccatgttgaaacacttacccttcaacatctattctgttcaatatttgaaatactccgggtctgcatctataccactcctttgtccattattcatctgtttattccatttgctgatctctgatgtttttgccattggtgatacaaaggctataaaatatatggcttataatcaaggaaacccagggagagaaatcctgtgtgagaatgcattatgatagaacaagtaaagtattccaggacatcagaggagagaatggctatcactactccaacagttggcaaaggcattggtaggatactacatgatacactgccttaaataatttatggtacaaatttcaaataaacaatcaccgtgtcttaaaggtcattatatcttctgtatgatgccttgcaaataatgaataaattgtaggcattcaataaacacacatatttcactgatggatcatgttcttatggcagaggtacaggctggctttggttgcacttgaccttcctctctcaagttgtcctttcttctttgatctctcttttttcttcaagtacctattttgtttttactgcttggcagagggttcatctctactaaggtgggttataaagacagtaactggtgaattccatttatttagttcagactgtacacaatttggtcaaagttagagttcataaatgtgacccgtgctggtgtcagttttacagtcatacatgatcagaggtggcatttctgaaaccttccagccattttgcaaatggatctatttgtttaaaaatattccagatggcagaatatgacaatctcaggttcatatttggtgccttatcattaagtaagtacaaaaaactctatctcctcagtcccataagtgaaatagttccttaatatttacctctttgggcatttatttatatataaatgtatctgttgaacatttactaccttgacaagagttgtggggaatacaaaactgaagagtgtccttccctttgttgggaaaacctgtttctcctctttacgtctttccatgagatagcccatcctgcttacttctgtaatatttccaatctaatttttagtagtgtaattattttgagattcatctcctttagtaaactgccagttccttgaagggagggactatactacattaacttctctccaaagcctggattttacagttgaggaaatagatccagtaagtttaaatgatgtggccaagatttcaaggacatgggctgtgtcttttcctttttataagccccagatgtggagaacaatagtaaacacatctgctaagaataggatcagagaatatgaatccagttttgctcattactcacctctagcctacataagaaaaagctatgaattcatgagatgtgaaaaaatggtagtgagtttctagttagatagtttctgaagtgctgtgtcattcttctttcttcaccctagtcaaagttttcttcctgaattcaggctaattgtatgtctcttagagttgagggaggctgtactcctatgaagccctctctgtgagactggctggaaatagcacagtcttgagaccggtctatattgggaatggcttgcacttccactgatggacccatcaagcaggtatgcgttttctcattggcctggtggatttctgaaaagaagtgttcttgagagttcaaaggcactccttcccagatagctgccttagaatgataagaaagtcccaacagaaagtatttctgggaagacaagggctgagaggaaactgtaagttcccaggcaaagacctacagttggaagtttccaatggtgaaaaatcacagaaaatccctcaaaagggcttcaggagagaaatagcaaggactttggcatctgaaacagagaagatggacaccagattaaacagtaccagatacacaaaagcattctatttataaaatggttctatctatattatttcttgtttcctccctcaccattgggtctgaatctggaagatccagaagtagcagctagtttgtaagagagagatggttgagaaaaaaagaataaacttgctggtctcttccacagtacaggacagaactggcctgggtcggggaatagcaggaggtactggaagggtaaaaccttaaaacttagtaagaaaataaattgtatattagactagattagactattcgacagcaagaaaaaagagtctatttgctaatacctaataatgagtagaaaactaggaggaaaactaaactgtatggaagaatgagtccatagagcttgcttcaaggggtaacaatgagaaagaatcaagttgctaagtgtttatatcctactgagcctaatttgttcaataactggttacatcaccaatattacacgccaaattttctgactcaaagcccactgtctactgcattcccaggtaaataaaactagaaatattaatctgttctaaaagtgagggagggtaaaagagatgttaggaacatatacaaatgcaatttctgacttgttttcatcttgattcatgaggaaggagggagagaaggtaggaaagaaaggagagaagaggagagagagagaaggaaggggggaagaaaggaaaaaacatttacaaaacatctttaagataatcagggaaatttgaatatggaccaaggatgtgaaattaagaaattactagtaatttttaggtgataatgacaagcttatgttaaaaatgcacttctatgtgagtgctgtgtaccgaaatatatatggggaaatgatatgatgtctgagatttgctttaaagtactctagagatcagagaaaatgtggtgaagacagataaaataaattggaaaaatacagataattgttgaaagtaggacacagggtacacagaggtccattgtttcttttttcttttcttttctttttctttttctttttttttttttgaggtggagtcttgctctgttatccaggcttccaggctggagtgcagtggcgcaatctcagctcactgcaacctccacctcctatgttcaagcgattatcctgccttagcctcccaagtagctgggactacaggcacccgccaccatgcctgaaaaatttttgtattttagtagagacggagtttcaccgtattggctaggctggtctcttactccggatcttgtgatctgcccacctcagcctcccaaagtgctggaattacaggcatgagccaccatgcccggcctgttctttctacttgtgcatgtgattaaatgttctataataaaaaagttaaaaatgaataaagaaaattcacaggcctatatgttttatttatctaactatacctcctctacaatgtctgacttgcacaaataaggcagcttcccttgaagatcacttctgtataaacacattatatctaattggttgcattacaatccctttatgttttagagcatggcttgaagtctaatactgatagaattgattcaaaacctattctctatattgagaaaaccagagctctcctccattgataacataatagagagctgaatgttcctaggtatcttctaatataatggttaaggctctgtttaccaaggttttgggtacttatctttgcattcatatcttgaatatcatatctctgatgacagcatcagaatttatcagtcagaggaagctgtgaagaccaaagttccttgggaaactgccttcacaaggaaatctggaaatagggaccgatcacttttcaaacacatctatgtaggcgttatctatgttatcttagactgaactaattcagattattcccaaaagatacagtaacatatttgctggcaattataacatgcagagatttcacattttaattcctgtgatcctggagtaggtgctgcttaaataatattgtccaggctgcagttgtgacatagttgaatatgtccacatatgcacaaaaaaaaaaaataacttacagactggaggttagtaatttggaagaaagttctaaaaacaatgaagttctttttttaataaaataaatgcttcttcaccacattcttgatgtagaaacaaagagaaaacaacaactacccccccaaatgacagatatcaaaaattctaggtagcaaagttacttagaaaagtcataatctcaatgtaaagcaatctgaggatattccaatcaatttacctcacatatttttttcatgtgtacaggcattaaatattataaaattcacccaaatttatacaaaatctattttcagtaagtaccagatgcaaattctaagtaataagaaattaatcgtgtcatatttaattggtgccattgtttttctttcttagtaatagaaaaaaataatggtgcaccttaaatcaatgaaacacagtatctgaaaatgaaataaagtttgtaaagccttagcaactttatgtaggttagataataagatattaagggaaattacagatgatgaatacatgtcctcaatgctacaagctttcttcagaggaacagtcatggttttacatcattagtctctaaaactggagacaaactaataatgttggtagctcactgagcagttcaacggggataactctggatgtttacatatacttgctctaaaaatattccttcctattctcaagattaggaaaactggataaatccaagtgatcaacagcgccacaatcaatttagacaggaagatagatttcagatcattacgatgaaagaccaatgtatgaaattgtttaacatgaaagctgtggttgctgccatcttagaacacaggactttagttaccatttaccatttgccatgctctggaattggtctttctacagggaagaaggctgactagaacaatgacccactgaaccccatttaactttatgcttctatgtttctaaataaaatcccctgaacctgcaactgataaatatttaaagataaattatataattagacacttacctctaggtttattagccccaacaatgaaaaaaaaagcaagttccaatacacatacacacacacacacacacacacacacacacacacacacgcacacacacacacacacatttgtcagatagtcataaaaagaatttacaagctcatacattttattttgttttaacttttatctaaaattaaagaaaaattaattaacaatgctaccccaatgccattcctagacagatacataatcaagcttcccccagaaactcacttttaggtaaacctattactttatttctaatttattttacttaatactgaccattctcctttagttgtcaatgacttatgataatttttaaaatattaaaatgaataacaataattcaatttcctttactaaacatctcttgttttctcctttgtatatttcagtaaagattatccttcatggaggaaaatgaatactgagatgcctagaatacccagttcttgacatgatcactatcacacttaaccaacaaccgatatgaaagctgtggttgctgccatcatagaatgcaggacaacagttaccatttaccaatactattttaagaacataagggaaaaggtcgattacaaaatgaaagacagtaagaaaaaggaaaatgtgagaaagagaggaaagggaatggagagaggacatatgcttttcctttatttccctagaagtacttaagtagggacaaaatgtgagaatgtggtaactttagctttgaatcttccaaattaacccatagctgttttggctcaaatgacaacagacatctttctggcatgtccacaaatcagctttgtttatgcatctatgatttatccaatatataaagaggaaaccattgacaagacagtaagattatacaaactatgtattaaaagccaacatattaccctattcccattaagcatggtattccttgttaaacaaaaatttatctaatgttataaatatttatctgatattgaagtagcaaatgcaaaactttaaatagactatttgattattatgctggaaaactgatgacataaaacataaatttaagcaaaagactctaaataattcctagtactctttggtagcatgggaaatacattattttcccccttgaataaaatgtccacctacatatacctacaggtttactgcaagaagttaatcagcagcccatattggcccacaagggcatattattggttacatcaatgcacagtgggatgtctcactagaactaaatataagacagctttgatttctttgctgaggaccatctaacctaattttagatagcctggatctttctctgagtagaaaccatgctctgttctgattctattgtcctggaaagcagagtaaaatatgcatcaactgacctttcaacaactgcattatgaaataatacaaagggggaataggttgcacatgttcacacacaaacatgcaactgtctctacctttttccagaaaattaagtttaaagttctataaaactagatggatattgctgaacaaatataacacatgacattaaaatcagcctgttacaaaacttagaaactactcaaagtgatgcccccaattcaccacatatattcagcttattatacaaccccgcaggagttctgcttgccttcctaaccatactaattcttaagtgtattttgtttcaacctcacttttctcaatgtcaacattattcatctcttctgtgatcaatgtgaaagttaaaaaaacaaataaagcactgagcatttcagaccaggcaattaaacatgtggtttctctaggcacatattacagcatcagcatttgcagctcaagaagccactgatgagtcaggctaaaataaagtcttcaacggagctgacactttattttgcatctacgccaccaagattacatcatcatggtgaaattcatggtccactaatatttagttaagaactccaaagttcaggcatttttattcaaaccataaaaatccagaggatgccagcctttactctgacatcatatgaacttggacatttctgttgcactatttctttttacagcattaaattcacagtaacgttaatgtgaatctgtgaaaactcaatgccatgacttcaagttatgagaaagcttctaaataaatgaagggatgttttgtttatcattcataatctcaagagtggctgtgtgaagtatttaataaagtcaaatataatatgcacaaaatccaataaaattaaaacaaagaacaaaatgtaacaacaccagatagaacaacaaaaatattcctttgggtaccgtggactgtgttagcactttgagaaatacaaaagaagtaaatgtcacaatgctattacaataaatctgtttgacattattactgtaatcacagctgatttgcaggcaaatgactatctgttttgtttacctatatattcttaccatgttgcttggcttatagttaagtacccaataaatatttattaattgaatccattgtgttattggtctttacaatgagcttttagtgttactgctattattaatattactcacattttattatcattttactatttattattatcattagccttccacaaataagacattagggtgtgacagaatgcccaaactcttgcttctaaagtagtaatagcatgacagttctatcttgcattgttcttaaaatatttttattaataaaataatgaaggaattaaacttacaaaaggtactgcttaatgtatctgacaggagcatttattttattatcagcagtgtcatactgctccttttctgcctatcacattgtctacttttataagtggccctatctcattgcaatacagctaccttcactaacctggtgggctatcatctgaagaatatgatataaaagaaagttacagccattactctgaaaagaatatccttggagacattcacaacacagactgcaacatttatgtagttttaatggctatacacttgagtgcccgaagataaaactaacaactgttttcacatctaatcagtatgcatatgtcatttataaattttcaatatgctgatttatcatttctagtctctataccagggtcctcatattcttgtatttctttttatctgaactcatgcagctttcactgagattcaaacaaaggaggatgtttcattgttctaaggcctggtccatttgtttcattgcaatacgcaagccagctgtgctcaaatgcagcatctgaagaatgatattgaaataaagtaggcagcctggcaggaccaatcacactaaagaaaatgactttggtcaattctgaaatggtaacacaaccatagtattagtcgcctatggtatgctcataaattctacatgaccttttaggaaatagagtggagttatttaaacctatattctatacttctagctccactctgtcaagcaaattagctctttcctgtctttgcctaaatcatttttcctgtacttagcagggcaggatttttgtttgtttgttttatttgggtgtcctaatccaaatgcaaatcatgagatattatttgaattaatcatatatatgtcacatatatttagctacagaatactttatattttattttcccccaaaatccaggtactttatgaaatttaattataatatcaaacaatatatcagaaaaaaatgtaaaatgtcagaaatatacattttccccttgcaattaaaaaagtgataaactaaagctgtcctaagcattccacactgacaaaaaataaaattcagtcagatttatggcttcatgcaatttcaaacagtaaggtatatatcaataaacttgcattttttgtttggtattttttttgtggtttgtttttcacttgcttgattttatttaggaaggtttttctactaacaattttgttcaagggaataaagccaggttcccagtgtgcaaaaacacagcccgactctgggaaggttcagtcagaaaccaaacttggaactatccaatggcaataaatatagaatgccaaggtagatagacaaacctgtataatgctgaaacaaaaggaagggggttcttggcactcaaaatgattttctctcataccagagccaatgtcttatacatcattgaagctttctaaatttgagcaaccataaatggtgaaaaacaaactcatgaaacataagaattaaaaaagaaaaagaaatacaggtagataaattcacaagattgcgttacatggctgcccaattaaattattgccataatttgtatgtcgtgtaataaccataatgtcttctaacattatagcactctcctagaaccaacataaaaaggtaaaaataaatatacgtattggtactttttagtcagtctctttagaagtattttgaaatcgttgtacacatcatcaataaaaactatatttattatttgtaaacagattatcattttaatcttcaacaccactaggaattagacattaacatctctgttttagagataaagacacagatactgagaaacagtcagcaatttgccccagatccaaaatcatctgatttcaaagttctcttttcatttaatattaattgtgatgaaatacatattatacatttcacctaattaggaataattcaaagatgtaatactaaatatctactcaatatccagccctctactactatgtcctagattggggatataaattaagtatggacataatctaagaatagtttttgtgaggagacgagtctttcaataaataattaaaaaattattttaaaatatttaaaatgatttagatacgaagtatatgtattatgcaggttatgccatttctttcaatatctgttttgaagatatctgatgtttgaagatggcagagcagagaaactgaatgaagacatatttttagtcattcaatcaaccaatcttggagtctgtcctatctttagatttcctgttatgtaaaatcataaatatccttatggtttatgcctacttgatttggctttcagtaacttgagcctgaaaatgttacaactaatgcatattattatataaaagtgcagagaatttagcaacatctaggaagagttaggaggaaggtgaagtgtttatttggttcatgtaactttcaccatgtatgtttatttaactatgtatatatattcctataaaccattgttccaggcattgggaatgccaatatgaaacactgcctttcctcaaggcttagcacatcagagaaaacaaattaatcacagaatgttagaagtcacatcatccagtgatgtgatttttcacacaaataatctgaggccatatagctagtgtccatgtgcagtagaaacttagactttcatatgctaaacaagaaataatatttcactaaacataatgccttcagattcacccatgttgttgcaaatggcagatttttcttttctttttttttttaatttgatgcctaatagtatggtaagtgaaataagccaggcacagatcaatactgcatgatcttattcatatgtaaaatctaaaaaagttattttcatagaagcagagagtagaatggtggttgtgagaggctggtggttagtgggaaggggaggttgggaagatggtctaaagatacatatttaaagttagaaaatgttcaagagatctattttacagcatggtgactataggtattgacaatatattatatgatcaaaaaatgcacagacagtgcatgttaagtgcttttgccacaaaaaaatgatatctatgtgaggtaatgcatttgttaattggctggattatccattccacaatgtatgtatacttcaaaacatcatattgtacataattacataaattttttgtccatttaaaaaataagtttcaaaaaaagaaataatatactaaagactatataaagtcacatagtctatattcactcagaagggaattttaaaataatatttcaatatttgagttggatcaggcaaatcattttattcctcatgtcacagtctgaatatcatgtaatgaaattaattatattatacctgtatatttatttccattcacattcatgccttctagagtttttaattttttaagcctccaaaaataaagccatatttaactaggtacactattgcgactaagttctggtcaataggatgtaaacataagtcttgtggccttttctgggagctttcactaaaagatagtctggagtttaagaccagcctggccaagatggtgaaactccatctctactaaaaatagaaaaaaaattagctgggagtggtggtgggtgtctgtaatcccagctgcttgggagggctaagtcatgagaattgcttgaacccaggcatcggaggttgcagtgagccgagattgcaccaatgcactccagcctgggcgacagagcgagactccgtctcagaaaaaaaaaaaaaaaagtctgatgttccccctctttctctcatccttcctgctatttcaaatgtgcatataatggctcagccattgggattaagatcatccatgaggacggaagaaccaaaattagtagtattctgacttctacgtaactgttgaactaccacaccagtcctggaccacctgtgtgcaagagaaatcagcttcttttataagtcaatatatttgggggttctctagtacttccaggcaattagaatactaacatcctaaagctaacaaattatatattagtttagtcagaactgttttgcagaaaataagggttttatatatatatatatatatatgtatatatatgtatatatacgttttgattacataactaccattgtctgagtctcagttctgtaactgagttctcagttatgtgactgaaaattaacctgataatatttattatagtcttgttatatctgcttaacatcgtgtttacgagtgacacatacagacaaaatagagagagagagggttgggggatggaggaaaagagggggagaaagacaaagaagcccttggataaaggcttcaatgactatttgcctctctgcactatgaagcattgtgcagattgtttaacgacaacaaaaagctgcaccaggaaaactcagtgtttgaacttgaataaaaggcaccacataatttttaaaaaagaatcttttcaaagaaatacacaaatgattgttcaatctattgcgttgaacagaatctaatcggatggtcttcgaaacattatacgtatttgtcttgatcccaaactgagaatgtattcatggactcataagaaacaatgttttagattttagtgtggagctgtctgtaatactcctgttagttatactctaaacctaaccacaatctcagaatgtcaagctgggaattattagattaattgagcattcagacaatttggttgactgaacactttccaaagatgaatgcatagatcattagatcagaaacatgctcttgactaaatcacattctcctccctatcttccttctctccttcctcttcctttctccttctcctacttgttttctttcgcggcattttcatcaaagaacttctcagatctgcatacagacatataaaaaattgtcattgtaatatattacactatgccaatctaaaggtaaaaatgattttctgcatctctaatagaaattatgaaattaagaaatttctcattttctcacagcttctgacttatcttctctcctgaggagttaaagcgaagatattggttatttatatgttgaggtgtactgatttgggtaagttactacatatataactagaatcatcaaagaacattgggcatttatatcctatctctacaaatatgtcaaattaatcagggatgcacaatgtcagagatgaactttttacactttagttttgaagccagttccccttaaaatttgctctttgcaaagaaattacttttgcactacagattcaaatatcaggagtttacatgagtgatatcttgagctgcaaatgtagtaaatctattctgtaccttgatttgaactgccttcctacctttgcccctattcaaatgacataattgtacttttgaaaattagggcacttcaacctgtatgcctggatggttctgcagttagttttagtcctaaaaaaggaaaaaaaatctttacttccaccaactttactattgtctgattgcagggctttattacaaagcactaaactataaaatattgttatgatttgaagttggatataaatgtattgtacgtaatctagactttaactggcagtttttggacacaaactttcatttacaccttgaaacaagtatattcttcattcaataaatatttaccgagtacttactctgtgaagttagtaaggaaagggactaagaagatatagaagcttgaatatctaaacttgaagattctatggaacagtagataagatgcaggacttaaaacctagatgatgggttgataggtgcagcaaatcaccatggcacatgtatacatatgtaacaaacccacacattctgcacatgtatctcagaacttaaagtaaaattaaaaaattaattaaattattttttaaaaaagatgccatctatcgaaatgatttttcaaggtgtcatgcaataagtgatctaaaacagacaaataaaagaatgtagatatcacttctaatagagcaatcaagggatgatatgagaaggagatggcattagagtccagcagaattttcagcaggcaaaactcagacaatattcttggttgaggaagggagagaaggatagagataaaatccatgttgtccagcatagctaagatccaatgcatatgtaggaaaatggcatcaaatacacgtagaaagttgtgctgcggttttattatagcaaattcttaatgtcaggctaaatatttagaggttgtgcagtacggaaaaaaagtagaaacagatgtatcatgctgagtgccattttaggcaggtgaatttggtagtcacttgctggatggattgggcaagggaaagactgtcagcaggaaaactgttagaagctatggtattaatacaggtagggcaaatgaagggacacatatacagtgctaacagatgaaagggaaaaacaagaattattaccaagacctaacagaattaagcagattaaggagtcagaagaaaagagaagagacagcatgaatttccaaatttttagtgtattgaactagaaaactatggggtccctaaaagaaactgggaaatcaaaaggtagagcttactaaagtgacaagtaagttgacttttagatttttaaaggaagaagtagggcatacatgtggaaatgtccagagaacagctggaaaccatgactagtgcaagagaggactggatgaaaacttggctgttgtcagattagaagttgggtctgaacatataagactgtgtaaatctattaacaacaagcagagaagtattgctttataaataataaatattgtcttcagagaaaaataggatcatttgcatatctttagagacaaagctgaggttaaaatgaagcagtaattctacaagccattccagcttaaaggaactttaactctgttacagtcccataacaataacttgtaccttcatgaccactgttgagaatgactgtcttgccatgctgatatttattttgtaggatcaaatgctttggactatgattattcattaataggcttttctgtctttatagttggaaaggttaatacagaacaaaaataaggaatgtctacatttgtgatgaaatgtaaaaatattttaatttcaaaaattattataatcatcaccattatatgttttctgatgatatagtaacaatcaggagagtcttcagcaaatggatgctaataaaaatgatagcaggcaactataaatacatctatattgcctttccttatcagattatattggatgacaaatcgcctgagttaataccctactgaaaatgtataattgttcattgttctcatttgctgaagctattcctttggaaggcttttatttctaagaacacaaaaacatttatctgtctgttttccaataggtaatttttttagatagcactttggatttgttttatataaaactcttttaaatataccttgattatcaagtataaaaacaatgatataagtagactatatgttgatatataacagaaacagcctgtatataacttctatatactctagaagtatatatatatccctgaaaccaagcccatatctataatgcttcataaattaaggatgtatttttccattcacaaaagtacttctccaccttttattaaaagtaaaatattcaacagaacagcttttgatcttttccatttatttgaataaaatcaaattgttttaacatataataaatcttgaacaaaaatattaaactataaaccttattgacaagtcaataaatgaaaaagcaatttttaatttctacttttttttttgttttttgagacagagtctcactctgtcacccaggctggagtgcagtggcctgttctcaggtcactgcaacctctgcctctcaggttcaagcaattttcatacctcagcctcccaagtagctgggatttcaggcgtgtgccaccaagcccagctaatttttttgtatttttagtagagacggggtttcaccatgttggccaggctggtctcgaactcctggcctcaagtgatccgcctgctgtagcctcaccaaatgctcggattataggcatgagctaccgcatccagccaattctattatatttcttaataaaatgtataaaaagttgttttaaaaattgatctttcctactttcaatagagttttgtgttattttgttttagaaggaagcaaaaaaggtaaaaataattggaaaaagtcttttgcataaggttattcaagaatcttctatttttcagacatattaaaactgactcttttctaataaaaataatatgattatctcattgaatataaagtcagaagtctaccaaatgattaagaggattgaggagttgactttacaagttatagtcaagttaactttttataataggagttataacttaaaattccagtcacttaaaagctttaaaaaaataagatggtgctaatcgatgaaaaatgttcccatcaatgactactattcagaaaattagaaaaatatgccttgtatttaagctaatggattcaaaatggaagaaaataatattctaaagaggaatgcatgatgtatttattgcaaagaatacatatgcaattgacataaattagtatttgctaaataggaaatatccagattttattttttaaatattctataaaattttaaaaatctatgtcaacaactcaatctcctgtatttagttatttctttactttattgtgataaaataaggctttgcaggatttttagttacccttcacaattatagctacatggggaaaaaatgacaaaagaggcaacttcacaaagtcagcatataatttaatgcctttattccctgatttccactccttctgaatcctcaaatttacataaaaacttcagagaaaatttattcaaatgagttaagttcttatcaagtcctttgtgtacttagtaatagagaaaaaactgtcttctgccataaagctactaaagaaacatggagaaacaaagcaaagtgtatgtgtttcttgactccttctcaattgccagttccacaacctccacattcacagttgtctgggagcaccaagcacggattacacaaaaattacctaatcatctccaaaaccaccgcagatatgtaaccagccatctaactataaacactgctggtattgtgacatatatgtgcttataacctctactttttcatatattacatgtgcatagaatatcacagaactcaccaaatatatctccatagcttctctaacagatgaggacaatggcctaatctatcagagccaatgaaaaacatcttacttccaaactatgccatagtgttaaactgtggcttgaatacacttgggttttcgtctgcaatgccaaagaagaccaaaatcaatatcaaattgctaacttcaagtattaaaagatgccttctgcagttaaataaagaccgataagcttgaatgttagcttgagggaataacctattcttttctttccctttctatatttgcttttgccaaacttcactcaggctggaaataatcataataattggaaccagcagaaagaaatagctgatgctgctaggcaagatgaaataaatctgcaactcaagtaatactaaatataagctccacatgagcatactagaatgaaacacctgagataagacagctctttggagccaaatccctaagtttacattttgcaagtagatattctagaaatgcaatatttataatctacctggatgccattgagtgtaaacaaatagcagatttatatcaaccatagcaggaagactaacaatttcctaggggaaagaaagaagagaaaaaatttgatttctgagaaaaatgttcatttaaagtgataatataataaacttttaagttctcaaaataatatttgttctaaaaattcaaaaagcacagaaacattgttaggggaatttttaaatctttgctatttatagtattttatattccttgtattttaacgtagtcctaatatagtatttttatggttgtcaatggtgtacatgacacaatactgaaattcagaataaaaatattataattcttctaaatgtttatgatttcagcatgaaaatgagcaattagtcttgaaacatttgaatctttctaagatgggaagaaggagaagaaatgaatttcatttctatcagaaaatttgaagctttgaaaacggaaactgaaccaggaatatgacatatttgggtactataactgtctgtgttgcagtttgtggtacctatctagggaattggttcattaatcctctagactctgcactattctgttttagcaatatagcaaagtggttaagggtgtagacttttaagtcaggcagccacttagtactgagtgacctcaagaaatctgtgtgaccttgggcaagtaatgaacctctctctccataagcttcctcatgtttaactaatatgattttaaaaatgctttactcatagagttaatgtgagccttaaatgagcataattccatgtgaaatggtacttttcctgttttcctggaatgtagctaaggcttcaaagctgaggacagtggaaaacaagcaagttactaatcatatccctggtcaaaccagttcaaaaaccatcactctcatcagcctagatagaaagactaaatatttgaaaagagattctatgaaaaagatgctttaaaaataattttaatagacaatggagtctcatctcacttttcctcttagaggagagggatgtgttgcatgcacagaagtggtcatttaaaaaggatcactcccacactagctgtttgttgaattattgaaaaagtataggtgtcccatgatgatacccacaagcaaagtgtgagagagttcttgtagaatatgacagctttttccatgagcctgaggaatgttcataagaatggggatttatgcctacttcttggcagaagaattctgaaggtgggaacctgagtggagctgctcataatatttgggaaagaagtgagatggctgcatttccactacatggtaggtcagggatgcctgaggttttccttgcttttcagaaaaaacaagtacaagttctcttgaagggatgctgcccaggagggctgcctgttgggttaaggggacagcctcagaaagaccctggaggtataatgcagtgggaaggagctgaattataagtggtcaggtttagtctattcccctgtcagaaaatgctgcaataggcagagtgaggtgtgcgatggtgatgataaaggtggagtgtctttgaagaacatacaaatatcattcataacagaaaagcagcatctggatgcctgacataacaaaggacacacatggggagattaaggagaaatggaggaagaagcttttgcttctttattcttgttcctcctcattccttgccctgatctcaagaggagacagaagaaggtgaggttgggaggagctagagcaaatggcaaagaaacagaccacactaacctcccttttcactggtttccagagttcaaaagatgagagaacctttaaattggatgcaaggttaaagtttgtcttcggaacagactacatttttgtttcatacctaaaattgagactattccgatacatgaaagaaacaaatagttatgaggtgggctagcgatgctgtctagaggtagggcaatggggtctgacagggtacactttaaggcaggagtaggtgagagaaaaataattgttttggccaggcgcggtggctcaggcctgtaatcccagcactttgggaggccgaggcggatggatcatgaggtcaggagatcgagatcatcctggctaacacggtgaaacccctgtctctactaaaaaatacaaaaaattagccgggcgtggtggcaggcgcctgtagtcccagctactcgggaggctgaggcaggagaatggcgtgcacccgggaggcggagcttgcactgaggcgagatagcgccactgcactccagcctgggcgacagagcaagactctgtctcaaaaaaaaaaaaaaattgtttcttgtttgcatcctttgagccaacttgcttaataaactggttacatgagacagtacatgtgactagaacatagtaaatgatcaatacagtctagctggtattgctattattagatatttttaaattgttgcccctaagtaaattcagcaatgtttgtattgcagggctaagttacacacggactctcaagttcagcattaaaaaatgcagagattcacacatgaataaaaaaataagaaagtcaactgatttgtctaccaaccaaacacatcaaaatatcaagtataacaaaacgggaaaaaacatattcttaatacaaaaatgtatattgtgattttccttgatggaataaacttatttctgactactcagacaatctaacggtgttttttaagaagaatagcacatgaattccattttatcactaatttacgatgaactgcttaatctatcatttctatattttccttagttctcaaatagaacaattttatttttctaaaagcctgaaacaaatcttatactagatgaaaacctctcttttggagaaaaaaaaaagccaattgaagtctcccaataaagaaaatctcttattttaagtaaatttctaaggggtcttttgatagtggagatccatggtaatgtcatcctgcctccatcattagtagccaaactctcttagatgagatgtcgatgagtaattgactcagcatcctagctttccacagagctcatactcttttgaatcacagaaggtatagattacacactgctaaagtatttaatgtgtaacttaaaacagaaacagatactttttcacaacagtttcagtgtaaggacaaaaatgatagtaaaaaaactaggaaatatcataatttagatgagttatgagcaaaaatgcatttcagaacaaagtagggcatcgttatgcctgattttggggaaaaaaatactttatgcaaactgagtctcataatggataaggtaaatagtgatcacattgtcaaaaatctaccacagcataatatagtgaactctaaatatattcagaaagaaattataccaattgtttcaaagtattttttcaaagatggagctgtaggtaaaaatgactgtacttacaatgtttattagttatggacagaggttcttaaagtgtgcgacggtcaatcttatgtattaacttgactgggccatggggtccccagctatttggtcaagcattattctgggtgtttctgcaaaaaattaacatttaatttgatatactgaataaagcaagttgctctccttaatgtcgtgggcctcattcaattagtagaaagcctaaatagaattaaaatgatgacctacttcaaaaaagggagacttcctcctgcctgcttgccttcaaactggaacattgttttttctgcattcagacttgaattgaagcatcagctcttcctggctttcaagcttcctggcctttggactggaacataacatcagtgttcctgggtctccacattgttgactgatcctgcagatctcaggatataacagctttcagaactgtatgagcaaattccttgtaactatcagttaatcttagtttcctggtggttttgtttctttgtagaaccttaatgtgtctcaaataagtcaactgttacagagaaagagaacttttgacatttattcattcaatgaatgttttcaaaaacattctacatattttaaggcattatgccaggtattagggaaacaaatatgaattaaatgctgcctgtccttgatgagttccaggtctagtttaaatgacatgtttgaaaacttcattggcaaatcattgttatatacaaaataagtgcataatttattgggatatgaaaaattaggagaatctggatctaatttttatatatcaattctgcataaaataactgaactttcagacactgtgttataaatgccattcttttaatttatagcataattagtaggacatacagtttaaaatactctacttttcatttctgggactttgaactgagaaggtacctataaaaagttttttattccatgctcgtgaattggcagaattaatataattaaaatttccatgccaacgagagcaatctacagattcaatgctattcctatcaaactaccaacatcatttttctcagaattagaaacaaaatttattataaaattcatctgaaaccaaaagagcctgaatagtcaagagcaatcctaagccaaaagaacaaagccagaggcatcaccattacctgatttcaaactacactataatgctacagtaatccaaacagcatggatttgctatgtgtctaaagacagacacatagaccaatggaaaatagtaaagagtccggaaataaagcttcacacctataccaactgatctttaacaaggttgacaaaaataagcactggggaaaggactccctattcaataaatggtgctgagatattggctatccatacgtgatagaatgaaaatggatccctatatattatcatatacaaatattcagtcaagatgaattaaagatttagatgtaagtcctgaaacacggaggtttcagtgagccgagatcgtgccactacactccagactgggtgacagagcaagacttcacctcaaaaaaaaaaaaaaaaaagtccttgaagaaaagctaataaatatgcttctggacatgagccttgacaaataatttatgactaagaagtcctcaaaggcaatcgcaacaaaaacaaaaattgacaagtgggacctaagtcaactaaagagcttgtgcatagcaaaaggaactatcaacagagtaaacagacaacctaaagaataggagaaaatatttgcaaactatgtatctgacaaaggactaatatccagaacctataaggaacttgaacaactcaacaagcaataaacaaataaccccattaaaaactgggcaaaggacatgaacaggcacttctcaaaaataaacaagtggtcaaaaaacatattaaaatactgagcatgactaatcttcagagaaatgcaaataaaaccacaatgatacatcatttcacaccagaaagaatggttactattaaaaagtcaaaaaataacagatgctggcaaggttgtggagaaaagggaatattcatatactgttggtgggattctaaattagttcaatccctgtggaaagcagtttggagaattctaaaagtaataaaaatagaatttccattcaatccagtaatcccattactgggtatatacctaacaaaaatagattgttctatcaaaaagatacctgaatgcatatgttcactgcagcactaaacacaatagcaaagccatggaatcaacctatattcccatcaatggtgaactggataaagaaaatgtggtacatatacaccatggattactatgcagccatgaaaataacacaaaataatgttctctgcagcaacatggatgcatggacgccattatcctaagaaaattaatgcagaaacagaaaaccaaataccacatattatcacttataagtggaagctaaacattggtacacatggacataaacatggaaacaatagacactggggactaccagaggtgggagtgggagaggggacaagggttgaaaaactacctgttgggtactatgtaactatctgagtgatgggttcaatagtacctcaaacctcagcaacacacaatatatccttgtaacaaacctgtagcagaatctaaaataaaatttgaaattttttaaaagaagatatttttcttttttaaaaaattgaaattgtatatctttaaggtgtacaggatggtttttgatacatatatacacacacacatgcatacacacacatatatattagtaaactaagctttcaaaaagatatatgttctcactattgccatataaaataagtgaataattttatatgtcaaaggaaagtaactcattacaaacatagtactcaaagagtaattcctagtacaacctagagaaaagattgtttcaaaatttgctccaagtatagcctagaacgtcacagcaatgggcaagaaggttggtcttaaattagcactttacagaatcaaaaactggggtattgtttaggttctgtggcctttgaattaagactgaaaccatatagctgataaaagcagcattgtcaaagatggaatttttactattattgtttgtatctgacttgctaataaagtaaaaatgttatctttagtgtttataagtgataaattaatattctgtatatatgatgaatcaattccatatgctacccattaagaaaaactcaatttaagaagattggtttgtatattattatagatgtatgtcctcctcttcccctattagaaataataagtaaaacagaatatatgtgcaggcatgttaaatataggcattcctcaaatttccactcttgatctcttctcattttcaatgctcttctaatgggactacagctctttgccaggcaacagctattactgtaaaaacaatacatctgaactctctacactgaaggtccaacaatcctgtgagctctagatatatgtgaccaaaaatgtttgtcaatcagaaacatgccatctgccaggtacctcaaacacattatacgagccggcgctcattattctccacacactgtgttctttaataccaactggagcaaaatgaaacaagaaaatctcctaaaaatataaaataggccatttctaacttaattttgtcaactcaccatctttaattccaatgcctaatctaaattgctttaagtaaaatatcagttataactatcttatgaatagttatgtgcatatattacttatgcactaagaaccacaatattctgaaatattgtggaaatagcatgctactacttctgcagttctcaaagatagcaattttctttttctagaacagctaaagccatttcccctgtacagtaaattttcgtctttgcagctaatggcatcttcatctccttcacacacctagccctaagtcagaaacctgaaagtcatttttgcctagtgcctccccttcaccactacctcccattccattggatataagttcttactcacaccattcttaaatatgtttcaagctcacctcctccctccattcccagtactcatgccaaaacttaagccttgctctcagtttcttctctcctccataagtgagtgaaaccaaattttctcctttcccccaatccctcccatgaaataaaacaaaaaacagaaaaccactttatgtttctccttcgcctaaacacattcactggctttatccacctacagtataatgtccataggctttatccgccttcagtacaatgtccataatttttaggtttctaagtaaggccttcctttatatggctccaagtttcctttctggaaaaatcctcggttgcctccagaagtgctcagttacccctttctttggcctcattggtctatatttattttcctacacaggcagatcatcttttccctatcccaccttgggtcacactcttctctctgcttcccacacctcccttcttgaattcctactcaagctttagtgacaatctcaaagatctcttattctatgcagcactccccagctccacttgctatcttccatctctaaataatgtttccaatggaactgcactaaccattttacaaaacatttccacctgtcctatcttcttggattctaataaccaccctctaacatgaggagactgaggctcagaaaatgttagtcccatcataaggaagcgatagccatagacttggagctcaaatccaattaagtcttcagactccaagatccacactctctatattatacccctctgcttcttcctgtccctcctatgtgctgtaaaggtagtaatgtttactcttgtaccatcacactgagcacagtgttttaaagtttgcttttatatttttgcctctccttctactctgcattcttagagggtagaatctgatccttattatcattttaatgccaggacccagctttagcatgacataaaacaaaaattaatgaataattatttattcaattaatcaaaggatcttaatttgctagaatattttttatcctgatggaagaaagtaaatttatgacacaaaaagagaaattaaagttcaagtctcttccatcataacacacacacacacaaactcctatccctcctaaccatgtttcttcttacagaacaattatccattaccccttactactaagcaagtttcttgaggagtggtatgcatacacgatttccagtttttcacttcctattcattcttcaaccctgtgacatgtggccatccactcccctgaaatagcaccaataaagatgatcttcatttttgccaaatgcaagggaaacatttcaaagctcatctttctaaccatttctactctgcttggcagtactgaccactcactcaatattaagagtgctcttagttcagtcttagtttccttcctgggatcccctggcttttcctcaaacttagatatcacagcatttctttgttcttttttttttttctttacatgctcttattggagagtcttataagttaatggattctagccttggaattagaacactttgatgagtcagtttataattacatgcactcctgggtcaatagcaaaggcatttgtaaaaactacataattttaaaaagtacttcaagttggtttttgcatgcattgttggtaaatttttgtggctggtttgctttcttgattatgttctattttggataattttaaaatgaatttgtgttcctacatattacttcagaatggtaaaaaatttcttgagccctaccagagcaaaattcagtgaggtaatggagacatgcctagaatttgactgagcctatgtagctggaaaatacatcatgatgtattctccaagattactccttatcttggtaaagatactccttatattggtaaagaaagtctttaccaatatctccaaaacaataaaatgggaataaaacatatttttccattcctataatgtatagttatataaataggtttacataagtaagaattattttggctgcaagtaacaaaaaaaaatgtaaatggcttaaatatcttgtgtactatattattatctctataacaaggagtccagagatagtgctagtcctagcttcattatttcagcagttctttaaggagccagtagcttttcctcattctgctctgccatcctccacctttcggctagctctcttcacgatcacaacatgactactgtggcttcaggcatcacgtccatgtggagcaactttcataggcagaaaagtaaatagtcttttgttgaatcttatctgaagaactaagacatttctcagaaactccccaagggaatttacttttccttacttagaagtgggctataagcgatttcctaaactaataactggtgaagagatggaattaccttgcttgatttagtctagttccttcccgcggtctgaggccatcctgatacgaaacacttaccagtgttataaacatgtggatacttgaacaaaactggcattttgatactaagaaagttggggaggaggagaaaaaatacattccaggtagacaaccaacaatttctttagtaactaactttgtggttttctaagttctatctgaaaagatattcaactgaagcaaagcatctccttagtcaatgttaaaagcgtcaatttccccaatgataaaaggcatcatggattttatattagacaatgaagactttccagttaattttaaaagggagatttgggataagaatataaaaaggcattttattgattcaatttagcatactgtttgggctagcaaatatattaaatttatacagttttatatttcatttatagtatatatgtattttgcacattccttttttcaagccagacagacagtattttgcacattcatatatagtatgtactccataatgaatctgacataaggaaaatgattttaaatttaaaacattaatgtaattcaaaatactatattcttcactttatggcaaaaacttgtgggatcctttccacttaaacttagttttagtttttctttacatttttgatttctcaccaaagcaatgccagtacttggactttagctaaacacttataaattaggcataatttaacttatttttaataattattttttataattgcaatataccgtatattcatattattgaaagcaggtctctcattttactctgagacatttaaaccaataaaaatgtaaaccattctgcaaatgcattatccagttcatgaataagtatgtaccttgcccctgcctcttcttttgtaacactaatataaggttataatcctgtgcattgtaacattaatattaggatattatcccatacactgcaacaccagcacatcagcttgtacattatgtggtccaccagccactttgcgatacaaataaaaatgaccaaaatccaaacttttaaatctgacttcttttaatcacttctcaacaactaatatatacaacacatagaaatcatttaggtgctttatttcattatgtcttcatggactctcataatcagagttaataagggttaaaaatatcactgataattgaaaattgatgggtgactatgcaagctttccagcttgatttgtcacacatggaatagtttaatgtaactgttttccctaaactaaggctgtatcctcacatgcctaagtgcctttccgagactatttatttaaaagctggcactgaaccttagtgtttgaagagtgtgtgtgtgtgtgtgtgtgtgtgtgtgtgtgtgttccatgtatccaaagatgcagaacaaatctgttgttcactagggtgactcccacgctagactgaagaagagcaaagcataggaacttccaactaaagagaaaaaggagatccaactatagatactgtttcagaagaaacactaagaaagaggacttgagtattttaactgctagtaggtaataggatctttgataaagctcttgctcttccagaagaggtaatcaattttcttctgctcattcagccttcactcttcacacacacaaaatgtctactccctaagtatatgacttgctagaatggtaagattaccgttatctatgttcagggtgtttttagaaattagccaagacttttggaacattttagtgaccctccaagcctaaatacttgctatgttttgaagaaactttgtctagcaaagagtttaacatccttacatcatagactgtgaaaaaaaaaaaggaaattaggtattgcagatcagaatgcagatcagaaggctgggcatggtgactcacgcctgtaatcccagcactttgggaggcagaggtgggcagatcacttgaggtcaggagttcaagaccagcctggccaacatggtaaaaccccatctctagtaaaaatacaaaaattagccgggtgtgatggtgggtgcctgtagacccagctacttgggatgctgaggcagaagaatcacttgaacccaggagtcggaggtctctgtgagcagagatgatgccactatactccagcctgaaccttagtgtttgaagtgtgtgtgtgtgtgtgtgtgcgtgtgtgtgtgtgtgtgtgtgtgtgtgtgtgtattccatgtacctaaagatgcagaacaaatttgttgttcactggggtgactcccacactagactgaagaaaagcaaagcgagactccttcttaaaaaaacaaaacaaaacaaaagaaaaacttcacaaaaagcaacattggacaattcatatctctgaaacttattggtgtttacaaaatccagctaatcagatttgacaagtttagggtatgtcactagattaatctgtgggtttctatagcacttattatcctccacatagcaacacaaaatactcatataagcaaaaatactcacttgtaaaatgcaaaatgttaaaaatgtatgcaattgtttttgtattatttttactcagacattccctgtgatctattaagtgacaatgtaaagtataaacagtttttgtgctacacttgatccatggcaatataaataattcaatttatgctggaattgggaaatttactttttaacaaacatcttcaaacacaatgtaatataaaaatagatttttaaatatacattttgatttttaattaaatagttttgtttctttctgcttcatttcacagagtcacttaataaaatccatggtacttacagaaaaattcctgatgtcatatgcatgtgtttcactataaggcagttatgaggttgataaaatttcttctacaaattttttcattagacatacgcaaatcaataaacgtaatccagcatataaacagaaccaacaataaaaaccatatgattttctcaatagatgcagaaaaggcctttgacaaaattcaacaacgcttcatgctaaaaactctcaataaattaggtattgatgggacgtatctcaaaataataagagctatctatgacaaacccacagtcaatatcatactgaatgggcaaaaactggaagcattccctttgaaaactggctcaagacagggatgccctctctcaccactcctattcaacatagtgttggaagttctggccagggcaatcaggcaggagaaggaaataaagagtattcaattaggaaaagaggaagtcaaattgtccctgtttgcagatgacatgattgtatatcagaaaaccccatcatctcagcccaaaatctccttaagctgataagcaacttcagcaaagtctcagcatacaaaatcaatgtgcaaaaatcacaagcattcttatacaccaataacagacaaacacagagtcaaatcatgagtgaactcccattcacaattgcttcaaagagaataaaatacctaggaatccaccttacaagggacgtgaaggacctctttaaggagaactacaaaccactgctcaatgaaattaaagaggatacaaacaaatggaagaacattccatgctcatgggtaggaagaatcaatattgtgaaaatggccatactgcccaaggtaatttatagattcaatgctatccccaccaagctaccaatgactttcttcacagaattggaaaaaaactactttaaagttcatatggaaccaaaaaagagcctgcattgccaagtcaatcctaagccaaaagaacaaagctggaggcatcacgctatctgacttcaaactatattacaaggctacagtaaccaaaacagcatggtactggtaccaaaacagagatatagaccaatggaacagaacagagccctcagaaataatgccgcatatctacaactctctgatctttgacaaacctgagaaaaacaagcaatggggaaaggattccctatttaataaatggtgctgggaaaactggctagccatatgtagaaagctgaaactggatctcttccttataccttatataaaaattaattcaagatggattaaagacttaaatgttagacctaaaaccataaaaaccctagaagaaaacctaggcaataccattcaggacataggcaggggcaaggacttcatgtctaaaacaccaaaagcaatggcaacaaaatccaaaattgacaaatgggatctaattaaactaaagagcttctgcacagcaaaagaaactaccatcagagtgaataggcaacctacagaatgggagaaaatttttgcagtctatccatctgacaaagggctaatatccagaatctacagtgaactcaaacaaatttacaagaaaaaaacaaacaaccccattaaaaagtgggcaaaggatatgaacagacacttctcaaaagatgacatttatgaaaccaaaagacacatgaaaaaatgctcatcatcactggccatcagagaagtgcaaatcaaaaccacaatgagataccatctcacaccagttagaatggcaaccattaaaaagtcaggaaacaacaggcgctggagaggatgtggagaaacaggaacacttttacactgttggtgggactgtaaactagttcaaccattgtggaagtcagtgtggcaattcctcagggatctagaactagaaataccatttggcccagccatccaattactgggtatatacccaaaggattataagtcatgcttctataaagacacatgcccacatatgtttattgtggcactattcacaatagcaaggacttggaaccaagccaaatgtccaacaatgatagactggattaagaaaatgtggcacatatacaccatggaatactatgcagccacaaaaaaggatgagttcatgtcctttgtagggacatgggtgaagctggaaaccgtcattctcagcaaattatcacaaggacaaaataccaaacaccgcatgttctcactcataggtgggacctgaacaatgagaacacatggacacaggaaggggaacatcacacacctgggcctgttgtgcagtgggaggaggggggagggatagcattagcagatatacctaatgttaaatgacaagttaatgggtgtagcacaccagcatagcacatgtatacatatgtaactaacctgcacgttgagcacgtgtaccccgaaatttaaagtacaattaaaaaaagaagaaaattcaacatagacaaaatctctctttgcactataaaggtttatttttttcttctgtaacatatctgtgtttgggtatatccaatgatatatccaaagtatagcaagtatttaggctcaaactgccatggttttgacagtgattttttttttaaagtaagccaaaataaataaaaatggcataaaacctcataaggattcatgtaacgattacatggagaaattatttccccaggtagagcaagccatctaattatttcaaatattgaaacaaatctagccattcatataaatcacccactcattagcctaatggatctttgaaagtatatcaatgggggttgggcgcagtggctcacacctgtaatcccagccctttgggagaccgaagcaggtggatcacgaggtcaggagatcaagaccatcctggctaacacggtgaaaccccatatctactaaaaatacaaaaacattaaccgggcgtggatggcgggcacctgtagtcccagctactcaggaggctgaggcaggagaatggcgtgaacccgggaggcggagattgcagtgagctgagatcacgccactgcactccagcctggacgacagagcgagactccgtctcaaaaaaaaataataaataagtgaaaaaataaaagtacatcaatgggatgcaattgagttaatattcaataacttatcaaagaaggaaacttttattgtttcttccagaccactcaaaacagtcaacaatatatattaaacttaacacaaattttaacttttttaaaaatatctcaatatgaagtccttttagagttgacaaagatgtcagtaagacgtaataataaaagcaatttttattaattatctatgatgatatggacattgtactatgtatgtccctatgcaagtctttaacaatgtaaattcagcaattattatattactaagttttctatataagataatttacttttattaaaggaaatataacaaatacttactagagacagaagagagctgagaatagaatggagtaagtaataataaagtcactaaactaaggcagttgtatgtttgttgtcataatatatagccagattatagctaggagagatttttagaaattaatactgaaccctggagcttcaaggtagatgtttccattgaactgtaaaataggattaattcaacgaaaatgctaaaattatggggaagctagcagtggaagtattgttggttgcttcaccttgtaacagtattaatacacagacttacttatattgcatttctttcatacaaagtatgaaaatactataaaatagtattttaatagtactatagtacgttaatagtatttaaatagtatttaaatttaatggtattttaacagtaccataaaatactataaaatagtatagtataaaatactataaaatgcaatacaaatagccttttaacttatttacattgcaatactcacaaatgcaaagtattatttttgctgaatttgatgcatttcctctttattatacattgttgactgtgaacacttaagagttaacttttattattgttattctttatgaggtgcttaatttctagctgagaagtaaaagttcaacagcatgatacttactcttaactacaatgatgtattaatataagaagtataaactcctaaacttaataaattctaataggatttctatgttgtcaagtttagagtaaataattcaatatattcagcaattctttgggagtaaagatatgcggtatgaagaaaacaaattactatgtaaaaataaactatgtctaaagtataaaataaatataaaatagcagatgtttacacataaagggaggatcagtggaagttatttttaaaaagtgaaaatattttccattgtatttattgatattattcttcaaataaattcttttcaaataaaatatttatttcattctgcaaaaaaaccttaaaatacaacttgcaaaatactctatattaatgtcaatcatttcatatttttcagttaatttgaattgagtaaaatatcttgaaaattaaaaacacctcataatgtcactagctcaaaatgaccaatatgtttgcaatagcatttactaaaatctacataatgcttatcacctgccagacactacacactttaaatacataacttatctaatattcttaaggtgccattactaccccaggttagttatcttgtacatatagctagcactaactgacatactcaggaattaaaactaggtggtctacttaggagactgtacctttaaccattgctctaccccaccttctgaggaaaatgattctgccagggtctgtatgtatttgaaagtcattaattaaactataatcaatcagagatgtcaaatgtgaatatgcttttctcattatgaaagtgaatttgtgagttacaagcaatgaaaaggaaagtgagcataataaacatgccaaaagattaaacagtgtaaatgttaagaatagggacagtacagataaaaagcaaataatcatatttaacattcgaggtcataccatttaaattatctacatgtaccagaaaactacagtggtatcacttataaattatgccccaagagaaccgtctcattaaccttgttcaaaacattaatggtactttatttctaaaataataaactgatcaaaatgtttaaacaatgttttgtttattaaacaacactattcatatacctcacatttctacagaaaaaaagtcaatctttattttcagaaaatttgacataatttgtttttaccttttcagatacaaaggagtatagagatctgactctattattctaagcctgaagtcagtcaagaagaaagtatgactcttaataaatgtggatctactttcctttgaaggtatctttgaaaggagcagtaggagggagagcaatgtagatcttctctaaaactgaatttcaaaggatttatttggcccatcttccacatgggaagaattagaatttttttttttttttgccttttatttcccattgtgagaccctaaatgggaaaataagtccaggttatgtaggtctctatgtggtattagatgcaatagcagccatagtgcaaggaatgtaggccacaaaggcctgtgtaactggctgctgtgaactttagtggcaaaccttaaaaaagggaaaagaaaaaggaaagaagacctttagcacttccatatagatctcaacatcactcaaaaaactttcttcaactgggtctgatgcattaacgagatcatagaattactgctaatttagaattacatactttggtgaggaaagtttattattacaaataaaatgccatagtttataaaaaagaattggatgtgacaataagccatattttaatatgtggtttattattgtgtggattaaaagcagaaagcttaaattaaaaagataattccttgaatttcattaaacagttttaaaaattgttttgcaggtatttaaacagtgtagaaacactgtgagatatatacatatatatatatatatatataatgtcttaaaatcccaacattttaaaaggagctcacctccttttaaaattatgacagatgaaaattatgataactgtaatgtaaaattaggcaaacaagtaaataaaattaagtaaataatgcaattttacctggtgcacttattaacaatattcttattattcaaatcttaccttttctttataaaatcttccttaaactatgataattcttgtagtttctgtataatacccaatgtctgaatgaatattcaaaaatcagtctcattaatgttttaaaaacgcaactgctaaacaaaccatgtttaagtttttcagctatgctagcttttgcatctcttgaaacataactactgggccaagagtttctaaatgattttccagtaaatgacatctgtattgaaacctaagacacacaggcactatagtaaaggttctgaaaaatttcattttttataatcataaataaaattaatctatgatttgacgaggaaaagaattattagaatagcaacatgaatcatatttaaaagaatatacaagagaattaattattccacaaaaggtaaaagaaatattttgttttgttttgtttttggtcagcagtggttcaggagatgaaccaactgtgggctctctggctatcattatacaaatttatcatcaatgaaccagtgaagcacgaaactgagggttaatatagaatgaaaagagactttcccctcaatatatcactttagaagcatatattctgagttctaaaagcaataatcttccacataaaattcaatacaagagtgatctccaaccacattagatcaaattatggcaagattcaaataatatctaatccaggtcctcatcttatataggaatccctggcatatggtcatttcagcctcttcatggatacccacaatgatgggaacttcagccaacagggtgctcacaaatttttggaaaactctgttagaaagctcatgatttaatgaaagtaaagctgcttcatcctttcaaatttctcatagatttatcaccattttgtcctgtgggctatcacaggatagtcagaattccttttcttacctgatagcttttcgctatttaatgatagctttcattctttcacttctccacgttaagtctttccacggcatttcatagaatacatctataatacacaataatcttcctttatttctcttttgaacttactctttgctagcgtgacagtttgccaacgtccgcctcaacaaggagtgctcagaattgaacacaacatttaagatgtgatgatcattgcaaactataatagggcatccgtttgtgggactctattaagtccaatttaacaacgcttaacttttgcagccacgttccatgacaaatatcaagcatttggccaacaaaaccatggtcattagttgtgtagtagacttttcgtacccaaagatctttccatttatgtctattcctataaggtggtattttgacatcgaacatgttaacatgaatctctgtatttgaaccttaggtatcttatcttcaaaaatatcaagttactctattttccttcctaccaaactcatatcccttcagtgttaaatagtatggagctatgttgacttataataacctatctcaatttattacctcttaatactcaagaatacccaaggaaaacattttcttgtatggcaatttacatttaagaaaccttgcccagtacttctttttatcttgtttattttaaaacaagttttttagagaataatttaacagtgcggtacatctccgtaaaagcatttcttagtagttgatcatgattaagcggcaaaatgcaggtaatgacatgctcaattccacctttgagtcaggacaaacagtgtacatcgacgacaacaacaaacccttatgctaatatgcctgtgacgcaaatatccatacataccgcacacgaattgtgcagtgagctaaaaaagaaaacagaaaagaaaaaagctactactttattctacttaaagttgtcctctattcaaacttttatctcactcttctctccttctgcaccataattttctttcgagcaaagacagggagttctggatgattccaatctccccaaatccacatcacagcctccaattgaggttcatttaagtcaggttggagctgagggagcctgggctggaaccggccagggtttcatccagctcctcccccaaaacacgccccccaaatcggagccagaggagagcccaaccacagaggacttccactcaatgagggcaacccctgagtaaagtccatgcggacaaccattcatctcctccgacaaccattcatctcctccgacccccgcccagcactagactgcgctcctagcaccgcgccttcttccggagcctcctcccccgggctggctaggggtgagcgcaggggttagtcagtacgcacgtgacgcgcgatgcccacatgacacgaccgtgagcgggggagggggacacggagtgaagaaggggaaaagttacagaagacccgtcaaagcgcccaaagcaatttgtcccttcttttcttcgccagcggtggctcacggatccctaagggacagctggggacccaggcgcccccagcccagccccagaaacgctggacgcagttctccgctcaccccaccaccttctcttcccagacccgctggtgatgccgctgcaccctgaagttgctccttccttctttccctcccttcctcccattctttctttcttttcttccttcctcccttccccaaaagctcttcatccgcttcgggtgatgccactgacgcacattcaatttgccccagcagctctgaggaggtcagaccaggccgagcaccttccaaaggggagggtctaactgagcaaacaaagttgcacgccacaccacaacctgcccctcccctccctttagcccccaagtcgaatccccggcgaaactcacttgcactgcgggtgctctctggcccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccaggtaggggaactgtccattctcggcgccccccttcagttcaaagcccagctggccctccgggttcctgccaatgacactctcatggactttgctagtccagtggcttttctttttcaagcttttggacatggcagtggggcgagtcgcctcagttcctgggctccttggggttaggggggctggtggtgagagaatgaggatggaggagcaagggggcccagggggaagaacagcagactttgccttcgcccccctctattcggtgctttccctcttctttggatggagtgtggacgaggaatggggaggatgagagggacggctgggcagaggtaggagagcttggatgaggttgtgctgtcccttgaatgacactcaaggctgtggccccgcagcagaggaagcagtggtggtggcgtcggcggcggcggcggcggcagccggagcgagcagtagccgagctggtgagcgggtgtggtgggggtggggaaggagggtagggatgccgggggccactcctgcgtggtgcgagtgggaacgcgcgcgcgcgcctgggtgtgtgttgttagctgatatccatggcagctgcagtggcagggtgcgtgtgcgtgtgtgtgtgtgtgtgtgtgtgtactagttctactgtactggcagacgggaggaggcaggggaggaggggcgcgcgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtgagaaggagttggggcgggggacccggcggggcattgcgggagaaggcctgggatccctgggagccttgtagcgtgggggagttcactgtgtagagaggtttcatgtcttcatctatatagtcacttatttgtcttaaagttctcgaaattccctcttagagaaggagaaagttagagaactggaggctgcgtaccctgattacgcagaagggaagcagcctcgcattccccggggcaggcccccgcccgcgcgtcccgccagtaggggaatttagcggacggctgcggttgtctggtgaaaggctatccaaggataaggggcttcacttttcccaagtaggggaaagagaaggggtctacagggctaggggtggagggagcggatgcagtgagcagcctccgcagagaaattgacaatttaaccagggacctgcggcagagacaaggcggagacactcccttgcccaggaaagccgccagagtccggcttgtacctggggaagaatccttaagacggtctggcccaacactcctttgctcacagagaaaggggagaagactcccgagggtgaaaatggtacattcggagctggaactcagctcgctgaccccaagcagtgttcccttcttttcgccaggtttgcatccaagagaggggaggacaggggcaaaaggatgcagggaggctgctgatttccactgaagagctaatttcctgtgagacattaacagtgatttaagaaaaagattcctgtaactggtaaatgaatttcatttgcttaacttttagatgatatgtttcaggcaaaaaaaaagttgtgcacccacttatctctttaaagcggaggatgaaaagcattgaataggtaggattcttaatgtctgagatgaaggcgatgtaggaggcaaacaatacggttaaaaatgttgagtcgacccaaacagaaagaccaggtttcaatccagactctgcggcttactgagaatatgatcttgagtaaactgcttgaccttcctgagcctcagctttcttagttgttaaatggactttaacaatactaatctgttaggactgtggtgaggatgaaatcagggaaatcagtcacagcagtgctctcctggcacaggtgagtaggagttcgaaatgataattccctcctctttccctcttaggtataacttactacttggggatgagggggatcaaatgtagtcagaactggaagagatcttaaaaaaagatgatttgtttaaccttgtgtctttttttcacttgagaaaacagatcctccgtaagttggctgcactagttgaagcttattcagtgagccaggggcagtgccaggatctgaagccagagctgcaggcaatgcccaggagtaggcaagacttgatagcaaagcctaatctcacccagagaagttgagtgttagcattatgaggcatagttctaaatggaaactcatcatgagaaccgaatatatacatattgtaaaaccaaatgacaagctaccattcatggaatatactaatatttattaggttctaactacatgcaagatgttgttttataggctttacacataatacttaatttctcctgacattttgataaaataggtactgttatctccttttacaggtaaggaaactgaggtatacaaggatgaacttttgcaaggctacaaatcttgttaatagtgaagctaacgttcagacccaagtggttcggctctagactttgtctcagttactgaattgaactctctgtgcacttacgatgtgtcataccagttctcactacatagtgtcccaaaagattgggcctgctctttctttcagagacaattaggaaaaaagtaaacaaacggagcaggatttgggcataacagcatgctcctcccatcccccaaatcccaggagtgtcactgaggtcagtgccagttaacttagtgctcttcaacttcacagctacccttctttgccctaaattgtgacattagagctgaaatctgtaaacgtctttatggtcagttggcacagtgtttagctttgtcaatagaaggtgctaggggaacactgcagaaagaaaggggctccttttcttggttccagtgctttcctgcttgctcctacggtgtggtggccagtgagtgactttctgaccagtggtgtgcaagaaggccatgttacataatcttcagtaaatttggccagttccctagtatgtgtctttctatggagtaccactggcatgtcagtggaatggcttcctagcaagttttactgaaaacacagctgatggtttcctcagcagcccagtgtgtgacaccttaaatttctggatcattaagtggaccacagccatattatttccaatgagcgcctactttcaggcttagtagggtggagggtgggtagggggaagttctactcagttattccctccttgggtactctcctagagcctgagagatagtggctgttcccaataaccactattactgtattctttagtgggattttttcctgtcctaatagtcaataccctttgactggatcttaactgataaaagtggaaccctgaggaaagcactatccttggagtcagaaattgggatcagattttttttctttctcttatggtattcctcatattcgcttaatttctccactgcctttaccctttttggatttgatgctatgtcaagaaaaaattatttcatcactgagcactctgagtgtagagcagagtgctaaatattgcatgctattccagaagaaaaatagtttaggaatcctaaaagccaaagaaagaaagatatgaatgcattcagttcttagaagagttctatgagatagatgcttgtggcagacatagtctccacccagatctcctaggatccctttggttgaatctgagtatccttcctctagcttctgtgttcttttacttctcacagcctgccccgagaatctctttggaggaaggcccaaacactactagactcactttgtgtactggcatagagagccagacagaaccacctgcaagtttacttctttcccaggataccctttgccaaggactttcctatagagtataaaagaccagccgtcttgcctctagtagcaagaaaacctgaggtgtaatttacaccctgaggctcccctatagaattatattgatgttaatattttgcctgaaaccaccttcttccctatcttgcttactgtggtacctgatgagtttttcttggtagcatttctataataaatcacttgcagacaatcttcatctcagggtttgatcctggggatcctgacttaagacattgctattcttttttttttttcttttacagatgaggaaactgaggatcagggcttttaaattgccccaaatcacactactaataagagatagagttgtggtaccttttttagagggaccattattctgctgactgcagtactgtagagcataaagtttcttatccacactgtttcttagttcagtctgtcaatatcactactccacgattattgttgtttgtttttctttctccctgtcttttacctcaaaaatctctattgtgatgccagagagacctttctgaaacctctccttttttctgtgtttaaaaccccccagtgccgcccatgaaatacacagcaaagtccaaactccttatcttgcttggatcctcctttccaccctttttaactgttcagccatatttctccatgtacttctgagattggaacccagggcaacaaagctaatgtgggttctccaagattaacacaactgaaaggaggcccctttatgccatctattctaggtcccttggaatataattaaaaacaggaatttcaacattgaaatgtaatgatgttcaggtaagggcagtaaggtacattgacttgagtcaatctcccaccatgtctggggactgggacagctgagccaggggtcctacctaagggtcaggcctgtgtcttcacttctcctttcaaccctttacttcttccagagttgaacggcttactttccttctctcactaggccatttcatggcttgtgtttgcctgaaatacaactctttccctccctggtctacacctgctcaccctgaaagaaatacctctgagcccactttctttcttggaagcattttatgactcttatttctgttatcaacacagcttttatttatgtctccatgtatcctttgaagaaacacaacttttcaggttctatgttttatttgcattcttagtgtctggcacattgtctgacacagtgtaaaagctgagtagaattttgcctgatagcagatgtgcctgaagtgagggtgtccaaaatttcattaaatgacgactgctttaatatgaattcttggctaaggcaggagaatcgcttgaacccaggaggcagaggttgcagtgagccgagatcacaccactgcactccagcctggtgagagagggagactgcattctcaaaaaaaaaaaaaaaaaaaaaaaaaaaaaaaaaaaagaatatatatgaattcttactgatagtattaaatgattatctctttacattcacagtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatggtgagacacaaattcagtctatttcatagtttgtggtcattcctattaataaacttcctttcacaactgtttcaatattcacacaaaaatgttaacccaatctgcagttgtaccccttgaatgtaaaataaaaaacaaaagcccacaaaaataggaatccacacttaaaaggtggatttatttagcacagtatggagtttcttagacttctctatcactgtctctaacaatgacatactcacctaaccccactaagagcaactttatttcatctctagttttcgtctaaagattcatgtggattttagattctactcttttgtaggttcgtatttgtactattataaaatgtgactctctctccaaactttgcctaaattatggaatgatttttcatgtttatccagtggtttccagcattcttggcccagtctgggattctactcttttgtaggttcgtatttgtactattataaaatgtgactctctctccaaactttgcctaaattacggaatgatttttcatgtttatgcagtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagtgaggagaagttttaggggcttagattcttctaaacacatgtacagaaatgcatatttcatctgatatcaaatggcatttatagtgctaatctttacctcaagacttcacatcttttggtgattgcatcttttaggtttatagcagctaagtttgcatgaaaacaccagggctgtttcatttcagtcaagaattaatgttcattgattgtgcttctgcatttcatgtaactattgtagaatttgttttagttttatgagggaataattgttccaacttctatataactcaggaatttactctcaaacaacactgtcaattagttacttatctctctggaaatgatctgggaacatggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcatctcaaaaaagataatggggaaaaaatatgttttgttctgtgactttaaagtcttgcaatattttacataaatgataatgggtgctttaataagaactcttgatacttttgttattgtattcaatatatgcatataatacaacaggatgatattgttttggatttggaaatgtattctttcttatgcaatcttatgcagtcatactgcttgaatatcattacctgaatttatctttcttttttttgttgttgttttacactctacttatttggtgcctgtcagtcttttgtcgtcagtttatattctactaaactcaaaaagacaatctcataccttttgtaattgtaggcattctttactagatttttaaatacacttcaaaaattcaagtactttgatttcatgccatcaagtagctgaatctatccccccgtctctttttaaatttaagtgagtagttcaatttctgtcactttctactttgtgaattctaaatcttttaaaaccatcttgccatttttcgtgcacttacccttacagaaaactctgtgaaacactacttatctctacttttatgtttttaactccttttttatattactattccctctgctttctaaatgcacatattaatttgttctttttattctctgtagctcttctcagtgtatgaattcagtttcccatcagtctccatacaattaaaaaaaagttgagtattctgttattttaataagatatctagtgcccatattctaattctgccccttatttttaatataattttattgttgatttaaaatgacaacagtttcaattcccagaaagtgaaaggaaacaaaggaataatattataggcttaatttttatcagtgaacttgtaggtgaagaaaagatttggggaaggaaatgaacatattatattgcaaaatagtaaggaacaatcagatgtgttttctagtctctggaaaagcatgtttcaagaaattcaatgaaaagttcatcatgcttgcttagattgttgagaagcaaaaacactgatgaacatttggaagcaatgagaatgtaattctaatcatactcttttaataatgttgcaaaactctccaaacactactctgtgtggatgtctttcagaatatgatgaatactagtagtcttattctgcccttttctctctatcacaatatatacattctatattgcatacacatattttccaaatattacatataatttcatgtaatttatagacctattaaggcccaaccattttcttggataggggattctttagaagtccagcttaaataaagcccgtatagaaagtttttttaaaatttatacataatcacctaaagtaaccttatctactgaactcttagtacatgctactggaaccttttatcatgtttcttcctggcttgcattacaacactgttgacatatctcagccttacttctaggcttctttgagagcatgactcatgtttgtattcctcactgaggttgaatgaataagagaaactacagtagtaggaaaaaacagtacatgtacatatcaatgaatatgaaagggtcaaatggatctattatagtaagcacaaaatcaactgacaccagcaaagtaaacccaaaatttttaatggtattttaatagatcaagaggagcaagcagatttttgagacagttgtctcctactttctctatcacagggagtaattttaaaagaaaaatggagggtaagtttctttaagagaaaattgtagtttaaaacaggtcatgggataattagaaataatttaatttctttagaggattttaatctttcaactgcttgcaattagatcctaaggcaataaaagaataaggagatttggaaaaccattgtctgtaatctctgaagaaaagtggacattaggggagtcagttgaaaagcaaagctatcaccattttctaaagaggaaaaaggtgaacctcacaaactatagaccaaaaaaataggacatcgagagaaagaatatgaagctagcataggttcacaaagaatgagtcaaatcaaacaacatgcattttttatttataaagcatgacttgttcattgtcaattcatgttagcttaatcattaggcattaatgccatcactgcaatgcatatgtcagcaataaataatcaaagaccaggcttccatcattctgtttaatatcttcaagtaatgcttaagtttgcaaatgctcttttaacacattctccatatgcagcctgcccagcactgcacacaatagacctgttacttccccctcacgagcactcctaatatttcatgtgctcatccaattgacttctcccactggtgcctcatattgaatttgtagaatcacacctgctcctttttcaaaactcttctgagttttttcttaaataattcactgaccccaaagttgtcagatatttgaagactactcgcacaattttaatattataaatgtataatgtaaatgtaattaagatttgtataatgtacgatgtactttggtaaataaaagtatgctgtgaataaatacgtatgatacaattcaaaattttacataaatatgtgataaaatttagctcatattctttttttttttctttgagacggagtctcactctgttgcacccaggctagagtgcagcagcatgatctcagctcactgcaacctctacctcctgggttcaaacaattctcctgcctcagcctcctgagtagctgggattacaggtgcccgccaccatgcccagctaatttttttctatttttgttgttgttgttgtttttagtagagacggggtttcaccatgttggtcaggctggtcttgaactcctgacctcagataatccacctgcctcggcctcccaaagttctgggattacagacgtgaaccacggtgcccggcctagttcatgttctttaaggacaattatgaatatttttatgcactgttaattttcattaagatattgatcaattaatagctatatatgttctataaattaatcctatctagtttcaatcttaaattgtttgcatataccaatctagtttattgtttgcatatattttatagtgtagagattaggcattttaataaaattttaaaatt

SEQ ID NO: 1139 - DNA, 258527 bp, Homo sapiens
ttgcatcaaagctaggcatctttgagagttccatgcccagttctggactaggggctgaagtgggtaaacagatgaaaaaccacggctgcacaacacaacttaacggtgtagctggacacggaccaggccgactgaggtgtaaagatggtatcaatccttaaaacgtcccttttcccctccagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaaggtacagatggaggatggggatgcagcagaggctggctgtgccttgacacggggatgggcgaatgttctctgctagctttctctgagatgggagcgcccctgcctcacatttcagcctgtgtgccccatcactcagtgtgtgtctgcccattcttgggggacagccagctgtggtcttctatgtggctgggcttttgcagaacagcagcatggagcccctgctctctgctatcttatctgtgtgagggaatggagggagcagtccccatgcagtgtggctgtgggaggagcagagacgcccggtttcccatccatttcatgccttctgcccttctggctccctgctgcagcgcagcgtcctcacccctacatcgcagagcctcagggaaattggtccaggaagagagaattctttcagttaaacttttggtcctcccagggggagttcctttgagatgacagatgacgacagtgccattagggctctgacccagtttccacttcccaagaaccttctggccaaggtgattcagattgcaacgtcatcctccacagctaaggtgagttgggtctcctagaagtttgtgtgggggccgtttacttggtcatgtctggtgttccctaaaggcaggtttagagagggctgagggggtgtgttcctccagcccaaacctaggccaggtggaggaactcctgcttgggaggaaaagcagcaggtgtgatggaatggaggtcaagcctcagcagcacagggagtgggcttgggggccgcaagagcagaagacccatacctcttctgggcggtggattgtcagtggggaagggttagaggtgtgggtcttggtgaggtatgaatttctctcttgctgccaggcgaaggggctttggtcatgaaatgcctaaccttgtttttactttaactcgttgctttgaattttgtcctgcttgtctctttaatcacctagccttgcttctcatgtaaaataagactctctctagctaagaaagccgtacaaaccccaattgaccccttaatttacaagacactaagggctcctcacccaaccccctttcgtaaggagttggcctgggtaaacagatcctcagcatttcaaaggagcctaattaactgataaggtacgaacaccaacaatatatgaagttcccaggaattttctccaagagataacaacataaaaccttgagttcgtgtctggcgtagaccctatatctaattataatgaaagatttagaatcttgcacctggtactgttgctcttcttgtaaccatttgtcttttaagttgtttatcactctgtaaccattttgattcttttgattcttgcatgtttttacttctgtagaattattacatttaagtccccctccccttcctaaacctaagtataaaagttaatcgagccccttcctcgtggccgaaagaattttgagcattagctgtctctttggccgccggcttaataaaggactcttaattcgtctcaaagtgtggcgtttccttaactcgcctaagtacaacagttaagcagagcttctgtccaggtgcagggtctttttgctcccgcaggatgtgcctggtttttagctcatgctgacagcttcaacccacagctgccacgatgttgccgagatgacagtgggctaggagggcaggtgatggcattgcccaagcactgtcttctgcagtggaagtcgaggtatagcaggagaagcgagcctgggactagggtgcctgagcccatgggcctgctcctggctatgcagcagcacctctagcatggctcacgcctggcacctgctgagatggtggctcattctgtctctgggctccttggcattctgagaatgccccaagtctcttcccattccctacatttctgtaaccatctctcttgccttccatgtagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaaggtgagtccaggaaggtcctgggtgtggtgcatgagaatgtcttgaagctcccctctgccagtggcaaatgggtcccattttctaggaaatgaaaccaccacagcaggccttttgcctggcacaaagacagctggtatgcaggcctcgcttgtaggccctgtggctgttgccatggcttttccagaggccctgtggagatactttgcccgtgacccagcattttccacactgttggcctgaacctggtgaggccgggaggaaacttgctcattgttctgaatagtataaagccgggaggagccgggcctgttttgagaggcagacctggtgtccagtatgatcctgataacccgggttttgtgggcagaatgaataatgtgacttgtgactgcagtgatgattgaggaagcagtcaggatcaaggtagagacagtgtggcagacagctggcagttctcttttttttgagacagggtctctgtggcccaggctggagtatagtggcacgatcatggctcactgcagcctcgatctcctaggcttaagcgatcctttcacctcagcctcctgcatagctgggaccataggtatgcaccaccactcccagcttatttttaaacattttttgtagagacaagggtctcactgtgttgcgaagactggtcttaaaatcttgggctcaatcagtctttctaccttcacttcctaaagtgttgggattgcaggcgtgagccaccgctcctggccatggccgttctcttgaaaggggctggtggagttagctgatggcacagtagtgggagggagttgggattgtctctgactgcctgaggagttagtaatctcaacccatgttggtggaggtttagtttgcagaccaagatagaaatgggcctgctttactctgaatggtcaggtgcaccatttcatgggtacagttggctctgggaaccatgttttagttacagctgatggtgagaggtaacaagaacctggagaaagacgaggaagaggggacaggcaattggtgagataaagagggcacagatatgctacctgtgactcgagggcagaacaaggactgagtagaactggaggcatctgagctttggcctgatgcacacgcactgtgagcagaagcaccttggcatggtaggggcctgtctgggaaggagcaagctttgcagtggctggagggccatttgtcagtgaggctggtgggtaaaacccatgaagtctggggagagggcagaagcctgttcctgcagcaaggagcttgtgttggcacctcctgtggtatgaggaccagattcctgtcctttaggtccttatagctgatggtgccagcacgcccagaggcagggggttggcccctgttgggggaagacttctttaaggagggagtgtttgatctgggctccgaagggtgagcagagtccagccattagaggtgacaggaacacaagactagttttacccatgtgcgtgaggtattggaatgctatgttttatctctggtgaggtggctttaggtatgtagggaggtaagacacagtgttttccttccagtggcttgtttgatcaagttgcattataatcgacatttacaggaaattccacgtgcatctgtatatgatggggtcacagatgggtcgggtgccatgtagggattgggaggcgggatggaaggattaggggaggaaggctttgatgaggcagcaaaggaagagggagtctgtggggtgcgttctagcatcgagggcctggcctggctggtctgagggtacatgttgggaattcacagaggtgacagtggcctattgtggtgttgggggggctgtagccacacagtgagtggtttctcctcagggccttctccagacgtagggctgttctgctgtgacacatcaggtttagcttttcttgaattaactttattattattttctttgagacagagtctcgctctgtcgcccaggctggagtgcaccgtcatgatctcggctcactgcaacctgtgtctccagggttcaggcgattctcgtgcctcagcctccctagtagctgggactataggtgccggccccccacctggctaatttttgtatttttagtagagatggggtttcaccatgttagccaggctggtctcgaacccctgacctcaggtgatttgcctgcctcggcctcccaaagtgctgggattacaggcgtgagccaccgcgcccggcctgaattaactttagttcattttttaaaacgtttattttggtaagttaacattttcctagttcataatttctccctccatcaccatgtcagccaaaatccaaaatctcttagagattacttggcacaacttatgcgttggagctcctgagcttgtctgggctggtttttggggagccccagagcatagactgagtcttgcatgtccccctgcagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccatgtaagaggccctgcatccctcaccacccctgctccctgtagtctgcctccatctctccagactgaaggcctccacctgcgacaggcagtagtacctccccattctcttcactgagtttggggcctgggatccccctggcctgaacagcccagtcttgcccacaaggatcccggggcagtcatggactaaattaatcctctgcccagcgggttgggccacaacatctgacccaggcgaatcctgcagagtggctggttgtgtgtgaatgaggaatttctttttcattgttttgcttgcctccctgccctccagtaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgaggtgagggacacccccatcccacccaaggctcctggcctttcctccgtggatgcccctcctccctggccctggggcttggtgcctggggcaagttaccctccccagtcctcggtttccttgatagaaactggggactaaccctgcctgcgtggcacacgtgaggattggagttgatgtcaagcggctccgtctcactgagtcaggtggctgtgtccttggcatgaccccttaccccggggctgtgactgtggcctctcttcccccaccccagtctgaggatgaatgcgcactcgatttggaccttgtgactgatctggttctgcacatcgatgctcgcggggaaccaggtgggtgcctccccatctgtcccatgctagccctggccacgtttgcagcaacagctggctcatgccccagggctcctttacaggtgggatcctgtgcttcctgcctgggtggcaggagatcaaaggagtgcagcagcgcctccaggaggccctgggcatgcacgagagcaagtacctcatcctgccaggtgagagccccggcggagggaccagggacctttggaaaccagcctgacctctgtcctagggactgacccaactgggactccaggggccccggtttctgaccaagctgtggcacttttcactgggcatagtgtttatctgcgcctgtttcatcaaaatggggtcaaaatccttgccctgcccacattccaggggggaattctggtggaagcagtgcccataactggtgtgtgtcttgcccaccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtggcacctacctcctgggcccggccaaccactgggggagggactccgttttgaggtggtccccagcccagatctaccttagacctgctttgtgtgtcttcagaaggccgcgcttgtggggtctcagtgttcctgatgtagggggctggtgagggttactcagggagtggggaagcactgaggaagtggcatttgtgtgctgcttacttgccacctcctccaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggtgcggcggggcggggcaggggctggcctggggaccaggcaggtgggaggcaggctcatggcgggctctggctctgtcataggcggtggagttcctgtccaaggctgtggacagtccaaacatcaaggcagtggacgaggctgtgatcttgctccaggagatcggtatgtaggggctgggctgggctgggctggggagtggctctcgagggtggtactgacagctgagccgttgcaggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtcagtcctggctccttcctggagccgtccacccactgctgttctgagggggcgttgtctagcccctgcctgtgatccggctgccctcttctcccctcccaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggtcagtcgggcccacacctgctctcctgagcccctcccacccccactgagtttctgtcacctccagcctgtggctaggggctgtaggtccaccacacattctgtctccctaggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgctgcctctgggagggaatggagttcaccaggtcccagcctccttccctgtctgcagctccttgctcagccccacccgtcttttcctccatccctgcaggtgaggcagggcaaggtcacccggcaggggaagttcaagcccaacagcgtcacatataggaccaaatcaggcaacatcctgctgcacaagtcgaccattaacaggtgagggcatgcaggcctggatggggcagctgggatggtccaaaagggtggcctcaccagccctgtgttccctagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtggtgggtgcctgcaggcctcccgcccaccccgctctgcagctgctcctccggggcctggcctcaccacagttccccaccatcttttccattccctcagatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtgaccactgctgtccactaggggctcctctctcagggcctccatacactgggccacggttccccaaagaggaaggaggaaggtaggtagagaagagagtgagatgcttattgctggggaacgggctggctgtggccccaagtcttttaagagagaagggggttggaacctcctcccttcaccaagaaagagcatgaagcagcggtgctgttaaccaccccagtcccctggcacagctgctgctctcggtacccaccacaggaagcctgtcagaactgtcactgtccttgtagttttggacagtaagtaagcaagtaagtgtcaagtagccctttatcaggcagactaggggagagttccacaggtagccaaggcgcagggctatgtggcacagtggtccttcccgtgtccacatccacaagttcacagctgaggggctgagctgagggcaggaagatccagggaggtggtagatgcaaaacgagacagaagcacgaagcctgcgtgatgggacatcaggcagctttatttatttactcttaaaactgttacaacagaatcatggactgacacaggtaatggctgagccataagcaaatcgagaagtacagaaatgtcccaccccaaacagctgcggagtacacatcacacagggcctctggtcccggccttctcaggtgctctggagtggaggatcctttgagggaactctgaccactcctgttgtctacctagagagcacgccacttgggccacctacccccaacctttggccaaaggagtgaaaggacctggaacctgtcgtcaacctcagcatcctcatgaccccaggacagacgcagtggaggcagcaggtactctgggcctgtgctgttgcccctgaggtgtctcctgactacgcaaccctgtttccttcccactttcatcccagcaggccctttcttcctgctgacaaaacactggctccctcatgttcttggcacagcagaagtgttctgcacatggtctctacggaggaaagctggtccccctggcccaggcagcacttcctccgtgagcccctgcagtttcctggtgtgtgcttggggagctagggacatggtgtcaaacctccacaaggcactgctacctcagaaagggggaggacctgtcaggcccaggacagcctccctgcacatggagatcaaatctaaacttaggtcaagacccctaccttctccagggatgccaggaccagagaagggcagaggtcaggagggggcatgaggaggccaagtctggggcagcctcctcagaggcaaatctacactgcagccaatccccctccagagaagcccttggaatctcccaggccatttcactacaaacttatgtttgaatcctttattagaaaccatgcaaactttaatacaaaaaatacaagtgcaataagaatctttgtgtcaatacagttcccgggatttctcctcactgcagccatcccaaggcctagctgggatgccctctgtgggccttgcctctcctccctcccctctccagtcagggcataagggaagcagatagccttagtctcatgccttttatttttaaatttccagacctgatttcctactatctgcatgaggctcccttggacatgagggcttacatgtcctagggtgtgggtgccggcctgaaggaattccatctcctggccctttcttgttctccagccctggctttttatcctagggctgaccaccagatcccagggaatgggacagagatgccaaaaccagcctcttggttagaaaagaaaagcagcatacacacaacaaaatggcaaaaccaaccagtccacgctccaagggccccttgtgtgcctgaccggctcaccagccacagcctctgcacccctcttccctgccgcaccgcctccagggccctaagctgcccacatcctccagcgggggtggcataaggatatctccgccctgttccctctaacacttactgaggactttcatgtagacatggcttcaacctgcagaactattttgccagtttttaggttattagaaaaaaataaaaggacaaaacaagaaaaatgtgacagcagctaggcgggtatgttaagcatggggacaggcagcactgacccccaacttggggcagggcagcaagaagggcccgacaccacctgcatggggaggggggggcgcccatttgtgggaccagagggagaggcagtggcttaagctccacggtcagcgtcctgtcaccactcggaatccacctccactcttccctccaggtagatccagggagaagggagggcatgtcagtttcttttgggtttggaccaaagaaccaaaaaaagatgaggatagaatctggttctcctctcctagatcccaacttagcctcaaccaccccaaccccctcccaacctcctccacggagcagtggcgcagtgatggggcaagaccaaagcagggagatgggcccaggctggggagtgagaggaggtgtggggcagggctgctgctgccccgggcacgcaaagcaggagggaaggcgagcctagcgggctgcccagcacggcgcccaagcgctcactggtctagtggacagcccgggaaagggggccaaggacccgggagcccgagttggggccgccagggaagtgtggggggcgggagacaatgtcggccccgtggtcggtgcgggccctggcatttgcccggaacgtcagcctgtaggtctcaatctgcagtgacatgggaggagggaagggagaggggaacaggggagacaagaggggaacacgggggagacggaagacgagaccagaatgtcatcattagatgcctggaaaataaaaggttacttcattaaaatttaggccacactctagtcaaaaacaaaggagtttcaatttgcggccagtggcagggcccctggctggcccttaggccgagcccagccacttacttgtctcctggatctggctgtccaaggtctgggcctccctttggtcaccaccccctgacagggtggggtggccattgaggccactggctgaagtgggggcgccagcttcaggcgctgcctcagagatggccggctcctccccagcagggggacccggacacagaggagcctcgctgccaccgccctcagtctacaatgaaacagtgggggagacagtgcagggtcagtcgagggggggagtgggatggggtgatggtggtgggtttcacacacagcccccacccttgctgccctggcacccactggctcaaggcacagtcgcttggagaatcccaggcaggtgccccggccccacccaccccacctcacctgggagaccgactcccgagggtcaggagcagctggaccagtgacacactctcagagcccctctgtggcatgtgaggctctgatgaagcctctctgagggcagaggtgccaggcctcaggctggtaccaaagacgtagccatgacaacagtaagcaataagcctgaagggtagccccctgaagggtacagcccaccctcccaaaccctccctgaacccaggccaccccctgcacacagagtggggtcctcagtagctcccgggcagccctgcctgcacatctgtctggtcaggaacacaggtgctgaggccttgtctgtgcggggcaccattctgggaccaggggtccatgggaggcagaaaggtgtccaaggaggtataacccagggacactgtggaggcctggagggcgtcataggaggaggacatttgggggacatggaacactcagtgtgaggaaggcagagaagagagaacagctgcgagaggccactggggagctggaaagcgtgtgtcgccaaatacccaaaaagtgacaagggagaagtggtttctaatcggcatagtgagaaataggcctcgattaaaaacaataattccagaactaataaagggatataatgtgaacaaggaaaagaacacaaggcttagggtcagaaaagcccagatgtgaatcctggtccacgctcgctcgctgtgtccttggaaaagagactaaagccaagttaacgccccactgagacgggcgtgagaacggcatcctcacgaggtatggggggcacgaactgagagcctgtggcagcaaggacccccccagatgttcctggaagctgatcaaggcttcagtcagagcatcaggagaggatgggacaggggacgggctgggcagtggctggcactggggagcagagatggaagggaaggcccagggcagcggctcctggcccctctcccctgcgcacctgaacccgagcagcagcagccatccttgtgctcggggtctgcaagatgcccctcatgggccccccacccacggatgacatggaacataggacagacagcatcttggcacacaaaaggtctcacagtactgtggaaggaggaagggaggaaagaggagagagggaagggagaagaggcccagccagtcgtgaggatgggaacctctgccacttgagctctgtcccagagccctgcagagggaggccccaggcaggccctgcagagggaggccccaggcaggccctgcagagggaggccccaggcagcctgctgtcgctggcagctaagaatgtgctgtcctgctcctaacccaggagcggagcctgacatggggcgggaacccacattccccttggcgcgagacagctggggagaactgtgtggtgcagaacccccgctcgcctgggggtggtctgtgtcccagtccgtggccttctcaaatggctggatgggctcaattaggaaggccatggctctcaggagcaaggttctgcctccagctgacaggtgaggggtggctgggctggggcctcttcacttctgcctcagtcaggactgatgatacacggtgggaaaacggcaatggtgtgggtgaagacatgactcctgaagagactgaggggcggtgacaggtgcctacctgtgaggaccctgaccctaactgcatagttcccacccctccccagctgtgtctccccagtgacccactcgctaccttcacagcacctcctgcaggtaggtggcccacattatcgagggatcccaccttggcctgggccttctccttgaagttcaacttctgactttcaatcttgacatctcctccacctggaaccacaaaggaactggtcacctagggtggcagaggaatatccctgcaggcaaaaccaggactagcgatatgcccaatctagaaatgagacagacgtgacctgttctgggtggcaaatgaagaacagtgaacacgtttgtctaaagaggacttctcatatcacagtgaggctgagacaatctctccgtccagccagtgggaatacctccaagaaaaggaaagccatcccttccaccaccccatgccacagccactgagctgcaggccaggcttgggcaggcctggggctccgagcacagcctccagggcgaagcctctgcttctctactctgtgtgggaatgccctcccgctaactgggccatgcagtgcttctcaggcacagcctcactgaattctcatgaatgccctgtcatcacggccacggtccctgcttcccagccggtaaaactgatgctgcaaaagagaagggactcacccagagttaccaccaatctgctgattgacagtgacaggttgtgaaaattgtctgagaccctaaaccgtaccacactctagcaaaaagaaggaataataaaaaggacagagtggccccgaggctgtgcgctgaggaaggaaagacatggaccaaggcaggcctgggatctagtgacctcaggctaggacggggagggaaagtggtctgaactcacgcccagggttcagagctcactggccagagtgtgcccatgagaccaaggggaagggtgcgggacgagctgccctcaatgagtacccagcccctcccgcgcccagcagcgtggtttcccttgggccccttctcctgttcttccatctcctctcagctcacatggcagacctccacgcacagcttctggccgaggtctcccggtgtcccatattgggaaacccagccctggcaaaaactagaccctaagtgactcagtgtcattagagaaggaagtatctgataggagatttcccagataaaaggggaaaaaaatggttagttaaggacagaactgttttgatctttctaaatagaacacattctaaactggatcatgctcttcgctgagagggaaagggagttttttttttttctttttggagacagaatttcgctctgttgctcaggctggagtgcagtgccatactctcgcctcactgtagtctctgcctcctgggttcaagcaattctccaaaggcatgcaccaccacacctagctagtttttgtatttttagtagagacagggtttcaccatgttggccaggctgttctcaaactcctgacctcaagtgatccgcccgctttggcctcccaaagtgctgggattacaggcatgagacaccgcgcccgccctgagggaagagagttttgccttcaccttatctggcctgtggtggctagccttctgggataccaggtctgccagccagtgtgcctgctgctacagcagtcctactcacaaatctgctgtagacccaggaactaggacacgaggctgctaggggactacccaaggcaagagcccagcctccgcacagcgacttccacaggggcgctgggccaaccatgttgctggaaggaaactgcattagtgcaagttgctgaacgcctcccattctcctgccagggctagcggctgatgcttcactggttgggagcaccctttgctcctgcatctgataggtgggacctgaacactgccctctatacagctccttcagcagtagcttctgtaatcctcgtttagagccaatccaggttctcagctcagagtgcaccacttccccaggcctagctcaatagttccacacacacagtaggtactcaagagaatgcctgtgcagatggctgctgtaagaaactgctcctcctccacttagaggttagcacccgaactcctgctccctgacagaatgaggactgtggtgtcctgggtagtcttcatgggatgctaaaggcacagagatgaaacccttgccagccagctggctgcccagctgacccatggcaggacgacataccctggagacccagtgggcaagggaggcaccactcaccaggcttgtgcttgatgttagccttagacccacacttggaggagaccttagagatgtccactttcttgttctgaatctgaacctgaagagaaggacacaaaagactcattcagagagaaggtatactgtcagagccaaccccatgctaccttttaaatcttctccatgttcagggtttctcgctccctctgtaagctgctatctcagtctggtcaaagacaaggtcatctccctaagtacttaaaagagccctcgacccaccctggccctgctcttcacttccttttttttttttaaagatggagtctcgctctgttgcccaggctggagtacagtggtacgatctcagctcgctataacctccgcctcctggggtcaagcaattctcctgcctcagcctcccgagtagctgggattacaggcgtgtaccaccacatctggctaattttttgtatttttagtagagacaaggtttcaccatgttggccaggctggtctcgaactcctgacctcaggagatccacccacctcagatttccagagcccagagtgttgggattacaggcgtgagccaccacgcctggccttcactttttttttttttttttttaagacagagtttcactcttgttgcccaggctggcacgatcttggctcaccccagcctccatctcccgggttcaagtgattcttctgcctcagcctctggagtagctaggattacaggcatgcgccaccacgcccagctaattttgtatttttagtagagacagggtttctccatattggtcaggctggtctcgaactcctgacctcaggtgatccgcctgcctcaggatcccaaagtgctggaattacaggtgtgagccaccacgcccggccaccagccttcacttctaaccccacctccagccagaccaaaccaccatttccacaccccacaggtctttctgtgcagaccctgtccatgcatgctccagacagctcttctgtcatttcaccaggtccaaacaccagcaccaaggctcccatgaaatatcccctttattccatctcaaatccttacctatcaactccttgcccagagaacctggaataacatatttacttctagtccttttcaatgcattttccccttgggagaggtgagggggtggtgtgtgtgtgtgtgtgtgtgtgtgtgtgcgcgttgtgtgtgtgtgtgtgtgtgtgtgtaatcatagtattcctgcttaatccatgttataacaattttcccagccaggtgcagtgggtcatgcctgtaatcccagcactttgggaggctgaggcaggcagatcacctgtggctaggagtttgagaccagcctggccagcacagtgaaactctatctctactaaaaatgcaaaaatttgcatttaaaggtggtgcaccttggctgggcacggtggctcacgcctgtaatcccagcactttgggaggctaaggcgggcggatcacgaggtcaggagatcgagaccatcctggctaacatggtgaaaccccgtctctactaaaaatacaaaaaaaattagccgggcgtggtggcaggtgcctgtagtcccagtactcgggaggctgaggcaggagaatggcatgaactcgggaggcagagcttgcagtgagccgagatcgtgccactgcactccagcctgggcaacagaaagagactccgcctcaaaaaaaaaaggtggtgcatctttaagtctatagccatgcatgccctctgggttgctggatggggattccagcattcctgtgagcggccccgctgtcctctggtaggtactgtgggagagcctgactttccaacacatcaactccatgcagtgttgcaccattctggtgggtttcaccacaagctgttaaatggtgagctaccttcttgagccctgttttcccttctttggtgtcaggaaatatagtcttcaccatgtttccagaggacagatataatgccaccagtatttttgtatttgcacccacagcccaaggcctggcacagaataactacccacaatccccagcttgccagagccattctcaatctttcctctaaaacttggctcatgcctaacccagcaaacccattatgttttcttccccatccttcaatgcccagctcaaaaggtgccttccatacggcctcacatagctctcgcttcaatccgtctctttctcatatcatctcttgaagggacaccaccaggaactataccataatggcttcacgtgtttgataattacatacagagtagttactactgtgaaaacacacagcctctactttgtctcatctttccaaaaagtctgcaattttccctagatagaaatttttttcttttctcctcaatctatagttcattatacagatatttataggcatctccaaaatggaagtttaggatacagcacagatacctcctcctaagtatgtgctgatgacaccactgtaagtgctttatctgggtttaaaacaaggtatcttgttatttgttaggggaagaaatggccaattcaagaagagggagacatgaagacctcatccaaacatctccctatccttatcccccataagagagggcatagggaagggtacttttaccagccaaagatctggtagctgcttaaaccaacccaacatgggtcttcaagcaatggtgacaagctcatcttagctgtaaccacaacagcacctgcaagaagttaacagtcactctccaagcccagggccctcaccaagatgtagagccacagatttctttcttgttttcttttgagacagggtctcactctgccacccaggatgaagtgcagaggcatgaccttagctcactgtagcctcaacctcccaggctcaagcccctcaagtggctgagactacaggcgcacaccaccatgcccagctaatttttgcatttttttgtagagaaggggtttcgccaagtggcccaggctggtctcgaatttctgggctgaagcaacccacttgccttggcctcccaaagtgcttggattacaagtgtgagccactgcatcggccagggccacagatttctagacagtgttccatatttgaagcctctatctcttgaccttttgtctagtatgcaattaaagaatagttgaggggcagtcagtttcacattatggatgtattccagctggtaaatgaagaagtaatgctagaattagtcttaccacggcatatgcctactgaacccacaggtccaggaattgccaacatcacaaaaaaagagacaaccgaagaatgagacatgaatgtaatttctcacagaataaacctcattacctacttacatgtcatgctagcatgtggggaaaaaaccaaaaccaaataaatttaaagaaaattgagggacaacagaatatgttaattaaaaccatgaggatgtaattagaagaatccagattctaggacaaaccactgagcttacccatcaaggaaattaccagtaaaaaaaagaatgagccaggcacagtggctcacacctgtaatcccagcactttgggagggctgacgcgggtggatcatttgaggtcaggagttcgagaacagcctggccaacacagtgagaccctgtctctactaaaaaatacaaaagttaggctgggcgcagtggctcatgcctgtaatcccagcactttgggaggctgaggtgggtggatcacctgaggtcaggagttcaagaccagcctgaccaatatggtaaaaccccatctctacaaaaaatacaaaaattagctgggtgtggtggtgggcactgtagtcccagttactcgggaggctgagacagaattcttgaacccaggaggcagaggctgcaatgagccgagatcgtgccattgcactccaccctgggtgacaaaacgagactccgtcttttttttttttttttttgagaccaaatctcactttgtcgccaggctggagtccaatggcatgatttcaactcactgcaacctccgactgcctggttcaagcgattctcctgcctcagctttccaagtagctgggattataggcacgcaccaccacgcccagctgatttttgtatttttagtagagccggggtttcactgtgttggccaggatggtctagaactcctgaccttgtgacccacctgcctcagcctcccaaagtgctgggattacaggtgtgagccaccacgcccagccaagactctgtctttaaaacaacaacaacaacaacaacaacaagaacaagaacccaaaagttagcagggcatggtggtgcacgcctgtaatcctggctactcaggaggctgaggcaggagaattgattgagcccagaaggcggaggttgcagtgagccaaaatcacgccactgcactccagcctgggccacagagtgagactttgtctcaaaaacaaaacaaaacaaaacaaaaaaagctgctggctcacacctgtaatcctagcactttgggaggccgaggtgggtggatcacaaggtcaggagatcgagaccatcctggctaacacggtgaaaccccatctctgctaaaaatacaaaaaattagccgggcgtggcggcgggtgcctgtagtcccagctactcaggaggctgagacaggagaatcacttgaattcgggaggcggaggtttcagtgagccgagatcgcgccactgcactccagtctgggtgacagagcgagactctgtctccaaaaaaaaaaaaaaaaaaacctaggtagcccacaccatgaaacagatgtagtttctgacataagagtcctatgttaggaatatatcctagagaaataacttgaaatgttaaagctatttatacaaaaatatgattttaaatgtgttatagtttcatgcctgagggacagagcgagactgtgtctcaaaaaaaaaaaaaaaaaaaaaaaaaaaaagaatggagtggggacttgtagagtaaaaacagcttaagattaaaagagttatagcttgtattatcttattagtgttactattttaaatatatggatcaattttttccttttttttttgttgagacggagtctcgctctgtcacccaggctggagtgcagtggcgtgatcttgcctcactgcaacctctgcctcccgggttcaagtgattctcctgcgtcagcctcctgagtagctggtactacaggcacgtgccaccacgcccagctgattttttgtatttttagtagagatggggtttcaccgtgttagccaggatggtctcgatctcctgacctcatgatccgcctgcctcagcctcccaaattgctgggattacaggtgtgagccaccgcgcccagctatatgctgaagtattaacaaataaataatatatctaggactggcttcaaaatacttgggataggcatatacagataaaccaagactgctcatgtagatagtaaatgaggcagggtaaaaggtacatcaggttcattttactgtttttttctacttgtctgtgtttgaaaattcccacaataaaaagttgttttttttttttttggtttttgttttttgagacggagtttcgctcttgttgcccaggctggagtgcaatggcacaatctcggctcaccataacctccgcctcccaggatcaagcgattctcttgcttcagcctccagagtagctgggattataggcatgcaccactaggcctggctaattttgtacttttaatagagacggggtttctccatgttggtcaggctggtcttgaactcccgacctcaggtgatctgcctgccttggcttcccacagtgctgggattacaggcatgagccgctgtgcccagcccagtaaaaagttttaaaaagcttaactgagcctcactcactttaataaagtccaccacctctaggctacagctctccctccttaggtggctatgtggaggagtctacaatctgcttccaaacgattcccccacaccaccctgcctccactctatgctccagcctcagggaaccatgtgcggcgcctccttcatgggctggcccaagtgtcccctcctcggggactgcagaagccacgctggctctctgtggtcctaggagcaatcacggcatcacacaccttgctctgcttgtgcttacacaggctgcctgccgctctatgagagcctgcaggcacactccaggtaccaaaacatgctgtcagcaggtctcagtgcccactacacatgcacagccccttgcaagggtgaaatggaaccaaaacggacacaaaatcttaactgggaccagccacagaagaagccactacattggcactggctcatcactcccctccctcccctccgctggtgtcctcctggctctcatcaaggggtatgtctgtctgtctgtcgggggcatttttggagcactaactaggatcctgtttggagcctctcatccctgtggtaactgcgttatttctgtgtgtgtgtgtgtgggtgtgggtgtgtgtgtgtgtgtggggagtggtggggggtgtaatgctgttctgtctgcacagcaggtcctcctcccttttttttcagtgtctctctctgtcacccaggctgaagtgtggtggtgccatcacggctcattgcagtctcaactacccaggctcaaggaatcctcccctctcagcctcctgagaagctggaaccacaggcacatgccacctaatgctgccaggcacatgtctaatttaaaattgctttgaaacccaggctggtttcgaagcaatcctcctgcctgggcctcccagggccactgtacctggccttattttaaaagatattttttttgggactgggcgcagtagctcttgctataatcccagcactttgggaggccaaggtgggtggatcacctgaggtcaggagttcgagaccagcctgcccaatatagcaaaaccccgtctctactaaaagtacaaaaattagcccaggtgcggtggctcatgcctgtaatcccagcactttgggaggccgaggcgggcggatcatgaggtcaggagatggagaccattctggctaacatggtgaaaccccgtctctactaaaaaatataaaaaattagctgggcattgtggcgggcgcctgtagtcccagctactcgggaggctgaagcaggagaatagcatcaatccgggaggcggagcttgcagtgagccgagatcgcaccactgcactccagccttggtgacagatcgagactccgtctcaaaaataaaataataacataacataacataaaatacaaaaattagctaggcatggtggcaggtgcctgtaatcccagctactcgggaagctgacgaaggagaatcgcttgaacctgggaggcagaggttgcagtgagccgagattacgccactgcactccaggctgggcgacagagcaagacttttttttgtagagacgggggtcttactatggtgcccagctggggggctcatcattttaaactgcacatttccttgtggtggctttagggagggactgacagagattatggaaggaaacaaagcacctgggtccagctgtggtcagctgttgtttatcctcatcttcccaccaggaaagatggctcacagtagtctccctaattctctgtttaaggaagcctcctaaagtgaaaaggctttaaaaatacattcaccctcaaaacaacaaaacaaaacaaaaaaccctacacatgtgaggtcatgtgtaggcagtgtggaaagatcacagcaggtgatacattaatgatgactattttcagagctcttatatgcaccacacaacacacacaaatatatctctatgtctcacctacacaagtgacccagttccctcagaacccctgttcaccttctgttttcatccaggacaaagccaggctcagcagctgcctgggcccctcgtgggctggatctttgtcacctcacttcagctgatcctattccaggctgactaattagtctggtcaagcaattccacccgagtgtaaaggatgccatttctacccaggccaggaagaggcagtggtgagaagatgaccaggaaggaggggcaggaaggagttgtgtggggcaagaatgaaagctcatggccgcattcctcatgatacaactgctgggggtatctgtaggccatgggcaggatgtcatgatcaccaaggaggaggcaggagtgttaacagagtctaaaaatgataagggtaagtggagcaggacctagtccggttcaggacagtaaggagaaagaaccgaatgaactcaaaagaaacggaggcaagacaggctgtctcacttggcctggaagggagcggtgagggcaggggctgtacatggcggcttctggtgcctctggcacaactccacagagtaccacttttctaggcactgtcacagtgacaagcggaaagcacacagggtgttcttcacacactcgacgatagtaagacttcgccctgtctctccctagaccagaacctccctgtgagctgggatcacctgtgtccctaatacacatcatagagctggcacacaatggcagcaagacaaaaagaaggatgtttgggtggaagaggaaagaggacaaaaagataaggagggaaagtctgggcgcagtggctcacacctgtaatcccagcactttgggaggccaaggcgggcagatcacaaggtcaggagttcaaggccagcctggccagcatgatgaaaccccgtctctactaaaaatacaaaaattagctgggcgtggtggcgcatgcctgtagccccagctacttgggaggctgaggcaggagaattgactgaccctggtaggtggaggttgcagtgagctgagatcacaccactgcacgccagcctgggcaacagagtgaactctgtatcaaaacaaaaacaaaacaaacaaacaaacaaacaaacaaacaaaaaaacaggaaaagggactaaaaaaggaggggaagaaaaaggaggaagggattagaaaatggacaaaaaaaaggagagcagaaagggaaatgggagggccgggcgcagtgtttcatgcctgtaatcccagcactttggcaggccaaagtgggtggatcatgaggtcaggagttcaagaccagcctggccaacatagtgaaatcccgtctctactaaaaatacaaaaattagccgggcatggtggcgagtacctgcagtcccggctactcgggaggctgaggcaggagaatagcttgaacctgggaggtggtggttgcagtgagctgagatcacaccactgcactctagcttgggcaacaaagtgagacttcatctcaaaaaaacgtggggaagggataggaagaaaatgttgattaattcttattttataataacaaggattcaaagatgagctctggaaagatccatccagacatctgtctcagagaagttacttccacggtaattcaagggcatgcagaccgacatacacatcccaggaacggactccagacaggcaacaggtctgctgctgaccactgtgctcagacccaggctctgacatagctggagaaaaatccaaagcctcccacccatatgggtaaaaagatactgagtggatatcaccatgctggtgtttaggggctcaccagaaacaccctgtctaacatgggagcatcaaggtcccctcactttgctagtctgcttcttacagaacgctacagctcaggtcactgggattctatctacatgggcacctggctctctccctagtataccccacagtgggctatatctcagatgccagctaaccagagcttatacttacattaccacctccagggacatgcttaatattgtccttggaaccacacttggactgaatatggctgtagctcacttttttggagactatctggacctggagtgttagaaaatagaaaaaacaacacaaagggagaggactggttagaaccgacacagggaaggcagtgagtccacacgtgatcacaatgaccaacaaaaagtgttgttaaacctccacccccaccttctacagaacagatgtggaaaagcacaggaaaagaaatgtgaaagagcaagaaggggagtgaaaaacgtgaacagacaacacaacgacaggagcagagctgcgcaggcactgcatgttggtcatcaccgctcctttgggggcggggttgtggttcacaaggcccaggcagcagcctaacctgatgcccaaccaggcacagccctacctccttgctctgctccctcctcaagagctgggcacagtgtccttggctcttctctgcaagtcttatcatgtggacctgttctcacccaaagagggtgcttcccttaaatctgggccctggaatggctgcagccagacccactctcagaagcaaaggctgctctgagaagcactgggcagctggcaacaagggcacggatgatactaacaggaaggaggggccagtgctcagatgtgcatacaaatggatacagaatctccaacaccaggggagcggctacagcctccacacttagcccatttgtctcagggctcgagaaggcatagtatttttgactcaagggtaaaataccttcttgaatcctccatatgcctaatcctctgccctgtgagatgcccatgcggaaagaacaggctctaagcagggcagcaaggacgcccaatcctgggggcacaaccacactgtatagtacgggaatggcttcccctggaactgagaaacaccaaggccctggctctaagagtctggaacaaagaatcctaggaccttctcaagaaggaatagttgccaacttcctttctttgcaaatgatgcaggtcccaggctgaagagttctccacagagtacagaaatcctgagaaactccaacccatatacctcattgtacctactcatttctagcctttttcacaactttgatggtaaccaagtggttagcaaactacttaatgagccttggtctgaacctaggacctctagtagtcacccagaagccacggtgcagctttcttcactgtaggaatgccctaggctgagacttcccatgctggtccctaagggctggagtgcgggcttctctggcagaggcacacctacctgctacagctaaggaaggtaggtgttgcaagcactcaggaggggcctggtttccaggtttacagaggcaaggggaaagaacctgtggtttcagcttacctctgccctccagttgatgctgcatacctatactaagtgggtttccattgggaatgagcatcctaactttcagttaagaggtgacccggggaaccaggacaaatgaagttatctccatacccagcagcgttatgagagggatcttctacttcaaggtaaagcacaggggctccagggttccaggtggtggaaattacccctgccatgtcttcttgataacgaatgtgggtgcactgtatttgcatccataccaggtaggtttcacatcaaggtcagtgtgaaggaaatgaatgaaagtctttggatccattttatccagccaaaaattatacacatatgtattctccaaagggctaatgggctcccaactctattaactttcaaggttaatacaaaaaattttctgatggccgagtcatcaagcacagagaagggaatataggggagaagaagtagaaactagttagggaaagggaaaaagtgcaagagagggcatgtggctcaggctggaagaagtattttaccatcttcaccttgcagaggtgggtctaaataaaactcactttccccgcaggttgtttctgtgcacttgcaattgggccggctgttttagtgactgcattagattcaggctttcgggttgtagcagctgcctctgtttttttctctactttggcctggatggagataaagggagggcaaatttcaaaccaagaggataagagctcaaaagccaagaagggaagaaggctgtaggggactcaaatccaggtcaggccaccaggcaaaagcaggtggcctttgatcctaggcaaaaccatacatttcccagggtagaccaagtcaaagatccttgagtagaggaccacaaaagaaggagctgcaggccatagtcttaagacatgaggaacagatcaagacactagctaatgaagaaaaggcacaaaggaaggctaagacaaccaaattagtgattctgagagtgtgctggggcatgattttccaattacaataccccccaccccatgccaaatgtcctgatatgccccaagcagctgccacggtcacaggaagtcaatactgatagaaagtgtcagactctttaggtatgttgaagcagaaaacaattcactagatcaagtcactcaactccccacccaagaactcctgtaacttttgcaccatgaaaccataagagcaaagacggggagataggccatcagcagcacagcccagaggcctgctgggcacaccagagccactgtcgctaccacaagcaactctcaggctcttctctagactgatctcagcttgccatcagtgtcttccaacagcaccaggattccacctcatttttgtccctcctgaatttcttaacagctccagattaagcaatttaagtatgctgccctggatggtggtggtggtgtagagctagtgaatgacctaggagatgagatggtcactactccagggacccgaacattctcagacggactttcatcaccaccttttcacgcagagttcccatggttaccaacagttaaataattctgggactgatgcaaccagaaaatcttaaccaccggaaaatcctaaaagtgaagcactgtgatctttctccatcactatatgcagtgcagtcctgctgtttaggaaggccagaggctcacagcacgactcatcctggccataagaggacaccctagtcctctttcagatatattccactcaagtcatgggttgtggaagtaagaggtgttctaccttctgcctatcctgacattctctgtgcaggctaagaaccatgaaaaactaggctcatgtcaagtgtctctctcacttgcagagtctctgaggcctcctctgtttcttctacaaaagaatccttttacatccaagcaaaaatgtaaactcagaccccaacatctagaacaggagcctttcttactgagacaggaagagaaagcccagagctcagcctaccccgcctccctgctgctggggcacaaaacccactacagagccccggctgaaataccctgatgctgagtccagtgtcctgactgcctgcttctttggtgggcctgggaacagtgggtggaaatggaggggaagatgcaggggccagcatgccaggaccccaagctccctggacccacccggcctcctccaggctgatgcttgatgttttccgtggagccaaccttggagcggacattcttcagatcaggagcagaagtattggtggccaggcggctgagccggggggtggtggagctgggtttggccgaggtgggcttcttgtctatgaaaggagttgtggagggccgggagggcatgggtgtggccttgactcggctgggaaccacccctgcagcgggggctgtcccactgagagtggtggttttcttcatggaactggtggaggtgctctttgggcgactcaagtcagctgcaaagaagggagtgagagataacacgggttcagggagagagagaaaaagggagacttaagccacagaggaggtgggggttcaagttagggctctacaaaatggcggatgggctattacctggtacagactttgcagtcatcttcttgacttctgcaggttttccctcagtcttaatggctgtacaaaatatacttattaatataacatttaacaaactgacctgttggatagttcatccaatagtgagattcctcattatttaacaattactgaatatctactttgagccagggactgtgttagtccctgggaatggagtggtaaattagatggtcaggcactgagtcttattcttctctactgccctgataagccttctatgtggccttaaaagtaggctgtcaatacatgcctatggacttgaatagccctcttcttatcatcatgtaagcccatgagcaccacgccctcttcttatcatcatgtaagcccatgagcaccacgtgctaggtgctgtgggttactaaggcaagagtaaattctacctggaaattcatgagcagtacatttttctgccttcactcaagatttttctgaatacatacaactgctaagctcacacagagatcaaggcttgttaagtaccaggcccacagggctaccactgttccaggtagtccactaaggaccggtgcgtaagcaggcctgcacagctgtttgtgatactagctagagctatggctggggcaaagccaagatcccattttcccctccctagttcccatgggagagaaaggcaatactcaccagtgggcttcttgggcaggagcgtggaggggctcctactgcttgggccagttgaggcaacagcagcagctgttgtggtttttgcaacagtctgagtgctcttggacccagatctggaggctggggcagaagctggcttggatggtgaggcccgcttctcaggagcctttgcatctgcaatgggctggaaataggaaagtgggaatgaggcctgcaggtcagcaatagccccaaggagtcacgctacaagatgcttctttttttgtttgttttgttttgtttttggagacgaagtctcactctgttgcccaggctggagtgcagtggcatgatctcggctcactgcagcctccgcctcccaggttcaagcaattctcctgactcagcctccagagtagctgggactacaggcacgtgccaccacgcccagctaattttttgtatttttagtagagacagggtttcaccgtgttagccaggatgatctcgatctcctgacctcatgatccgcctgcctcagcctcccaaagtgctgggattacaggcatgagccactgcacctggacacaagatgtgtctatacaaccatgtattggagaacaggaggtactgtgggttcagcagctactgacaggaaaatacatatggttctaagagcaaagtcctccacataaagcaacaaactggccatgcagggtgctatgtgatctgagggcacacaacagagagtaaaactacttcaatccaacttgagccagtgagaatgaacagccctgatgggtacatcaccacaacctacgtttgcctccaaatctactgctatatatatcatacacacacacacacgcatatattttaatgtaacctctgtagaaatgccaaaaatactaatgtatttaatgtaataaaatctaatgtattatacttgaccaaagattaaacatacacaaacaaaaactaaaaattatgttcaaatcgagccattcttttggctaacacgcacctagagaatgctgaacaggactgagctgcagatggagaggccactggccaaatctgggacagaagcgtgagctgtagccctactccagcaaatcactgagcctctgagctttatttcctcatcgggataaagagattagaatggagggtgatgaaggaccagctttgataatatgtgatgtcaggaaataaaggatgaaaggtctcagcacagagacgatgagaagaggcaggcctgatcaacagaagggataaaaagcactgatatcacagctacagtctgaaagcaaaagggaaaaagtctctcaagtatagatgcttggcatctgggtcactctagttccttttacatggaggctgagaatgacgtctctagtgaataagggaaagaatcagtttagcctggtttctacggggataggggatgaagacactattttgataaacaaattaccacattacaaaagagagtatgccaaatcacagacacagtgggctcagctctcttcctccaagagaagtggctataaagagggcagtatgtaggtagcgacaagcaggatatcgttaaatggaaaaatcagctaaggaggtactagaaattaagggctggcatccaaagtctaactctgcaaatgtagggtaatgacaatttccacaaataaaggccttaagtatggtgtgaagaacgctaaggctggaatcagggaaagtggttctgctaccagctctgctggaaacatgtaggattttggccagaggattcccttttctattgctctaaaatttgaggactaaaccagatgctctctgggatgtgcatcaaatttttaagactatgactattattcagaataatctagcatagtcttattattttgccatgagggtaataatgataaaataagttagaaaaaagttatgtgggatagaaatctcaaaaggatgttgcatcttttagatgtcaggctcttggcttcaaaaacctgcagaagttaactggagctattctgctgtttcccaatttacattttcttctctgccagaatcgtaatctacttattttttctgaataggtttttctctctctgtctctacaaatctttctaccaaaataagctgcagatgaagaggccactggccaaatctgggtcagaagcctgagctgcagtcctggtttggccccttaattctaagtgtgctatttggcaaatcgctgggcctctctgagctttatttcctcatctggataaaagagattagaacaggactggcgcggtggctcatgcctgtaatcccagcactttgggaggccgaggcaggcggatcacctgaggtcaggagttcgagaccagcctggccaatgtggtgaatccccagctctactaaaaatacaaaaaattagccaggcgtggtggcgggtgcctgtaatcccagctactcgggaggctgaggcacaagagatgcttgaacctgggaggtggaggttgcaatgagcccagattgtgccactgcactccagcctgggtgacagagcgaggctccatctcaaaaaaataaaaattaaaaaaaagttcatgtatatacagcaactagtacactacacttcatttatatgattattatagagtgaaatttcactagacacctctccttcctactctcctctgtcaccccccagaagccgctgctgaataagcaacagggaggacctgctgccagggctccaggcacctcccctctgccctcttattcaaacctattgttttctaaagatcaagaaaagcaaccaactggataaatgaggatcagagagaaagctttacaagattttatcattactagtttatgagaggatttttcagtttcttggccagggcttcagcctagacttcaactcctaggttccacagttttcttcaccatattaaattaaaaactgacattttaacatgggaaactatttcgtaccatgaatttaaagagtactatcaggctgacctaaaggcccttctcaaataacacaagatgttaaggaatgcagccacagcctccactatcctctcctcctggagcaattctgtaacactaatgctgctccaaatgtgaccagtttctgggcaatacagaaaccgtgggtgacctggaaaactggatgacttcagaagtagctcagtgagaggtggcctaatgcccaaagcaaagtaagttatcacatcatgctggaacatgctgagataagctggaagaactagttatatcacaatagtaatggataaaacttctgcaggatgataacagggaaagacaaagaattacatttgatgtgggaattataccaaaaaagaatatctaactggtatgtggagtagaggaaactggttaataagtgcttaaataggtaaagagtaggtagctgagagaaaggaggaagaacctaagtagatagagtattacctccaaacagggaagggaaaggtaagagcataaaagggcttcaaaatgttaatgtctgcatcaatgggccccaaattgatttccttttcttttttctttttttggctgctcctcgtggagcagggctaacccataggcagcgcgtccagagtagccatgccaattttcaaatcaccctctcccccatttcccttgccttttcccaattccaccagcctgattctgttgtctgttagcaacaaggatctgtctatctgacactcagaggggaacaattttcctcggcacagtagttaggtgaccacttacctttggcttcacgtcttttgaaggtaagatggaaggcctggcagaggcgacggcagggcgtttgggtggggcagctggcactaagcctgaagcaaggctcatgggttttttattcaacccaccaatggtggtgggagctggctgcttagggagagaagtgggctgtgttttggctttcgatgttgaagtctttgcaggttgagtggtggccaaaggctttaggttgattgttgtttattttttatttttattttttaaagggcaacatcaaacagacaagaataaaaacaaattaaaaaaagtataaattgcacaattcaaagtaaaattataagcaatgaggatagatgcaacttaaaattagcatttctttcttctgagctcaataaataatggaatgaaaccaggatagagaaagaaaatggggaatagtttctttttctttttctttctttttttttttttttgagatggagtctctctctgtcgcccaggctggagtgcagtggcgatctcggctcactgcaagctctgcctcccaggttcaagcgattctcctgcctcagcctcccaagtagctgggactaccagcgtgtgccaccacacccagctaattttttgtatttttaataaagacggggtttcaccgttttagccaggatggcctcgatctcctgaccttgtgatctgcccgcctcggcctcccaaggtgctgggattacaggcgtgagccaccgcgcctggcctgggaatagtttcttaatgatagtggcacaaattctggcagtttggcacctgaagatttaattcagtaaaacaattaactcttaataattaactaacttttggtggctattctaaaagaaaagcatcaggaggtgattcagccattattacctgtattttttttaataactttttaattttttgaagaccctggacaacatgctgaaactacctgtatcttgatgggacaatagcagccacagcctacagtgtggcttttgaactttgcaataagtactagttatgcatctgaagctatatgatccaccttcaaaatctgcattctcttttcatgaatggatatttcagaatctttttttttctttcatctaacgctgagataatagtaaataattcagaatttatttcagaatatttttgcaattgtcctttttgttgttgttaagggaagttgaaacaatctctacagaacttttttttttttttttgagatggagcccagtgcagtggcatgatctcggctcaccgcaacctccaactccttggttcaagcaatcctcctgcctcagcctcctgagtagctgggattacaggcatgcatcaccacgcccagttaattttagtatttttagtagagatgggatttcaccatgttggtcaggatggtctccatctcctgatgtgatccgcccgccttggcctcccaaagtgctgagattacaggcatgagccaccatgcccggcctctacagaacattttttacagatatataagataatagggtcaaaggctgagattttaaagttggtttaggccactgtggtaaatgagaatacaagatattttctaagcatgtccaaacatgaggaaggacaataacagctcagaaaaaagaaatttcattcgtgattcaagcaataacagcagaagatactccgtttaaaaattatggcagtagaagataaccaccattctggcacctacctttgttttcttctctgggcttggtgggagctccttgttcggtggggtggtgatgtcatttcctgtcccactcaccacaggccttccttcttctggcctggctattcctaaggggagagggtgagtgggaattatgctaagcaaacattttacatgcccattttgaaaatacaaggtttagcaaagacagaccactaactagcacttcattctgaaaaaagtccacagggttgtgctgctgaaatgtggacaagcctcccaagttctcattgtgatggaggacagttttagattcctcagattcagagagcctgaccctgtggagaagcagtctaagggacacatgcacaaatgatcagtggaaaaaaatggtcctttaagtttggtttcccttccctagagaccaaagggactctgtcttccaaccactagctctccaagcaataggacaaaaacctcttctaccagtctatctttggaataaaggttgctgtgagatgggataagagccagaagatcattcaatgactccctttccttcctttccctataaagaaccactttatggaggatgtgagattaacctgatccagttctaacagtgacccagattttcaacaaggccaaggagacccatggaaccagactcagggccagaaataaagtctcctgcctaaggcaacatagcctcctctctgtggagaggttactctggatttcaataggactatacctgagagcattaaaatactgtgaaatgtataaccttgctgtgggggaaggcatttctaactggcacaaagtcaagaggccacaagagataagtttgactaaagaaaaataaaaaacttcaatgtggcaaaaaacaaaataagacaaaacactataataaaagtcaaaaggcaaatgacaaacagaaaaaatacttgaccctcataccaaagacaaagagcttattctataaattactcccacaaatcagtaactgctacaaaggccaataatccactgggaaaatgcaaaacaatatgaacagactttatagaaaagagatacaaagttttttgaaactatgaaaagatgtacaatgttaagtataagaaaaataaaaaaaccccactgaaatgccattttattttttgagacaaagtcttgatctgtcacccaggctggagtgcaatgctgcgatctcggctcactgcaacctctgtctccccattcaaacaattctcctgcctcagcctcccaagtagctagattacaagcatgcaccaccacacccagctaatttctgtatttttagtagagacagggtttcaccatgttggccaggctggtctcaaactcctgacttcaagtgatccacccacctcagcctcccaaagtgctgggattacaggcatgaaccaccatgcctggcctgaaatgccattaatattaacatattgtcaaaagtcctaaaattttaaaataactactgagaataatatagggaaatatacttggtaggtatgtgaactgtatgacccataggcagggctgcctggcagtgtcattttctgaaaattacaaggacagataaattctaatctagaaaaccaatttctagtaatttatcctagaagtgtatttacacaccagccaaatagtaaatgtgcaaggtttccaccagatcattgtttctaaaagcaaaagaacaacccagaagtccgttaatagaaaactggttattatggtagaaatatcaatgtaatctctgaatgtgaaaaaataaagcatggagaaattcttttatgattactatgcaatggtctctattaagtgaaaaaaaaaacaacaaagcataagtataatgtgaaactatttgtcttgaaaagggatgagggaaaagatattgcaaatacacttatatatgcattttaaaagaatttttgaaaggattgtaattaaacagaacaacgtttttgagggaaaggatgggacacaaaactggggaggttaggaggcttaaaactttgagaaataattacagattcataggaagttgcaaagaaatacatagggaaggtccctgtgtacccttttacccagtctccccaagtgttgatatcctacgtaaatacagtatactatcaaaaccaagaaacagagacaacccacagagcctactcagatttttcactttacatgcactcatttgtgtgtgtgtgtgtttgtgtgtgtagtgctatgcaactttatcaagtgtagctttgtgtaaccaccaccaccaccttagcctcccaaagtgctgggattacagattacctggcctggagtggctggttacaatcaatagggcttcttcatgttacccctctatagccatatctaccccatcccctttccaatccctaaatatatggcaactactatgttctccatctctatagtaacttccagtacactatatttaaaagagtggtgcaagtagatatccttgccttgttcccaatcttagatagaaagtattcacttattcaccattaaatatgatgttagctgtaggctttctgtagacgctctttgtcaagttaaataagttcctctctattcctactttgctgagagttttaacatgaatggctatttgattctgttaaacgatttttctgtgtttacaatttattttcttcagactataacagattactttttttttttgagatggagtctcactttgtcgcccaggctggagtgcagtggtgtgatctcagctcactgcaagctccgcctcctgccattctcctgcctcagcctcccaagtagctgggactacagtacccgccaccacacctggctaattttttttttttttttttttttgcatttttagtagagatggggtttcaccatgttagccaggatggtctccatctcctgacctcgtgatccacctgcctcggcctcccaaaatgttgggattacaggtgtgagccaccacacctggctgacaattacttttgattattgcactaaccttgtatacctgaaataattccaatttcagttttttttttttttttttttttaagagatgaagtctgttgcctaggctgcagtacagtggcatgatcacagctcactgccacctggaactcctgggctcaagagaccctaatgcctcagccttccaagtagctgggactactggtacgtgccaccatacctgaataatttacaaaaaaaatttttttgaagagatggaggtcttgccatgtggcccaaactgaccggtctcaagcagtcctcccacatcagcttcccaaagtgctgggattataggcacaaaccaccatgccccatcataatttcaatcttttaaattgattcaagttggttttatgacccaagatccatcttggtgagtgtttaatggacacctgagaagaatgtacattctgtcactgagtggaatttctatcaatgtttatgagattttgttgtttgatggcactgttacatctttactaacattctgtctagtagttctatcaactgttcatagtgggttacagaagtccccagctgtaattgtgactttgtgtacttctccttttagctctgtcagtttttgtttcatatatcttgatgctctgttttttggtgtgtatacatttagaattgctaagttttctaaatgtaaggatcaatcttagtgggattgatcctttattcttttctccgacatctactttgtctgatgttagtatagtcactccaggacacgtaatctttaatcccagcactttgggaggctgaggcagaggatcacttgaggccagcagtttgagactagcctgggcaacaaagtgagacttcctctctacaaaaatcgaaagaaaattagtggggcatggtggtgtatgcctataagactcagatacttgggaggctgaggtgggaagattgcttgagcccagcgagtcaagcctgctgtgagctatgatcaggccactgcactccagcctgggcaacaagaaaaaacaactatatatatatatatatatatatatatatatatatatatatatatatatatgcataatcattatatatagctactgctactttaaaaaattgttaacatgatatatttctttccatcttttaactttcaacctacctatgtccttatgtttgttatgcatttcttgtagatagcatatacttgggcaatttttttttctttttaagacaggtgtgatcatggctgactgtactcactgtagcttctacctcctcggttcaagtgatcctcctacctcagctcctgaatagctaggaccacaggcatgtgccaccatgcctggctaatttttaaattatttgtagagatggggtctccctgggttgctcaggctggtctcgaactcctaggctcaagtgatccttctgcctcagcctcctaaagggattacaagcaggagccgctgtacctggcctacttgagtcattttttaaaaataatatactcttccaatctttgtcttttaattgtagtactcagaccatttgcttctaaaataattcctgatggccaggtacagtggctcacgcctgtaatccattcagcactttgggaggccgaggtgggcttatcacctgaagtcaggagttggagatcagcctggccaacagggtgaaaccccatctctactaaaaatacataaattagccgggcgttgtggtgggcgcctgtaatcccagctacttgggaggctgaggcaggagaatcgcttgaacctgggaagtgaaggttgcagtgatctgagattgtaccactgcactccagcctgggtgacaagagtgaaactccatctcagtaaataaaaaaataaatgaaataaagtaaaataattactgctatgttaaggcttaagtctgatattttattttttatttgttctctctttttctcatttctgtttcactttcctgccttcctgttggttacctgaacatttttaatctttttaatttccttttttcattttttcaaattacatctcacccaaggttacctgaacatttcttagaattctatttttattaaaaaaaagcttttgagtatattgctctgtatagttttcttagtggttgctctaggtattacaatatacatacaacaaactggtatcaatgttctactactgttttttcctctagagatggggtctcactgtgttgctcaggctggtctcaaactctgggctcaagtgatcctgccgtcttcagcctcctgagtagctgggactacagatgcacaccgccacacccagctatgttttactactttgagtgacctactggaaccttacttccatttaggatcctttattttctccctactttaatttttttttttaaagacagagtctcactctgtcgtccaggttggagtgtagtggcacaatctcggctcactgcaacctctgcctcccaggttcaagtgattctcatgcctcagccaaccgagcagctgggattacacgtgtgcgctaccatgcttggctaatttttctttttatctttagtagagatggggtttcgtcatgttgcccaggctggtctcaaactcctggcctcaggtgatccacccaccttggtctccaaaagtggtgggattacaggtgtgagccactgcgcccagccctaaaatatgtcttaagtgtttcctcttcatagattaagcactacatcagatggcattacaatttgtgcttcaaatatgatttatgactttaaaaaattcatgaggagataagtctattatattcctttttttttggagaccaagttttgctcttgttgctcaggctggagtgcagtggcatggctcaccacgacctccacctcccgagttcaagcgattctcctgcctcagccttcctgagtagctgggattacaggtatgcgtcaccacgcccggctaattttgtatttttagtagagacgggggtttctccatgttggtcaggctggtctcgaactcccgacctcagatgatccacccgccttggcctcccaaagtgctgggattacaggcatgagccaccatacctggctatttccatatttttacccattccattgttgttcttttatttctgaaattccaagcctccttctgttaccaaatcttatttttttggagagcctcctttagccattctctaagggtatgtctactagcaacaaattcttagttttcctttatctaaaaatgtcttttttatttatttccccttcattcctgatggattgttttaccaaataatttgcagttgacagttcttttcttttggcacttgaaaaatgttgtgccacttctttttgcattccccagtttctgataagaaacaggctgtcatttaaatgctgtttcctcagcaccataaggaaggttaaaaaaaaaaattgctgtttccctaatgcatcatatctctttgctttttttacagatttttgtctttagtttataaaagtttaattatgaaaagtcatggcatgatttctccacatttatcctatttggtatttgttcagttgcttgaatctgtaagttttgtcttttgtcaaatttgggatgtttgttgtcattatttctttgaacagttgttcagccttgcatccttgctcctctcctgagattctgatgatacaaatgttagatcttttgttattgtcccatgggtctgaagatatgttttttccttgtagaccattttttcgtctgttgttcagattgaataaatcctattgatctgtcctcaacgtcactgattctgtcctctgttatctgcagtctgctgctgagcccattgaagtttttaattttaattattatatttttcatattgacaattaacatttggttctttttatgtaacttctatttctttactgaggtttttagttttcatttgtttcaagagaattcataattgcttgttaaagcacttttatgatggctgctttaaaattctgattttgtactttagcatgcaatcaccctgtttatatttagtctacaggttatgactgtagttctgatgacaatttggttcctagagcccttgcaatgcatttatggcctgttgtgttctgattctgctaaggttctaactaatcccttttggtactgcctgaaagggctgtagggacttacctgtgtcacccagtgtcagcacataggggctgagtgatgctggaaacatagaatagagagcttcctctggactgctctctggctgcctgggacccaggcagacctcctgtttgatctctgctggggttgctgggagcaggaaacacctacctcgggggctttctcttgctaaggggaaggaagtagaggttctgaaacctacgaaagtctcctgcccctgggtagaggattacaagacaccagggctatagaagccactggtgctgttacctggtaggggacaggcctccctgcagttgctggtgatgtgggcggaccaggcctatagcttctgctgagtatggagtggacaacaggaaggcccttatgggctgcattgacactgtacctgcaggcagactgagcccactgctggggatgggtagtgaaacagggctcaccattaggtctttgctgggtttttttctttcttgtttttttggcaatagagaacagattttctctatttgttttcttttttcctttccttttcttttcagtctatgcctgttggtaattccaggttacaggcctctccagtgcccagccagggatatgtaggagacaaaaagaaaacccaggggatggacgcagtggctcatgcctgtaataccagcactttgggaggtcaagcaaggaggatcacttgaggtcaagaggtcaaggctagcctgggcaacatagcaagatcccatctctaccatcaatcaatcaatcaatcaatcaatcaatcaattcatcagtcccagggaattcactgtattgccattcctcaagtcctgagatccctaccaggtttgccttctttctacctcatattcttttatggaattatcttcaattatttccagactatttagttgtatttacaggggaggagcagaaaacaatgagatgataccatcttgtcttggtaggaggtttttgtaatggagagcactttgtactttttgatgtttgaaccatatgtacttttagtcaaaaactgagtatttttctagttttaaaatgtaatggggaaaaaccatagccaacaactgtgcaaatttgttaacgcctttgttcttttttttttttttttgagacggaatctcgctctgtcacccaggctggagtgcagtggcgccatctcggctcactgcaagctccgcctcctgggttcatgccattctcctgcctcagcctcccgagtagccgggactacaggcgcctgccaccacgcccaactaattctttgcatttttagtagagttggggtttcgctgtgttagccaggatggtctcgatctcctgacctcatgatccgcccgcctcggcctcccaaagtgttgggattacgggcgtgagccaccgcgcccggctaatgcctttgttctacagcaagctcaaagaagatcttacttgtgtaactagctgccactggccccagaccactataaatatttttcaataagttcagcatttttcagtaaacaacatatttcataaagtcgcattgtctatgatacaggcatgcagtaactcgacctatacaaataaatgtaactgtgcataagcagaaactgctttctctctcccagaaggtagttctcaccaagccctttcccttgtctcatggatatataaggcaacttcttttttgttgtttgttttgagacctgatcttgatctatctcccaggctggagcacagtggcatgatcttggctcactgcagccttgtccttttgggctcgagcaatcctcccacctcagcctcccaaacagttgggactataggtacatgccactatgcccacctaatttttgtatttttccatagagatgggttttttgccatgttgctcaggctggtctcaaactcctggcctcaagtaatctgcctgccaaggcctcccaaagtgctgagattacaggcatgagccaccaagcccagctatcaggcaatttctagagaccaccacccacatatccccagagtttcacaaaagcaatgtctgatgtggaacttactaactccttcaatgaactgtgctcttctgttgggtctttccattacctatactaccactggctgggaaaaccagcctcacatcacagcatgaccttcaattcctttttctcacacaccttccaaattccagtttcactttatcttcacctgttatatttcccctctcatatcctcagcgtttcatctgccactacctgaatcaaatttctaacaggattgtttgctttcaactctttgtcttccagttcatcacacttactgagaacaagtaaatcttcctaaagctgacctggagctactttatctgctatcataggcagtcaccacagtttcagaacatggtagtgagaggtgacagcgtgctggcagtcctcagagccctcgcttgctctcggcgcctcctctgcctgggttcccactttggcggcacttgaggggccctttggcccgccgctgcactgtgggaccccctttctgggctggccaaggccagagccagctccctcagcttgcagggaggtgtggaaggagaggcgcgagcaggaaccggggctgcgcgcagcacttgcgggtcagctggagttccgggtgggcgtgggcttggtgggccccgcacttggagcagccagccagccctgctggccccgggcaatgggggacttagcacccgggccagtggctgcagagggtgtactgagtcccccagcagtgccggcccataagtgctgcgctcgatttctcactgagccttagctgctttcccgcggggcagggctcgggacctgcagcccgccatgcctcagcctcccacccctccatgggctcctgtgccgcccgagcctccctgacaagcaccaccccctgctccacggcgcccagtcccatcaaccacccaaaggctgaggaatgcgaacgcaccacggcgcaggactggcaggcagctccacctgcagccccagtgcgagatccactaggtgaacccagctgggctcctgagtctggtggggacgtggagagtctttatatctacctcagggattgtaaatacaccaatcagcaccctgtgtttagctcaaggtttgtgaatccaccaatcgacactctgtatctagctgctctggtggggccttggaaaacctttatgtctagctcagggattgtaaatacaccaatcggcactctgtatctagctcaaggtttgtaaacacaccaatcagcaccctgtgtttagctcaaggtttgtgaatgcaccaatcgacactctgtatctagctgctctggtggggccttggagaacctctgcatctagctcaaggtttgtaaacacaccaatcagcaccctgtgtttagctcaaggtttgtgagtgcaccaatcgacactctgtatctagctgctctggtggggccttggagaatctgtgtgtcgaaactctgtatctaactaatctgatggggacacggagaacctttgtatctagctcagggattgtaaacgcaccaatcagtgccctgacaaaacaggccactcggctctaccaatcagcaggatgtgggtgggcccagataagagaataaaagcaggctgcccgagccagcactggtaacccgctcgggtccccttccacactgtggaagctttgttctttcgttctttgcaataaatcttgctactgctcactctttgggtccactctgcttttatgagctgtaacactcaccgcgaagatctgcagcttcactcctgagcccagtgagaccacaaacccaccgggaggaacgaacaactccagacgcgctgccttaagagctgtaacactcactgccaaggtctgcagcttcactcctgagccagcaagaccacgaacccaccagaaggaagaaactccgaacacatctgaacatcagaagggacagactccagacgcaccaccttaagagctgtaacactcaccgcgagggtccgtggcttcattcttgaagtcagtgagaccaagaacccaccaattccagacacagtagtaagctttaaacttttcagtgggacatttgaagcttagcaagattggattccaaacaactttctagaattttctcccattatttcttgtcacatatgtaaagacggctttggaatatttccttaacctatactctctcctttagagaagcctcaaggtgaatgaagcgggtgggtctaaatggctcagattggttaagaaggctatgggacctggtatagagttgactggaccaagctgagccaataagatataattactcactcattgtcagtatagacaaagacatggaaatgacagtcatgcaacatcggaaccctgacatatatggtggtaacaaagctggccacagagctcaaaccatggcaactcaatgctattctgtcctgggcagagttacaagggaagcaaaaagagatgacagaggaaatacagatttttaaagggaagagaatggagtacatgtgcagggagaagcagaggtcccaagagagatatacacaatggcagcagcctggccacatttcctgtgactggatgccctgagattcctccattgttcttttacctaacatgagctgtctaggcttcatatctttgtttaatatgagttcccttgcctggaaggctttccctccgcattatttggcatcccagggttccaaggcccacctcaaatgtgacttcctccaaaatgtttccacaattcacaaccctcccactgcctcccagtcctccaactggatcaaaagttgcttgaggataaggataatttccagtgcctagatagtgaatgcaaatggtaggcatgttaaatgaaacaatcttcctataaaagttttatctacagagtggttagcagagtcagcatttaaacatttatcgggtgaatggatcggtggatttgtcagtcatctgaaatttttttctattagcacaaacttctgttagtctgaattagaaagaacttgttctgaaacaaagtcttcactcatgatcacctagaagttatgtggtactgaacaaagcacctggggatcaagaaaaagatgacaaagtcctgtccaggaagagcttacagttctgtcccagctagaaggaagcaacagcatgggacacctgaatgcttgtaattctggagtcataagaaatcaaagaggaactattaagcttctttgcctccataaaaaaacgtgttttttatctccataaaaaacaaaaaatgttttttatctccataaaaaaaaaaaacccaaaacatctgtatgtcttctacttaccactcccctagaaaataccatttcttactttcaaagaaaaaaagtacaatttcataaaaatatactgagagtaataaatattagagaaaacaggtcccaggaaacaagactatttttttttaaacaagcaaaacacatgttttaaatccccatttacaagtttgtgaattatggccctttgtgctcaaactggactcggagaaacacaagcttttttagaccaccacaataagagctgtggggggatgggagatggggaagaaaagaaagggccaggaagaaagacacaaaaggctgtcacaaagaccgcaaaatttagctgtttattaggttgcaagtctctccttctctccctgctttctctttcttctttttctccccacaaatcctctcaaaacacatacaaaaagagaaaactagaagcaagattgggtcaaacatgaagaacacagaaagaatattaaatagctagctttaaagggctctttttcagtttgaacaaaagtaaaacgttctccaaagcaaaaacagaaaacagagcttccacccagattgtgcaacttaatgagaggaggttagtgctgataaacccattgtgaatctatataaagtgacagattttcaagcaaggaaatcaatcagttgggattgaaggatttagagctcaggaatcatctggttcaaaccaacagggagctgagggctgggtggatgggggatgggttggacagggtgacatgaggtcaagaaagggggtctagtttttatacccaccattctctgaccccattccaccccaaacttgcacactcaattcacattatctgtcatgctagcaagacattcagcttgaccctgcaagattcactttgttctcttccttgcctcactcccagcaagcttccaacacaagggaattaagctttccccaggcagtcacagaacccagctgtaaaaagctgcttagtgctctgccggtaatctgtcactttggttccttccttgctgtctgcttgttcccaatggaggcaaaatttagaaacataccatcacgtgggggcttttcaaacaggaacgatggagtgctctgggttgcagtgacctcaatttctttcttccctgccagagccgtctgtcctggctgtttctctcctcgctggcaaacctgcgagcatgaatcaattctagtttcactaaaatcttcctgccctttttccttgctgcttccttcaggaatctgctccagcttactatggagatataatccagcagtgccgagttccttcttcccagagttgctgctgctgttgctgaagtgagccaattcttctctcttcttggccactggttcctcacagatgaaaggaggtatctctttagtagacaagatgggcagtttcccagggctcaatttgtagctagctgtctgttcctcacccacagtcatggagcgcttcatagcaggagctcccagtttcccaggtgtaggactaggcattgggctactagggggaggcagcaggccagaagaaggctcttctcgggcagggagttcagggtacttatctgcaaggttgacagctgggggaactgagaggtgagaacattcagacagggccctgcgcactgcctttttctgctggggggcttggttgagcacagcctcctcggtagaactcaatttctccaactccttatcatggtctctgatgtgacagcttgcattcaaatgttcctgggtgaacaccatagtgattggcggaatggtggtgggtgaatgctcaataatgggggctgggtgggctagagacaccaggagtggggactcacacttcagctgctcagagttatcatttaccaccccaatcactgggcagccaggggtgatgctattctccatctctcccggagttgcttcccttgagcccagagagccttgagccactggatgaaagctggggttccaaacactggtttcctgctccttaacatatctggtagggatgtcagcagccccagggaaatccagatctgactggctcttggtctctagtccattcttccctgccaccttcccctgaactggaatggttttgtttttgtctggcccctctatgagtcccagatggaactcggaggtcttctggtgtaccgagttcccctccaagggatggcaggtctctgaaatcacatacctgctctcaaggtgacctgaggcttcttgacagtccttgtcctgcatttcaatgctcagctctttgtctagcttcccctcaaaaaagcagagcttgttctgctccaggaagctggcattcttcacaagcccatcttttggttgcccgtccatgctgacattcagcccaatttcattcagtttgccctctgtcctctgccattcgaatccggcttgactgatttcttttggggagtccattcggcactctgcaggcttgcccttactgagctgaccgtacgcggcagtgagagaggctgtctgcttgtctgagagcgacatcgtctctcctccactgctctccctgctttcgctcctggagctctaataccacctacgatcacacagagcttgcagtgacatcacaccaattccccagtattcatgacaaaattcatctctccctcaatgcccctctctcctcaagcagttgagtattaaatgcacttacaaatgtgaaagaaagaaagaaaggaagaatgaatgaaagcgaaagaaaggaaggaacctgctgctttctgcacaacaaaatgctactttaatctgagaatgtaatttcccgtgaactagcactctgtttagatctgcaatttaaaacacagtatggtgccaatccaagcactaaggatagtaattattttggctttcactgatatagatacgtgcatacccacacactcatttatctgataccatgcccacccttccacattcaaccactcagaaaactgttttaaaaataaccgagactcatttgccaatccccagctataaccctgaagaacaatgaatccaggaaattgttcaaaattggactaaaaaaaaaaaaaaaaaaccacaccttaacgtagtattaagattgcaggcattcattctcagaggaagagtgggtttgctgtcatagcaacttatcaaactaacttgaaaactgacttgagtggggtccccaaaacccgtaagagctccatctgtagctctgcataatggaagagtttaataaagggttcatttaaagacttcagtgatcagggctttggggatagatattctaattataagacatttgtgtgacaacataccccttatgcatttacgcctgtccctgcccccacttggttccttggatgagctgggttgctccctccactaccaagccctgctctttccagcctaataatctgttaggtgtcatgtgaacacactgggggcagtgcatctttctctgacctccagacttagggactctaacaattgtagcttggagttttccccactcaccagagcttactgcccccatttaactcagcatggtcctttgctgccctgggctttgagctcaaatattgtatattcaaactgaaggaaccataaaacaaaactgtgagaaaaaaattacactataaggacaggctatactcttactttgaacaaagctgatttttcttgtctagctgtaagttactgtcttgcaataacatagcatactggaaatattctatcagaaatccaagagaagtctttttccaagatgaagaaaagatttagattgctttttttttttttttaaaaaaaggccatttgccataaactgcaatgatttgatgacagtttttaaacaatgcctttagaaaaaagggcaagttaagattgttctttggtctataaaatgtaaagaaattaccaaggtccgcataggaaagcttgctaaactgtagcctctgtccccaagaactcaccttctctattcataccactcaagttcccaacaagagtacagggatcaaccttatataccttttccattaccttcagtacctgacacagggctacactcatgatgatgagtggcaatgttgcaatgctgaaaaaaaaaaactgaacatgaactgagcctcatatacatttcttccccttgatcttgagctgtttagtaacaatacatgacaaagcacaatacagattaactggcaaggaacctggtttccatactctatggcaaagatcttgctaaggaaaaggaagtgaggtataacaaaatgaagaatgccaggagaatcatgattctaattagtaacaagaaaaaatatgattggccgggtgtggtggctcacgcctgtaatcccagcactttgggagcccaaggcaggtggatcacgaggtcaggagatcgagaccatcctggctaacatggtgaaaccctgtctctactaaaaaatacaaaaaattagctgggcatggtggtgggtgcctgtagtcccagctactcaggaggctgaggcaggagaatggcgtgaacccacgaggcggagcttgcagtgagctgagatcacgccactgcactccagcctgggcgacagggcaagactccgtctcaaaaaataaaaaaaaaagaaaaaatatgaggcgagattgggtacagaaaggccttggtaatacaacatagttgaattcttgctttctttttttatacatataattgaataatataattaagtatgtacaatatgtgaggaaaattatgaaagtctggagatggctgggtgccatggctcacacctgtaatcccagcactttgggaggctgaggtgggcagattgcttgagcccaggagtttgagaccagcctgggcaacatggcaaaaccctgtctctacaaagagtacaaaaatttaggtgggcatggtgatcacaattgtggtcccagctactcagaaggctgaggtgggagaattgcctgagcccagtaagtcaaggctgcagtgggccgtgatcacatcactgcactccagcctgggtgagaggaaaccctgtccaaaaaaaaaaaaaagggggtgaggaagatattgttgtaatacagtctgaatataccagaggaaaactctggaaaataccttagaaatcaggtaagcctcaacaaccccattctgtgtaaactagtcaccccccacaaacgacacacacatatacacccttaatttactgacatggtggggaaaaaattaatttgactttgagtcagaaggccagattttaaaatctgtgtcacttaatagttaagagtcttagaaactcatttaactgctcttagcttcagtttcttcctctataaaaggaggggaatctttaaggtgctcttggattcagttttaccactttcacttctgaagttgaaacagccattcaagtaatcacaggcccactgctatgtccagctcaaagtatgacttcaacctgggactccactaggcagtatcttcagtaacctttctgtctcatgcgggagtgctgcctattggcagaggcatgactgggcatggcggacgttgcagcatgtctgaagaaagtggtagttggcccttatattctgaagaagtggaaaataccaaggcaaagaacaagcatagaaacttgttccttatagccaaattatttttagttctggccagcctacccagacccacttcactagttcatccctacccaacagctaaggcaataactaaaattacaggtctctgctaccttcagatatcacatattctgcctcagtaattctatccataaacagcagactgcaaaatgtgaaccagccaaaagaccaagagcagaaaccagaagaatgaagctagtcaggcacaaagaagtgcatattccagactacagttcatactgtgtagatcagaaatgtggtcaaactgaaaaaatataattatgaggtcaacatctagcaactgggccaagcactggcttcatagttacaaggctcaggagacagagagttgaaagaagcaatctggggtgggggggcggtcagaacaagaagttcaagcccatagaaggggcgagtacccaagacatcatgtcagccaggtgctcaggcatacagataagtttggtggtcacccaggggtctgagtacaacaaaacacatagccgtgaggattgagggaatatatataaaaagcatttgacaaagtagttaaaacacacaaatacataatgtatctactgatgctagctttaaaaaaacaaccaagaaggccgggcgcggtggctcacgcctgtaatcccagctctttgggaggccgaggcgggaggatcacctgaggttgggagttcgagaccagcctgaacaacatggagaaaccccgtgtctactaaaaatacaaaattagccgggcgtggtggcacatgcctgtaatcccagctactcgggaggctgaggcaggagaatcgcttgaacccgggaggcagaggttgcagtgagtggagatcatgccattgcactccagcctgggcaacaagagcgaaactccatctccaaacaaacaaacaaaaaaacaaccaagaaactgtacatatatatatatgaagtaggttttcctactccctatagggaatctgatgtgtagtaataataacaacaacaacaacaaaagtgagaaagcctaagtccctggactggagaactgctgcactctggtaaagacagacaaaaacaaaacaaaacaaccactactactcacaagaaacaacatataaatcgtaattgcaatcactaacagataagagaaaaagaaaagctaaatttcaaaatctggggcactgcctaaggaaagtaaataacctattccctgaatcccttttaggacaagggtccattatatccatcaacagtactgcaaagacactaaagtatgtgtgacagtacagagtcagaatgctgaggcttccctaacagacccctcattttatagaggaacaaaatggtgtccagagaaaaaaagtggtttgcccatgatcacatggtgaaaacttaatggaaaagccacaaagaagatgctaggtttctgactgccagtcttcccaaaccgctgagcaaaaattaatcttagtcactagatgactctccttttcgatgtatctttatttttttgagagggggtctcgctttgttgcccaggctggagtgcagtggcatgatctcggctaactacaacctctgcctcccaggctcaagcgattctcctgcctcagcttccggagtagctgggattacaggcccacaccaccacacctgactaatttttgtatttttagtagagacagggtttcacgatgttggccaggctggtcttgaacttctgacctcaggtgatctgcccaactcggcctccccaagtgctgggattacagctgtgggcattgcgctcggcccaatgtatcttttttgtgatcattgaagtacttcaaactttaatttggaattataatttaattcttttgtgatcactccaaaactcccaaattaatacacagtatgcatacacatgtgtgtgtatgtatgtgtgtttaggggagcaaacgcgtgtttgaagtaagggagaaaaagaggcaatgcacttggtttcggtgtttactttatatcttaagaacggtcttgtttgaggccgggagtagtggctcatgcctgtaatctcagtactttgggaggtcgaggcgggcggatcacaaggtcaggagttcgagaccagcctggccaacatggtgaaaccctgtctccactaaaaaaagatacaaaaaattagctgggtgtggtggcaggtacctgtaatcccagctactcgggagtctgaggcaggagaatcgcttgaacctgggaggtggaggctgcagtgagccgagatcccaccactgcactccaggccaggcaacagagtgagactccatatcgggggggggaaaaaaaaaaaagaaagaatggtcctgctttaattatgcaaagagtaagatgtgggtgacttattccttagcaaacttctgtttctaatttccagtcttaagagaacttagatttatgttaatatctttctatggtgccttagcactgtaagtttcctttcatgtggcttctgagtaggaagacagattcagcctcactaagaaaaagcagagaaccagacgcttttacagagggggaagggacagagtagcttctagtttcattacactaggctgggcatggtggctcacccctgtaatcccagcactttgggaggcagaggcaggtggatcatgaggtcaagagatcgagaccatcctggccaacgtgatgaaaccctgtctctagtgaaaatacaaaaattagctgggcgtggtggcacgcacctgtagtcccagctacccgggaggctgaggcaggagaattgcttgaatccgggaggcagaggttgcagtgagctgagatcgcgccactgcactccagcctgccaacagggcgagactccgcctcaaaaaaaaaaaaaaaagattacactattgcttttgcaaggcatacaaagatattaaatggaagaataattaatggctttgttgcaccccaaatgaggtgaatgccacctggatgacaaatgatggggaaaccctagtatagaataattagtaaaactcaagaaagactgggcatagtagcccacgcctgtaacaccagcactttagaagggttaggtgggaggaccacttgaggccaagagttcaagagcctgggcaacatagcaggacccacatctatacaaaaaaaataagaaaaaaatgttttttagccaggtgtggtggtgcatgcccatagtactagctacttgggaggctgaagaaggaggatcacttaaacctaagagtctgaggctgcagtgagtgaactatgatcacgccactgcactccagcctgagcgacagagaccttgtttaaaaacaaaacaaaacaacccacagaacaccctgagaatggccagttcagtactccagtccaaataagaattacagacataatctcaatcagggatgcagatttatccacaggaaatagccacagcaagaaactccaatctcccagccactgtaaaattatatcaagttggtggatgaggtaaatacatgaagtttgaaaagggtgagcctgcctaggtaaaaagaaacacacttaagaaccagaaggactaagtcctagattcagctgccactgggattccttgtctctaggttcttcctccccaggagctgggattacaggtgtcccagctaatcaccacacccagctaatttttgtatttttagtatacacagggtttcactatgttggccaggctaatctggaactcctaacctcaggtgatcctcctgcctcagcctcccaaagtgctgggattacaagtgtgaaccaccgcacccggccccttgcctctaggtcctattcctactcactcacctctgcaaagtctctttgaacccctcctgagttctttatattatcataatactctatctctttttagaatttagaaaccacactgtaatcttttatttatatgactttcccaggagcttctagaaggtaggaatgtgaactgtgcatttgtgccatgtgggtgcactgcacagtgcttgactcacagtaaataagctttcaaaaaagatctgctcagtgaaaggatgggtagtttccttttacactgcatctgcatcatttgacctgatccgttccatcattaaagctgtcttcaacccaacccaagcggtggtgatctggaatgtcctttgagctaaatattgtgaagttctattccattctgtctgagtttgaagaaagcgcatggattcctgtgtgtctgggcagaaggtggtttccaggactcttggcaaagcctgcaggtctctaatcccagtacatgtactggcagatatttctgttttagccttgtgcttggagttagtatttaacctgttcagggccttggtttttatacatgacagacaactagtttctctgcattctttcttatcagttaccaaggcaacactactttccagattgaccaactgttcccagttattgcctccaggaaacaattatcattacaatgaaagtcaataattctactattaacaatgattgatgacactcactccttgttaataaaagataaagttgtcaagttataatctagtttcttccctggaagtaaacgttccaagtgtttagacatacatacataaaggtaaaactatttcagaaaccatattctacattttagaaacatttctcatgttttaactcaagaaaataaatcatgattctccctgattaaaaaaaggatgagaagcaaacagacagaatgaataagctgaggcgaataatctgatatatgtgaaccaaagacatgaaaatgcttatggataagaaatcctctaaaggccgggcatggtagctaaggcctgtaatcccagcactttgggaggctgaggcaggcgcatcacctgctggagtttgagactagcctggccaacatggtgaaaccctgtctctactaaaaatacaaaaactagctgggtgcggtggtgtgcacctgtagtcccagctacttgggaggctgaggcaggagaatcgcttgaacctgggaggtggagattacagtgagccgagatggcgccactgcactccagcctgggctacagagggagactgtctcaaaacaacaacaacaacaacaacaacaactctaaaaactacaacttggaaatatcaagtctttgttcttttaagtctagtatggaccctcccatagccctccccaaaagaaaagagaatcatccaactaaactaggtagaaagataacccatttcttcaagcaaaaatctaagatcttctgcttttagaggcacacaatacccctaggatcctttaggagcttactttcttttccccaatttcatctcaaaatgtttaacagatgtccctgtttccccaaacttgactttattccatgcacctgcacttcactatgcatgcctttacacagctgtcccctagaattctttaccttaatttgctcagcaaactcttagccatactttcagagtctcctgtgtgaagatttctctaggtcttgtaggaaaacttagtccctttctgctctgtatttccataggatctagctcacacttctatcctttttcagaggagtaaacttctcttactagaggaaaactgtctgttttccaccctggaatctctgaagagtatagaatgtgttttattagtctatttttagagtaggagtaatgtcacttggtatctactgaatgaatgaataaactaaatactaaaaagtacaaatcatgctgtgtgtccgctatttgcagagcaataggcaatgtttatacacttcaggaggccgaggtggacggatcacttgagctcaggagttcaagactaggttgtgcaacatggccaaacccagcctctacaaaaaatacaaaaattagccgggcacggaggcacgcacctgtagttccagctacttgcaactgaggtgggagtatcacctgagcccaggaggcggaggctgtagtcagctgagactgtaccactgcaccccagcctgggcaactgagcaagaccctatttaaaaaaaaaaaaaagaatggaagcccccttactgtcacctccatatcttaaagaaataactatatctgcaatactgtaaatcaaaactaagtttttattttaacagtgtgttcagaatcccccaatgctatttgtcaaccagagggtacaagtgaagggtgagggaatatgaggggaagaagcttcttttaaagtaggatattcaagccaggcatggtgcctcacacctagaatctcagcactttgggaggccaaggaggaaggattgcttgaggccagaagtttgagactagcctgggcaacagagtgagaccccatctctacaaaaaatattcaccaggtatggtggtgcacacctgtagtctcaactacttgggaggctgaggcaggaggattacttgagcctgggaggtcgaggctgtagtaagccgtgatcatgccactgcacttcagcctgggtgacaaagtgataccttgtctcaaaaaaataaatacaaatttaacaaaacaaagtaggataatcaattgttgcttgattcatttcaaagaatatttaaatgttctggctcaaacaaggtaatgaccacacagtattttttggaggttaagagtttaggatggcaatgagtatatagtaaggttcaataaatggtagctatttttagttgtgtgactagtcccaataaatttcatcagcatggtagtaaaaaaaagccagtggagtcaggcgcagtggctcatgcctgtagtcccagcactttgggagaccgaggtgggtggatcacgaggtcaggagttcaagaccagcctggctaacatggttaaaccccatctctactaaaaatacaaaaattagccgggcgtggtgacacatgcctataatcccaactactcaggaggctgaggcaggagaactgcttgaacccaggagccagaggttgcagtgagccgagattgtgccactgcactcctgcctgggcgacagagggagactctgtctcaaaaaaaaaaaaaaaaaaaaaaaaaaagaagccagttgaatcagagggcaagtggggtgagagtaatgaggaaaggaacttcacaaatggcactacagttaagaaaagacattaccaaatgggtacttctccagttgtaaaatagtagcaagttctaagataacaaatggttttttcatctgctgagcatattttatttatgtacaagggccttgaaactgttagaattctgggtttataaattacttcaagtttcacaccaagagagtttctcaccataaactgacattcccagctgctggtagacagttgatgagctcaagcaaactgaagaaagaaatgaaagccagattataagaagaccaggcttcactatggcaaagggagggcctatttacagggatcccaaactgtcccattcacagtagcagcatagcaagtacactgtcactcacagttctacttggtttccaggggaacaactaacatggagcgggtattggaatctaatgtggatcatcctttcaagtttgtgcttcccttcacaaaaaacacaatcccataagaagtccttttctggccaggtgcggtggctcacccttgtaatcccagcactttgggaggccaaggcgggcggatcacgaggtcaggagatcgagaccatcctggctaacacggtgaaaccccgtctctactaaaaatacaaaaaattagccaggcatagtggtgggcgcctgtagtcccagctactcgggaggctgaggcaggagaacggcgtgaacctgggaggcagagcgtgcagtgagccgagatcgcgccactgcactctcgccttggcgaaagagcgagactccgtctcaaaaaaaaaaaaaaaaaaagtccttttctgaaaagttgagcttagacttcctgacgtattgcattaatcttccctgcctggaagaacatgcatagtatgcaaagaaaccttctgttaaagtttccctaaatttgacagcagcatgaaaaaataacagtagagcaaacagtaagctggaagagactttggcaatatattcactttccctacttctaaacagggtaagatcagcaaaaagataattcacttataattcaaaaaatgtcattaggcatcatgtatatataaagctctaggctgggtgttaaaaagtacatgtaaataaatcaaacacagactctctggacaataaaatgctagacagagtcaaaagacctagattctaatcctaaattaacctctaattcacagtttatattttcatgatgtatctttatttctccaagtagaaaagtgtttaattagtgcctagatactaaaaaaagtctattttatgtttactaattgtcaaccttcatctttttctttttaagtacctgaaacttccggaagcttctgaagcaagtctaagaaaagcatggatcttagaaacataaagacttggattcaaattctaaccctggcacttcaccagctatgtgaccttgacagcctccattttctcacctgaaaaatggagataatctttaatagtgttattttatgtgtgtgtgtatgatctatttacctatttccagataaccaggcaaataaaatcaactcaataggtggtaggtgctattattattattattattttttgagatggagtctcactctgtctcccaggctggagtgcagtggtgcgatcttggctcactgcaacctctgcctcctaggttcaagaaattctcctgagcctcctgagtagctgggattacaggcgtgcgctgtcatacccagctaatttttgtatttttagtagagatggggtttcaccatgttggccaggctggtctcgaactcctgacctcaggtgatctgctgcgcctggccagtgctattattattaacacccggattagttagaggtactattatttttactaacaccactaataatatcttttttttttttgggcgggggggctagagaggggcggggcgggggatggagtctcactcactctatcgcccaggctggagggcagtgttgtgatcttggcttactggaacctctgcctcttgggttcaagagagcgattctcctgcctcagtctcctgagtaggtggaattacaggcatgcaacatcatgcgtggctactttttgtatttttagtagagatggggtttcaccatgttggccaggctggtcttgaactcctggcctcaagtgatttgcctacctcagcctcccaaagtgctgggactacaggtgtgagccactgtgcccagccaacaccatttgtaatatctttactgtccaaacaatggaaaccatgggtgacaccatttgaccacaagacgaatgagaacaagatatgtgagaattggtagcaatatgggggcagggcagttaacatgaatgattcaaagtgaggaacaaagataaacaccagtgatggactaacaaaacatgtgaacacattatgctgttcgacagaaaaactcgatatgcaagacataaactctccctacgataagctagaaacagtgacttcaagaaaaatattgagtggattaatttttcttctacaaaactaaaaaataagaataggacaactctgaaaaagaataatagggcaaggggttgggctagccctattagatattaaaatatattaggaagcctggtggaaagatcaatggatcaggaaagaaagtccagaaatagaccaaatacatgcagaaatttagggtatgacaaaggtggcagttcagtgggagatcgattataaacatgatggtgggatgaccaagtaaccctgcctcacaaccttataaacaaaacataccaaaacaacaacaacaacaaaaaaaaaaaaccccacaaacaagcaaattctagattggccaacaatttaaaatgaaaaatattaatagaagagaaaagaaaatattttcataatttcagagcatggattggcttttataaacttgttaatacatgaagaagtcactaaaaaaaaaataaaacacagccaggcatggtagctcatgcctgtaatcccagcactttgggaggctgaggcaagtggatcgcctaaggtcaggagttcaagaccagcctggccaacatagtgaaacccagctctactaaaaatacaaaaaattagctgagcgtggtggtaggcacctataatcctagctactagggaggctgaggtaggagaatcgcttgaacctgggaggtggaggttgcagtgagccaagatcgtgccattgcactccagcctgggcaacaagagtgaaactccatctcaaaaaacaaaaaaaacaaacaaaaaacagcacacacacaaaatctatgccatgaaataatttttcaccgattagatcagtacacataaccaaaaaaaaaaaaaaaatcacactagtagagaaaggcagggaaacaggtatttgtctatgttgagggtgggagtagagatgtacctttctctacaagggacatctctgtaggcctacagagagcaatatggaacacccatcaaaattatgaatacatattcttcaaaccagagattcttactccggagcccctttttattacacagacgcacacacatgaagatgacatcctatagatacaaagatagtttatgtaccatatttctaatgaaaaaaagttgggaaacacctaaatgtgcatcagtaaagaagtactggccaggcacggtggctcaacacctgtaattccaacactttggggaggctgaggcagacagatcacctgaggttgggagtttgagatcagcctgaccaacatggagaaaccccgtctctattaaaaatacaaaattagctgggcgtggtggtgcatgcctgtaatcccagctactcgggaggctgaggcaggagaatcacttgaacccaggaggcagaggttgcggtgaactgagatcatgccattgcactccttcgtgggcaatgagagcaaaactctgtctcaaaaaaaaaaaaagtactataatacattagtatatacctatgtaatgaaatagtatacagctatcaaaaaagaatgagtcatatctagagacatgtaccaggaaaaaagattaaaaaaaaaaacaaaaaaaagaggcctctttctttatactgattcttttttttttttgaaatggagtttccctcttgtggcccaggctggggtgcagtggcgcgatctcggctcactgcaacctccacctcccagattcaagtgattctcctgcctcatcctcccaagtagctgggattacaggcatgcaccaccacacccagctagttttgtatttttagtagagatggggtttctccacgttggtgaggctggtctcgaactcctgacctcaggtgatccgcctgcctcggcctcccaaagtgctgggattataggtgtgagccactgcgcctggcttctttatactgagtcttaaaagatctctttaaaaattaagtttaaaaagaatagcacacatcagtatgtatgtatacgtctcatttatatgaaatcaggaaatatatatgttattacttattatacataaattgtctggaaggatatataagctattgtgaacactggttgctctggagagggaaagctggaaggcggttaatggagggaggccaacttacgttttactgtatactcctttgtaccatgtgaatgtattaacctattcgacaattagtttaaaaatttttttttaactattaaaaaggtatacattgtccttaggggaaaggtgtggtagaatttatagaagaaacaataaattttgtcccaaacccattatccttcccatacccactctgtaaggccactgctaacacagtctctgagcctgacctgacccaggcagggccccaaaagttctgcagtactggtcttgcttcctcaagaaaaacaaatcctctttctgcatttctttggaaatactgagcaaaaagagatggctgggatttcacagaaattacatgttaacttttagatcactgctgaaactaaagaatgggtctagaaaccaaaacgaaagaactggatagaacactggaaatctcaatgaatgctggaaagccctctacatactatttcattttctgccttggtaatagggtagctaatagaagataaaaacagagaagatgagaatgtcttatgcaaataacaacctttagcattctttactcacacagcagtattccttagtgggtacatactcatgcatagacaagctttacccaaaagaacaagtccataccatgcagaacacaatcccatgatgaaacctctctaaaagcctgactggctactaaaaccaattggtgttttttttaaattctggagttagtagctacatcatgcaagctgggaaacagtgattaagaaatagtgtcacttgtaggctgtgaaaaatctcaaagacaagggaacattttttgaaagctagattcagggaagccacgattaaatgtatacttttttggggaattgggggtggggggaaacggggctaccatttctaaatcttaaaggaatcatcttcttaatctcattccaattacttgactgaatagagccaaaaaagagtaaaattatgaggaacacaacatgggcaagttttatggactatgtttgatggacacagactatgcccaaaactcaaacccacatggaactgtggggcaatggatataagcaacaaactggtcaaaaaatgtatctgtatcattgagagatcatttcccattactagaaacacaaataaatcggtgcctaccaatgctggtttgaggccaccatttcctcataaggaggtggactgatttcatttaacctaaaagcagtttggatatttagtcccaccagcacaagctacatataaattgaaaaaaatctcatgcacatagctagacatgaaatattttctttcctcctgtgaatccttataccaagtaatgattaaaatttagctgtaaacttgatacataggaggcacaattttaaaaaaattaagaaatggatgatgataggtcttttgttagacaattcattgaaaattcaacttcccctaaaattcaacgttcagtgctgggtaaaaaaggcatgcaaccaagttaccagcctcctcaagcaggacacaaggaacacattggctgcagaaaacacaccgtagcagttataggtttcatgccaacaaaccaatgattaacaaggatgattagagtctggatggagccaagacacaagctctttgcctttctgatgctgactcaaaagccacaagcacacacatttccccatggcaggttcataccagcggacttcagttgcttatgtctctcttgttcctggattgtagactttggcaaaagtggagtaagtcctcgggacttggtgggtctcatgtagcctttcattggttctgccattctgcttttatcttcctttttcccttctcctggtgtctttgattcagatttttctgtcattttctgaggtgtctccaaaatcttatctttgggttctgggagtcgaacacccttggaagcagtcattattactaacgtatccgccacctctgaaggaggagcttcgactttgctatgtaagaaatctgactggatttctggtgttggcaaggaaacgctttccaattccgtgattttacaagccagactaatttctttcaatttatcattttcactttttggagacaaaagagtcagatctaccttcttattcaaactatctgaacctttggaatttctatcttgagcattttggtcctcacaaaaactgagcttttgtgctttgtcttccagtaagtcaggaatctgaactgcaacagacccttctttagtctctttctcttcattcactggatgtgctgggaaattacctctatctgcatatccttctagggctctggcctctcctggtaggctctggtcttctactggcactccaggaaggaggtgaccttttgctagctctgtgactttctctactgaatgcttagacgcaccactgtgcactgactcagattctcctatcacatgcccttcatcgatccctgcttcatttttcatggaatcagcaagctcagctttattcttaagagagtgatctccatgaatgttaactgtttctatggctgttgtaataggtagagcaactcctcctgtgcttgtagagggcacaacagcagagggacccttgggtctttcttgacctgggactccatctttggtgtagttatctaccattaatgatttggaaatctgggctggggctatctcttgcccattttttgccaaggtatctggaaaggaatcaccttcctttactacttgaggagtaggagtgggcagtttttcacaggctgctgattccagaacctctagaggagatgatttatttatcagctctgatggtgttctgggacaggtaaatgtaatatttctattttcgtccatataggccattccttcaattccctggtcccctgtggtttccatgggaacatgtatttttgttgcatctatcttattctccagaatgtgcttctcaggagaactatttttaacctttttactttttccatcattactccttttacttggtttgtcagccactgcagtgtatctattggctgcatctgtcttattctcctcagatactactgaaggaacaaatcctgccccctggatttgctcttggcagctcacatctgtcaccttggcaggtggttcagtaacagtagaagccttgactgtgcttatcttgttttccccaagagtcccaagctcaacaaaattaacctgaaaatttccacccttcctgtcaactgcttccactgtgggtgtatctggtgtatgtgagaacgaagaatcatgcattttggggaaagtaaatcctatttccttgcttttatggggaatactaccagtatctccatccttcccttcaaaaggtgggttaaggatttcttccttcctctccattctagcaggctgtgtggaataattatttttaaactttttgcttttgccttcattgcctctctttttaggcttttcagaaatccagggagctgcctcatgatccttccatggacaccttccttccttgctctggttattgacacccatatctttgactacatctcctgtttctgtgctaacaccagaagtctgagtcatgcctgatccactttccaaaggaatcaatgcctgcatggtgcctgccaccttaggctgagtcatctctttaggctcccccatcaccactgcctccgtgagatcagccttagtgcctggttgctttgaagaattcagccccagctcctcactcttatcctgagtagtcattccttcagttttagagactggctcactcggtatgagaacagcccttccgtccttctggctgtccagaagaaatggcagctcagattttgcttttaccttcccagaatctgttctcattttcccagaacttccccttcccttcctgcttttgccatcacctgccattctcttaaatggttcattctctaccccagggacctgtaccaacacttggccctgcagctgctcagaagtaaagatgctgatctcttgtctttcgttgggaaaagcttccttttttagttctttatcctcttcagctccttcaggaaactccttcagtttgacattctgcagtttagtcattttactttcattattcccttcttttagattacattctaatggattacttgctatcaaagtgggtaccaaatttggtatttcttttgctgctgtgggttttgaaactacacccataacctcttggtccaagaaaggagagcaaccctctttaagtctgatatccaaaggggtttctacattgtatgcagaaacttctgctaggggtcctttcagattgagagggcctactgactggcttttatctacaggagtcttcaggtggggtgcaggctgtggtttgtattcatgttgcttcagcaatttcttgtcttggttttgtagtactgacttgttacttttgctctcttcctctactctcagcttagactgagaacttattgcagttttgggggcttcttcagaaggatataaaggaattctgagactctctgagacaaagttctcagctaccagtctggctgcactggagttaactaaacattcccttttcaagttttctccagatacaagtccatattctgtacccatagtggtaggctggctggggagaacacctgatttttgtgtgtcagctgcaaatggatgacctttaggcttatctgcattgtcatcatccgaaggtcctccagcccgtggttgagaatatctcttttgctttggtttcttcttctttttcttcatcattattggtgtgctttctatatcccaggcctccctgccaagatccctctggggttcaagtgagtcaacatgaatactttttctttggttcccaggcccaccacaggaggatgaaccagagacccaacctgactcagacaaagagcagtggcccagcctgtgatcaagagtcttccatggaggagagcctcccagcagctcaggagggaccctggcaggcttgggccgggttgacctgcggtcactgggtctgcaaacttgtttggcttgtgtgggaggggtaccgcaatacatgaagttggctaaaattccaaacaaaaaactcctcgttattgtttcttaaaaacaacaaaaaacaaacaaacaaacaaaaaaaccagaccatataaatgactaatttaaggaggctattttcactaatacatatagtacttactgtaatttgctcaggaaaacagtcttttctaaaacatttctcacttttaactggcgctagcaaaaatatttaacagatcatcatctcaggtaaagattgttttcaaacatttataaaatatttgaaatttcagaagtagcaggattgaacttttaaaaatgaaacatttcacatcttttaacctctaaaaataagcacttactgcctgtaaatctcatctgatttatattggtcattcttagtgcttgcctctttttggtgaaatttattaattgcttcagttaaatatacatgattttggacaaaatttataattctaagactaggtcaccaatattaaactaatacttgtcaaacaaaccagacagattctgggaactagatcagaaggccagacttaagtcacttcacgcacacacacaaaatatactgaatccacattttggtcagagaaaaattctcatgattccagaaccagagcatcctactttgaaagacaaatatgttaaatttcaacattctgctcctaaatgtacttcccaaaagacagagaaatatatataatgttaagtaggataattaattttaacaattaagatgagtacctttggaagagtttcagcaggtgatctggtctaaccttcctcccagttaatataatatggatccaagatcctggcaagagtctcattaagagcaggtatatgccagctcctgtcaagtctgacccaataaattgatttccaagaatattataatatgtaaatagtggatttcattcttgtccttacccctccaatatcctctaaatcctagcctttgtttaatatctcaggttaattattgcatcgctcaaaaaattgctaggctatagtatcccccagtatttataacatttaattcagcaattaatcagcagctattcagtgccatcttttatactattttattcaattattatgtaaatcttgggtttcagagttcatgcctgagaacttatctcttcattcaggttataatataataattcagggggcaaggacggggacttaaatatctatatgccttaacatggtgtattttgtataccataagcacttgataaatctttactgatttgttgagtcagtaaaacaacatttaaaaaaaaaatcacacatttatttaagctctagtcttgtgctaggtagtgtgcaaagcattagagattctaagtgaaataagtcatgggcccttatgtcccatatgtcaggatgtccacattccaatcatagtcacagaaaagtaaacagaaaatcaagttgataatcatatacatatgcttctgggttattaaaaacaggtaatcttcaaattcactgaataatcaaactttaaattggaaagtatcttagagcagtacctctcaaagtttaatgaaaattagaattatctggggatctaattaaaatgcagataataattacaaaggcctaaggtagagcccaagattctgcatttctaccagcctctcaggtaatgtagatgctgttgggccatggaacactgtaactagtaagactttagagaacatttgaccaattaatttatattatagctaagtaaactgagatataggcaagttatgtaacttgcttaagaccacacaggatagaatagtgaatagctgaaccagatcaaaatttgggtgtcctttcttcactatgaaaacagtggagaaggccaggcacggtcgctcacgcctgtaatcccaacactttgggaggctgaggtgggcagatcaccagaggtcaggagtttgagaccagcctggccaacatggtgaaacctcatctctactaaaaattagccgggcatggtggcaggcgcctgtaatcccagctactcaggaggctgaggcaggagaatcgcttgaacccagtaggtggaggatgcagtgagccaagatcacgccattgcacgccagcctgggcgacagagtgagactctgtctcaaaaaaaaaaaaacaacgacaacaacaacaaaaaaaacagtggagaaaaaaaaaattaggtatcctgatttgctgtagtagtaatttttaaagatataacaagctgacattctgtctaaaccagataaaatctgtctaagagaattgacttcataaactatactgctgattaccaccatacaacagggaactagagacaatgtctaccatcactactctatcgcccctaatttgtttcaaagagttcattttgttttcctaacttacctgaggtctctgaagaaagctcagaaggttgactgttgcatggtttcctttcccctagtttttctaacacagaatcctcctcggccggcaagctgcactttttccccgttcctgtgacggtttctaaaggtaataacaaaagccacacacgtttcagagaagcatgatttcagctattttccatctgccagaaattggatatgggattagtttctgaggagttctcctacaaggggcagcaaaggagtgaagtggtagttggaagctgaagttgggaaggtatgtctagttatgttacttttttttttttttttgagatggagtttttcactctttgttgctcaggctggagtgcaatggtgcgatctcggctcaccacaacctccgtctcccaggttcaagtgattctcctgcctcagcctcccgagtagctgggattacaggcatgcgccaccatgcccggctaattttgtatttttagtggagacggggtttctccatgttggtcaggctagtcttgaattcccgacctcaggtgatccgcccacctcggccgcccaaagtgctgggattacaggtgtgagccaccatgcccggtcaatgtttcgttttttaagatgggaaaaataacaaacgtttgttaaatgggtgggaatgatccaatgaaaaaagatttaaattggtatgaggggcaaaaaagggaagaatacatggggcaatatatcgagtaggaaagaggagatggaatctagggcaaaatgaggagaggttggtcttaattaggagcaggaacagtttacttataaaaacgggaactttcataagcagagaccatggatacagatacaagtagttgggtagataatggaatagaagtttgtcgatgttctattttattgcttgacttatctgcaagaaaaacaggacaatcagcagagaatgaacatagaaaaggtgttggaggtgggaggagggtaaaggcgggaaagagttgtctaggagagcaggagtatgaataaacttgcaaagtacagtgtgactgtctgtactttacctggcatgatgtttgtccttagtcttctcgagactacaacctggtagagagaaatactgagaataagcacaagcacgtacctggtgaaatcatgaaagtaggtgcagctgactgccccacatcctgcagagattctaaatgggaatcctcacttattcctttttgtgtttgtgcaatttccatgtctttaattggaactggtgttgcctctgtttctgagagtggtggaacatctttggctggagtcacattgttggccagggtcagaaccccatccttagccaggggtgcttctgttttgagggctgggacctgatcctcagtcagggccacctccatttctggaggcagacatacgttcttgatgagaactacttctgtttctggaggtggagtcacatccttgcccagagccatttctgtttctgatagtggagacatgtccttcaacaagcccacttcttttactgtggacggagccacatccttggccggggctatttctgtttctgggagttgagccatgtccttgactggggccacctctgcttctaaaggtagtgctttatccttggtcaagatcacgttggtttccgggggcagtgtcatgtccctggccagggctacctctgtttctgaggacaaagccaccttctcagcagaggatatttctgtggatgatataatgtcattagcctgtgccacctctatttctgagagtaataccaaatccttggctgggactatcttgttttctttgggtggtcccatgtccttggaaggagccaagtccatttttataggagatgccctctctgtttctttcttgttttctttgggtggtcccatgtccttggaaggggctaagtccatttttataggagatgccctctctgtttctttcaacagtgtcacatccttggctggggctacctctgtttctgtgggcagtaccacattcttggctgaagatacatctgtttctgtgggccatctgacatccttaaccagggccacttctttttctgtgggtagttccatgtccttgactagggccatatctgattccatggatggctgcatgtccttggccagtgtcacatctaatttggtgggtgattccatatctttagccaatgccacctcggtttttgtagctagtgccatgtccttggcgagggccatctctgtttctttagatggtgccatgtcagtagtcttcagtcccatcattatttccaatgcttgtgctggtggcctctcttctgatgccatttctatctccttggctagctctaagggaactaaattggaaatttaggacacatcattgtctactcatacctttgcattaaaaatgcttactttcttcaggcatgagagtatttggcttttgtgaccataagactgtacacataactaagaattaatgttaggccgggcacagtggctcacgcctgtaatcccagaactttgggaggccgaggcggatggatcatctgaggtcaggagttcgagaccagcctgacaaacatggtgaaaccctgtctctactaaaaatacagaaattagccatgcagtggcaggcgcctgtaatcccagctacttgggaggctgaagcaggagaattgctagaacccaggaggcggagtttgcaatgaaccgagatcacggcattgcactccagcctgggggacagggcaagagtccgtctcaaaaaaaaaaaaaaaaaaagaagaagaagctaatgtcaagtaacatattctgcctactctttgacagtctcaacacttggaagaataagatgtaaaatactgggaggacaagtagtggaggagaaatggcaaagaagagagaaaacataggcttcaaaaataacacgggcacagaattagtattagaaagataatctgtgggacagcaggtcagtcatgcttcctatcaagaaaaactccagagttctaaatctgtactgaatttttgtttttgttttttgagacacggtctcacgctgttgcccaagctggagtgcagtagcatgatctcggctcccgggttcaagcaattctcctgtctcagcctccctagtagctgggattataggtacacgccaccacgctgagcttatttatttatttatttagctctttcacccaggctggagtgcagtggcgcaatctcggctgacagcaacctctgccttccggtttcaagtgattctcctgcctcagcctccctagtagctgggattacaggcacctgccaccacgcccagctaattttttgtatttttagtagagacggggtttcaccatgttggccaggctggtctcgaactcctgacctcaggtgatctgcccgccttggcctcccaaagtgttgggattacaggcgtgagccaccgtgcctagaccaatttttgtattttttgtagaaatggggtttcaccatgttggctgggctggtctggaactcctgacctcaagtgatctgcctgcctcagcttcccaaagtgctgggattataagtgtgagccaccacaccaggccgtaaatctgtactgaattaaaaaaaaaaattctgatacctaatacaatgaaaatgtgatgaaaaaaatatatatatgttaaaaaatttaaaaaaagtatttatgtgcccgttaaccctaagtgttatagttcaacaatttaattcctccagtggtgatatcactaatataagcaaaacatttgtgattgttctgaaatttttatacctgctgtaagctgctaaaaaatacacctgatgatttatattgattaccaatactgcaaccattaactgataaagggagtctctaatagtttacctgccgttggctgaggaggttctgcaacagcctctggggaaacaaaggactctgagtgtggagagtttaaggcttccacagaccacccctgaggtacaacagctgtgttgcagggagacatacctaatattgaaacacaaacaaatacattttgaaacttagtaaacattggaaacaaaaggtatttgatatatttttgttttgttttgttttgtttgttttttttttgagacagagtttcgctctgttgcccacgcagacagagtgaagtggcgtgatctcggctcactgcaagctccgcttcccgggttcacgccattctcctgcctcagtctcccgagtagctgggactacaggcgcctgccacagctcccggctaattttttgtatttttagtagaggcggggtttcaccatgttagcccggatagtctcgatctcctgacctcttgatccaaccgcctcggcctcccaaagtgctgggattacaggcgtgaaccaccgcgcccggcctaagaggtatttgatatttaaaatcagctgcatatattgccaggaagacacagactaataaaaaacaatgcaaaaaaagttttttttctttttttgagacagagtctcgcactgtcgcctgggctggagtgcaatggcacgatctcggctcgctgcaatctctgcctcccaggttcacgccattctcctgcctcagcctctcaagtagctgggactacaagcacacaccaccacacctggctaatttttttgtatttttaatagagatggggtgtcactatgttggccagattggtctcgaactcctgacctcatgatccacccgccttggcctcccaacgtgctgggattacaggtgtgagacaccgcgcccggccgacaacgcaaacaagttttaaaggaaacactgctgacattcttcaggttttagctagttgttagtaggtggtatagtatatcccagtagtgccattaatcaacattcactggctactttctatataatatataaagggtaatataaagattcaaaatattaatgattgaactctagttccaacaccacaaccaacataatatactatagtaaaaaactgcgagtcttaatttcttcatctgcaaaatgagattaacacctccctttccaacattagaagacaattttattaaaatactttgtagcagttttgttgttgttgttgttgttgttgtttgcccagctaattttcttatttttattatatttatttattaatttttgagatggattcttgctcgttgcccaggctggagtgcaatggcacaatctcagctcactgcaacctccacctcccaggttcaagtgattcttctgactcagcctcctgagtagctgggattataggtgtctgccaccactcccagctaatttttgtatttttagtcgagacagtgtttcaccatgttggccaggctggtctcgaactcctgacctcaggtgatctgcccacctccgtctcccaaagtgctgggattacaggcatgagccaccacactcggcctaatttttctatttttagtagagatggggtttcaccatgttggccaggctggtctcaaactcctgacctcaggtgatctgcccgcctctgcctcccaaagtgctgggattacaggcatgagccattaggcccagcctaatttttgtatttttagtagagacgggatttcaccattttggccaggctggtcttgaactcctggcctcaagtgatccatccgccttggcctcccaaagtgctgggattacgggcgtgtgccactgcacccagatggttttttttttttttttttttttttaagacagggtctcaactctgttgtccaggctggagtacagtggcatgatcatggctcaatgcagcctcgaccttctgggctcaagcaatccttccacctcagcctcttgagtagctgagactacaggcatgtgccaccacgcctggatgaattttaaaattttttgtaggacaggatctccctatgttgcccagattggtttcaaattgctgggctcaagcaatcctgtcacctcagcttcccaaagtgctagggttacaggcatgagccactgtgtctgcctgtaaatgaagaagtagaaaaatgtggctgggtgcaaaggctcacgcctgtaatctcagcactttgggaggctgaagcgggtggatcacttgagcccaggagttcaagaccagcctgggcaacgtgacaaaaccccatctctacaaaaaattagccaggcatagtggtacacacctgtaatcccagctgctcaggagattgaggtgggaggatcacctgaccaggaggccaaggctgcagtgggccgtgatcgcatcactgcactccaacctgggtgacagagtgagaccctgtctcaaaaaaaaggggagatgacagcccaactgtgaatctgtgaattgtctcctttgattaatccaaagagagccttgtcacacccacagcccctaaatctgacttttcttagtggttagcttcaaaggtgatgtgtgaaaggccatgttgattgtttggcattaaacaactaaaggacaccagaatatgccaccccaaaatacgctactttggcataaggacttttttaagctgaaggctattattagcctggagatggcaccataggaatctacacagcaacctttactaactagcttttacctaccatttacctgtctcccacaatttgcggcccctagagactcaaaagtcttttccttcatcttctcacctctcaaaaaaaaaatttgtcattctttattgaagaagctatataaggtggaattctaaagccacctcttgcggagttactcattccctaggtacctctcatgtacatattaaattcacattttaaactttggtctcttttttcttgttaatcttttgtcacagagccctagtcagtgaaccaaagatgagtaaagaaaaaatttttttccttccctacagaataaatccatttgaagaagccataccgtaactgtctttcaagggatcattttgtcctgcaaatattgaagtatcagctgtcgcactggagggaaagaccaaatctgccaggtcatcatcatggtacatcttaaagggatctggaatatagaagaaatccaaaactcattcctggtgaatgcaactagaaagattaatatttctttctttctttcttttttttttttgaggtggagtcttgctctgttgccaaggctggagtgcagtggtgccatcttggttcactgcaacctctacctcccaggttcaagcaattctcctgcctcagcctcttaagtagctgggattacagatgcccgccaccatgcctggctaatttttgtatttttttgtagagacaaggtttctccacgttggccaggctagtctcaaactcctgatctcaagtgatctgcccacctcggcctcccaaagtattaggattacaggcgtgagccaccatgcctggccaatatttcttattatcctatgatgaatatagatgagttgtcaatagtaagtaaaccgaaatcatatgtgactgcacatggtagagaatcaatattcactaattcatttgttatgagttaataataaataatcccttctctaagatttggttatgtacatcagatagccaacaaatgcataaaacaaaaagggcaactaatgctcagctgtataacaaacactctgagaggtgaaagtataaactaaattttcaatatatatttatataacattcattttaagttactttttaaaaagacagagccattaacaagcttaaaaaaaaaaaccaacaagtaatttttcacctcatgtggacatgatgaagaaaactgcatttcaaaactgtctgaatgggacaagataaacaattgttatcctaacagaagaaataaactcttgactcaggagctggcatgaataaaagcactcaaaacatcaggtaaactctttgtgcttttgtacatgaaaaaaaagcagggccgggcatggtggttcatgcctgtaatcccagcactttgggaggccaaggcgggcggatcacgaggtctggagattgagaccatcctggctaatagagtgaaaccccgtctctactaaaaatataaaaaaattagtcaggcgtggtggcacgtgcctgtagtcccagctacccgggaggctgaggcaggaaaatcgcttgaacacgggaggcagaggtggcagtgagccgagatggcgccactgcactccagcctgggtgatagagtgagactgtctcaaaaaaaaaagaaaaaaaagcaaagctgttcaggctaaacaagagttccactttctgaagaggccttcttggaatttattttattatcttaatcatcctgaagacttgttaaaaataaagattgctggttcctgagaatctgcatttccaactagttcctgagtgacactaacacatcactcccttaagacacttcaattgtcagagacagccgcataaaagcccaggccttgagagaatgttcattttcttggctctgaggcagctataccaccctctttttgtaagaaatttcaggattaggggagaccactgcatcgggaagtgtgaacaagcagaaggcaatattgggaaacttgttgaggcttcttcttcagaaaaccatgggagcctggaaaagtggcacacaccccagctacttgagaggctgaggtgggaggatcttcttgagcccaggggttcaaggctgcagtgcactatgatatggcgactgtgaatagtcactgcactcctgtctgggcaacacaccgagaccgcccatctttaaaaacaaaaaacacagcctgctttttgtttaaaaaaaaaaaaaacaaacccttattttcaaaaaacggaaaaattagccaggcatggtagcgcatgcctgcagtcccagctactcggaaggctgaggtgggaggatcacttgagcctggggaggttgagtctgtggtgagccgtggttgtaccactgagctacagcctgggtgacaaagtgaaaccccatctcaaaataaataataaaaacagaacaaaattaagaaaaagaaaagatggggagatagaatatgagagagatgataaacattcattcttcccagttctatatggtttgggatagctcgctgcttgctctgcctctcacacttcccccttgagggaaaaaaggattcttaaagcatcaaacagactaaattctggatggtttgcactttaagatgggagcttgctaaattacttgtaaaaatagatgattcttacagagttctgtcatttagtcattaattttttactgggtgcctaccacatggcagacccagtatgctctaaaaaacccaaagatgtacaaggtcagggatgggaacatttatatatgttcccacaggatatattttggttcaagtcaagggagatctttgcttgataagtatttaagctgagaactaaagaactgagtggttatgaggaggaagacaaaccttttctctctctacattccctctcctctaatcccacagtttaaaattccatctataggttgatgacacctgaatttataattcaagacctctagacctctcaccttattttcagacttttatgtagcatgtttccaaatctactcattatatagtctttccatctctaatggcattctatccttctatgttttttgcaaaaaaccttggagtcatcctggacctcctctttttcacacaccacagccaacccatcagaaaatccattgcccttgaccttcaaaatgtgccccagaacctatttctcccccagctccatgactagggtttctcacaaggttgcagtccagcggttggccaggggctgtggtgatctgaagacctgactggggctgcagaacctgcctgttaagatggcttacgtggccgttgaatggaggcctctgctcctctcccatgtgtgcctctctatatcagctggctttcctcatgattagtaaacacagagtgatcaagatggaagctacgatattttttttttttgagatggagtctcgctctgtcgcccaggctggagtgcagtggcgtgatctcagcttactgcaacctccgcctcccaggttcaagcaattctcctgcctcagcttcccgagtagctgggactacaggcatccgccaccacacctggctaattttttgtatttttaggagagacggggtttcaccatgttggccaggatggtctccatctcttgacctcgtgatccacctgcctcagcctcccaaagtgctgtgattacaggcgtgagccaccgtgcccggctgaagctatgatattttctgtaatttaatcttagaaatgacacactattatttctgccatctattctacaatcacacagaccaaacctagtaccacatgggaggtgactacacaagggtatcaataccaggaggcagggatcattggacgccatcttggcagttgactaccacactcaactttccgctgaggaaattaaactccactgaattttttttcctactcaaaattggtcattcctttgttacccttgctggctcctcttcttcctgatttaaattatttatgtacttatcatttgagcttgggcggtcaaggctgcagtgagcccagactgtgccactgcactccagcctgggcgacagagggagattctgtctcaaaaaaataaaataatgaacaaaatatggtatagccatataatggagtattacgtgtccataaagaaagtactgatacatgccacaaaatgcaggactcctcaaaacagtatgctaagtgaaaaaaagcagtcacaaagaaaccactttatatgattccctttatataaaatgtccaatctaagcaaatttatagagacaaaaagcaaattggtagttgcttagggttgcagtggatagggagatgggggtgatatttaaaaggtacagagtttctttttgtggtaataaaagtgttctaaaattgaatctggttatggttataaccataaatagataaatagataggtaagtagatagagtacaattcagcggaatttttttggagacagagtttcgctcgttgcccaagctggagtacaatggcacgatcttggctcactgcaacctctgcctcccgggctcaagtgattctcctgcctcagcctcccaagtagctggaattacaggcgtgcaccaccatgcctggctatttttttatatttttagtagagatggggtttcaccatgttggccaggctggtctcgaactcctgacctcaggtgatctgcccacctcagcctcccaaagtgctgggattacaggcgtgagccaccacgcccggccaattcagtggaattaagttactctattttatttattttattttattgagacagggtctggctctgtcacccaagctggagttcagtgggacagtctcggctcactgcaacctctgcctcccgggctcaaacgatcctccaacctcagcctcccaagtagctggcattacaggcgcccgccaccatgcccggctgatttttttatttttagtagagacgaggtttcaccatgttggctgggctggcctcgaactcctgacctcaggtgatccgcctgcctcggcctcccaaagtgctgggattacaagtgtgagccaccacgcctggcctaagttactccatttatctactctatctactctacctatctgtctgtctgtctgtctacacatctatcagggacagggtcttgctgtattgcccacgctagagtacagaagcacgatcctaggtaactgcagctttgaagtggcagactcaagtgattcccccaccccagcctcccgagtagctaggactacaggcatgtgctgccacaaccagctaacttttaaaatgttttgtagagacagaatcccattatgttgttcaggctggtctcaaactcttggcctcaagtgatcatcccacctatgcctcacaaagtgctgggattacaggcacaagtcactgaatctggccgaactatatactttaaatgggtaaactgtatggtactgtgaattattggccaggcgcagtggctcacacctgtaatcccagcactttgggaggctgaggtgggcagatcatctgaggtcaggagtttgagatcagcctggccaacatggtgaaacctggtctctactaaaaatacaattagttgggtgtagtgggcacctgtaattccagctatatgggaggctgaggcaggagaatcgcttgaactcaggaggcagaggttgcagtaagctgagattgcgccactgcactccagccagggtgacagagcaagactctgtctcaaaaaaaaaaaaaaaagaattgtatctcaatacagctttttcttcaccctccccccataattactttgtacctaggaaagccgataactgacaaatggtacagaacatcacatactaggttatttgaaacaaacgatgagcatcttataagttagatgtcaaaaaagaagccatatttaagtggaaacataacttgagctctcaatctggctaacagggaagtaccaaagctattcctttaaggctcttttggaactcattcttcctaccaactctagctctgggctactacagataggcttttgtttgtttgtttgtttgtttgtttgtttttgagatggagtttcgctcttgttgcccaggctggggtgcagtggcgcgatctcggctcactgcaacctccgcctcgcaggttcaagcaattctcctgcctcagcctcccgagtagctgggattacagacatatgccactacacctgcctaattttgtatttttagtagagacagcgtttctccatgttggtcaggcttgtctcgaactctcgaactcaggtgatccgcccactttggcctcccaaagtgctgggattacaggcataacccaccgcacctggtctgtttttaattttatagaaagtgggtatgaatcagctttctcttctgtcaaaagaggatacatatatttggcagagttaggtaagaaataccgataatgtgtatataaaggctctagcactgtgcctggcacagaacagcactggtttaacattaccataataattccttctggaagaattaaggttctaaggtactatggatcctctaatcttcagtgtatatgaatttcacataatgtatttaaaataggttttgaagagcagggaactagagggcattaagtgtctcaaaggaaaggataaatgaagaagagaaagggacaaaccaatgctaaggttgtactttgtgatctatacttaagctaaagcattttcatctgaatggtggttgtagctttttcacatttatgtcatagcacacatttagtagtcacgagcaagccaacacttaccagtctggataggatcgaccacttgctcaggttggaaacaaaagttggtatcttctggccagttctggctatttgggtattcctggtaggccattttctcttcaaggaattcagttggagacccttaaaatagagacacaaaacaaaagttacaagatattacagttttctcctccactacagtggaatttctacaaagtattacagctagtacaatataaaaaatcctatctagctagtgtcttacaagaaaacttttttcttttaattgaaagataaaaggagctgggtgcaatggtgcgtctgtagccccatttacttgggagactgagagaggattacctgaacccaggagtttgaggctgtagtgcactatgatcacacctgtgaacagctactgcactccaacctgggcaacatagcaagactctgtcactaaaaaaaattttagatagaaggaaataaagtaggtcattaaggttaaaaaaacactacagagtgacttctaggttatgcaggcacgaagagggtagtgatttctccacatgaaagaacaaggataaaactgtcaaaagcaacaatttcagggagctggaattaaaaaaaaaaaaagccagcctaaataagtggaaaggtataacatgctcaggaatgaaagattcaatactgttaagatggcaatcctgaaaatgaccaatatattgaagaaagtacaaaataagctcattccataatttatataaaaatgcaaaaaacctagaaaagccaaaacaattttgaagaaaaacagttgaagggcttacataacctgatttcaaaagttattataaatgtaccaactcaggctgggagaagtggctcaccacctgtaatcccaacactttgggaggctgaggcaggcagctcactttgaggtcaggagttcgagaccagcctgaccaacatggtgaaaccctgtctctagcaaaaatacaaaaattagctgggcatggtgatgcatgcctgtaattctggctactcaggaggctgaggcacgagaatcacttgaacctgggagtgggaaggttgcagtgagccaagattgcgccactgcactacagcctgggtgacagagcaagactgtaccaactcagcatggtattgacaacgtggtattggaacagaacaggttcagaacgtggtactggaacagaacaggttcagaaagaaacatacaaagttagggtcaactggctatctacaaacataatataattcaacataattatattcaacccagaaacaaattttttttcaacaaatgatacagaaacaattggacactgaccacataccatatgcaaaagttaactccaaacagatcaaagacctaacgtagctcacttgctaacttattatgcaaaaaaaaaaaaaaaaaaaaaaaaaaaaaagacaagacaaagacctaatgtaagagttaaaactaaaaaaacttataaacaggaaaaaatctttgtgactttggattaggcaaagatttcttagacatgtcaccaaaagcactatctgtaagagacaaaatatataaatgggacaccatgaaaatttaaaacttttgcttttcaaagatgctattaaacggccaggcatggtggctcatgcctgtaatccctgcactttgggaggccgaggcaggcggatcacctgaagttaggaattcaagaccagcctggccaactgggtgacaccccatctctactaaaaaatacaaaaattagctgggcctggtggcctgtgcctgcagtcccagctactcaggaggctgaggcaggataatcacctgagcctgggaggcgaaggttgcagtgagctgacattgtgccactgtactgcagcctggggcaacagagtgagactgcgtctcaaaaaacaaaaccaaacaaaaaaacaaaagacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaacaaacaaacaaacaaaaaaaacaaaagacaacaacaaaggtactattaaagaaaatgaaaagagaagtcatagacttcgagaaatatctgcaaatcataaatctgataaaagatttgtatgtagaagagattataatctcttacaatacaattataagataaacaactcaatttaaaacttgatggccagctgcagcggctcatgcctgtaatcccagcactttgggaggccaaggtgggcggatcacaaggtcaggaaatcgagaccatcctggctaacacagtgaaaccctgtctactacaaatacaaaaaaaaattagccgggcatggtggaggatgcctgtagtcccagctactcaggaggctgaggcaggagaatggcgtgaacctggtaggcagagcttgcagtgagcggagatcacgccactgcactccggcctgggtgacagagcgagactctgtctaaaaaaaaaaaaaaaaaaattggctaaatatttcaatagacattttaccaaagaaaatatataatgcgtaatatgcacatgaatgaagctcatcagtccttagggaaatgcaaattaaaactacaatgaactcctactacaaaaccactaaaatggctgttatcaggccaggcacaatggttcatgcctgtaatcccagtacttcgggaagctgaggcaagaaggtcacctgagcccaggagtttgagaccagcctgggcaacatagtgagaccctgtctctacaaaaacatacaaaaaaaaaattagccaagcatggtgacgagtgcctttagtttcagctactcaggatgctaaagcaggaagattgcttgagcctgggaagtcgaggctgcagtcacctgtgatcacactactgccttggtgacagaaaaaggccctattttttaaaaaaggctgtacaaaaagactgacaggagcaattttgagaatgtgtaaaatggtagtttggtggtttccttttatttacttatttttgtttttctcaaagttgctctttttttgttgttgagacagggtcttgctctgtcatccaggctggaatgcagcggtgtggatcatggctgactgcagcctcaacttcccaagctcaagcaatcctctcacctcggcctcccaagtagctacaaatataggcacttgccaccacacctgcctaatttaaacaaaatttttttttttttttttttgtagagacagggtctcattatgttgcccaagctggtctccaacttctgggctcaagcagttctctgatctcaacctcctcaagtcctaggattacaggtttgagccactgtgcctggctccatctgtatttttaaagactagtcaagtacaacagtgagaagcagggaaagagtggaacgtggagttcaatctgtaactgactgaacaattgagataactcactacctttggaccagcctctttttattttttaaataacagttttatcgagtataattcacaaaattcactcttttaaagtcgagttcaaaggttttttagcatatacacagttatacaaccatcaccactatctaacttcagaacattttcttcactccaaaaaagaaatcccatatcttttctcctttcccactttcccctacccctcggtaaccactcgtctactttttgttcctaaggatttgcctaatctagatatttcatataaatgaagtcacacaatatgtcatcttttgtgactgacctctttcatttagcacaatgttttcaaggttcatccatgctgtagtatggtaactgaactttattcctttttatagccaaataacattccactgtgtagatccaccacactttgtttatccattaatcagctgacatttggttgtttctactttttggatattgtgaataatgctgctatgaacattcacgtacaggtttttgtgggaacgtgtttcaattatctttgatatatccctaggagtagaactgctgggtcataaagcaactttatgtttaatattttgagacactgccaaactgtttccaaaatggctgcgtcattttacaatcccaataacaatacatgaggactccagtttcttcacatcttcaccaacatgttgttatctttttttatcgtagtcaccctagatgtggtaagaagtagcatcttattgtggttttgatttggactgctctaatgactaatgatgttgagcattttttcatgtgttcatctggcatttgtatgttttctttggagacgtgaaatgagtggggtctcattatgttgcccagactattcgggtgcagcggctgttcacaggtgcaatcatactgccttgcagcctcaaactcctgggctcaagtaatcctcttgcctctgcaagagacacctacagctgagaccacaggtgtacaccaccatgcttggctatctttttttgtttttatttttgagacagtcctgctctgttgctcaggctggagtgcagtggcacgatcacagctcactgcaaccttaaactcctgggctcaagagatcttcctgcctcagcctcaagagtagctgggactacaggtgcatgccaccacacctggctaatttttttttaatttttgtagagaagaatctcaaaagcattatgctaagtgaggaaatcaagataccaaagaatatatattgtatgattccatttatatgaaatttctagaacatacagaactataacaggaagcagatcaatggtcacctgaaactgtaggtcagaaaagggactggctttgtaaatgggctcaagggaacttttagggtaataaaaaaatgttctaacgatggattacactgatggttgcacaactccataatattactaagaatcatttcgactccgtaattttactaagaatcatttacttccacacttacaacaggtaaatttttgggtatgtaaattacacctcaataaagtttttttctttcttttttttgagacagggtctcactctgtcacccaagctggagtgcggtagtacgatcatagctcactgcagcctcgacctccctgactcaagcaatcctctcacctcagcctgccaagtagctgggactactggcatatgccatcctgcccagctttttttttttttttttgagacagagtcttgctctgtcacccaggctggagtgcagtggcgcgatctgggctcactgcaagatccgcctcccagattcacgccattctcctgcctcagcctcccaagcagctgggactacaggcgcctgccaccacgcccggctaattttttgtatttttagtagagacagggtttcaccatgttggccaggctggtctcaaactcctcaacccaagtgatctgcctgcctcagcctcccaaagtgctgggatgacaggcatgtgtcactgcacctggccccaaaagccaactttaaatggcatttcaacacaagtaggttccccagagctgaatgtggtgaaattgggttaattatgtagtttaattttctgtactctatgtatgtattcatcaccatttcagtagatatgtaaggccaattttacataggtcacacatacttgtttttaaacactgctggagaagaaatctcaaggctgaccgaagcaacagactcaggcactgggtaaagagagggacaggacatcaagagctaatctactggtggtgaccaggcagcactgaatcaacagcaccacaacatattaaataatttttttaaaaaagtgattagggttttgaaccctacttttccccagtcaaatttctaccctttcaataccttttagtatctgctgtatactgatggcatagttttgagacagcgtctccttttgtctcccaggctggaatccagtgacttgatctcagctcaccctaaactccgtctcccaggctcaaattatcctctcacctcagcttcttgagtactgggactacaagcacgtgccatcacgctcggctaattattgtatttttggtagagacaggatttcaccatgttacctaggctggtcttgaacttctgggctcaaggagtccacccatcttggcctcccaaagtgctgggattacaggccaccgtgcctggcccagtctgctttcttataaacaatattagtgcggctcataatttacatattactaacaaacgaatcagtgactccttctatttcacaccctcagctctttccttgtttttttgtttttttcccccagtggtaacctcagaactttaaagtgaaaggaacctagaggatcacctaatccaaacctctgaagtttaaaccatgccacatttgtccagataattcatttaccaatttaagcacatactgtcaatcgctactccaggcattagtgattcagcagtaaaccaaatggtgaaatgtcctgctctcatggaacttagatcaccaccatcaccaccctatgcttaggcactacgaaaacacagaagcaagtattagcctagttgagagtttaagacatgcccaatgatgcaaacctctgcaagctttagttttcataactaatacctacttcataaggctaagatatgtgaagtgcttagaaaattatgagaaacatgctaaattattgctaatcctataataaccattatggtttatgtaggacaagtgtctacaatgcagtaagtgctacttataggagtttaaagaacagtcacataacacagtcgtgggatgatctaggatcttcctgtaggagactagaacttaattgaatctaggaagatagaaggatgtaattaaatgaagctgggaaacagagaaagagacaaagtggggaagacacacagcaagcaaaatagaagttagggccatgggcaagaatgggaaaaccaagagcatatcactttggatgaaacacatttatgaaggacagcagttcttcataaacggcagctagagtttcaaaggccaaatagaaacttaagatttgtctgcctgaatgccttctaaagggaaacccacccctaggaaccatcccattcctctatttggtcctggtgttttgctttccccaccgaagaagtagacttgtgattcaagcaggcccaaagcccttttggagaaacctgatatacagacattttaagatattgaaccataataatatacctgagctggccaggcgtggtggctcacacctgtaatcccagcactttgagaggctgagacgggtggatcacctaaggtcaggagttcgagaccagcctgatcaatatggtgaaaccccatctctactaaaaatacaaaaattagccgggggtgtggtgacgtatgtctgtagtcccagctactcaggaggctgagacaggagaattgcttgaacccgggaggcagaggctgcagtgagccgagatcacacaactgcactccagctgcagtgacgtagtgagacttagtctccaaaaaaaaaaaaaaaaaatattaggaatatacctcaaaaaaattaagaattttatataagaatataaaattaagaatatagctgccagtggccatctttctcaaccctgaaagacactgcctaagaatgaagccaaagaaggtgtagggaggaaagaaggggagaaagaggagggtgggagagagacaaagaaggagaagaaggagagaaagaggccaggcatggtggctcacacctgtaatcctagcactttgagaggctgaggtggtggatcacttgaggccagaagtttggcaccagcccgaccaacgtggtgaaaacccgtctctactaagaaaacaaaaaattagccgggtgtggtggtaggcacctgtaatcccagctactcgggaggctgaggcagaattgcttgaacctgggaggcagaggttgcagtgacccgagatcacatcactgtactctagcctgggcaacagagcaaaactctgtcttaaaaaaaaagaaaagaaaaaagggggaggagaaaggagagacttatggatcaggtattattctaaaacccttatatgttaaaaaaaaaaaatctagctacaagcacgcaacaaaatatacaaatatacaatgcctagttcttataatggcacacgtaacattgaggaaatctctaaaaacaaagcttcttcacaggacagaaaagcaatctaaaccaaaaagagatatgctaaagaaggaaaacagaactagaaaacagaatcaggagcccaggcacggtggctggcgcctgtaatcccaacactttgggaagccaaggtaggcagatcacctgaggtcaagagttcaagaccagcctggccaacatggagaaaccccgtctcaactaaaaatataaaattagccaggcatggtagcgggctcctgtaatcccagctactcgggaggctgaggcaagagaactgcttgaacccgggaggtggaggttgcagtgagccaagatcgcgccactgcactccggcttgggtgacaagagcgaaactccgtctcaaaaaaaaaaaaaaaaagaaaagaaagaaaacagaatcaggagacccaggttctaatcttgactctgccacttaactttgggtgtgaccttaagactgttagagctacactactcatccagaattaaaaaaaaaaattgtgctacataatttctgaagcccattttaattttaaaattaattctgagacttttgacttatccattcatctttataattctcaaaaatctggtaaaacataacttacaaataagactcagcagttattagacagatgaaatacttggtcatttaagtagatgaaagtactcattacttgtctaagccagaaaaatgacgatgaattaaagaacaaaccacagcatcctcgggaaggttcacaagtggcatatacactgagcagaggggaagaaaaggtgatgaaacttggataaacgcctttttaaattagtaaaaatattaaaagcaatatgttttttcataggattaatatatttgtcttagttcttgaatcacaaaacacaaatgtaataaaacaaccccattctggattactgcagtgaaattaatcagaaaattataggagaaagatgtttctgatgttctcaggttgaaggtaggaatcaatctcagaacctttggctaccttcaagaacagcttttcctttttcttcttcttttttttttttttttttttttgagacgaagtctcactcttgtcccccaggctggagcgcgatagcacaatctcagctcactgcaacctctgcctcccgggttcaagcgattctcctgcctcagcctcctgagtagctgggattacaggcgcctgccaccatgcccggctaatttttgtatttttagtagagacgaggtttcaccatgttggccaggatggtctcgaactcctgacctcaggtgatccgcccgcctcagtctcccaaagtgctgggattacaggcatgaaccactgcacccagccatttttcttcttttattattattattaaatattctaaaaaatctatagagggaaaggagggagagaacagctgggcaccagcagacatatttgagttcttacttttattttattgagacaagatctctgctgggtgtggtggctcatgcctgtaatcccagcactttgggaaggcagaggcaggcagatcacttgaggtcaggagttagagaccagcctggccaacatgatgaaacgctgtctctactaaaaatacaaaaattagccacgcatggtggcgcacacctgtaatcctactcgggaggctgagacaggagaattgtttgaacctgggaggtggaggttgcagtgaaccgagactgtgccactgcacccagcctgggcgacagagcgagattctgtctcaaaggaaaaaaagaaaaaagggaattgttaattgagacaaggtctgactgtctcccaggtatagtggcgcaatcacagctcactgcggcctcaacttcctgggctcaagcaatcctcccctctcagcttctccagtagctaaggacacagatgtgtgccactatgcccttctaatttattattgttattattttgggggtagagacagggtctccatacattgcccaggctggcgttgaacaactgggctcaagcaatcctccggatttgacctcccaaagtgctaggattacatgcatgagcctctataccaggcccatatttgagttcttaaccctggctttgccacaggctaaccatgtaaatttgggacagccctttcatctctcttagtcacagtaatgacctctaaggatacttgttcagttctaaaattatggttaagtaaaaaacattcttcaagtcacatcctatttagagaaggtgcacctatccatctatttcaaagcttataaagacgatgtgtttagggcttcaacaacacaaaacattattacggcaaatgttagatgctaatctaaagccttccttacccatcaaatgaacccatcccaggcttgttccctactactccaacaggaaagtcatgcagtaagtatgctgtcccctcatggctcctgctagagcctgtgctccactctgcccctgtgcctttgctcatgagatcactgatcccctgcttgaaatgtctcctccctgatccaattccaaagccaccacttgggcctcatagcttccacagaacctctctgatgactttaatgctcattttccactacttagctcttttaccattcactgttactaggaaagaatttagtccttaagcacatgttttcctgttagtctttttttaaaaaattaaaaagcctttaagtattctatttatcattaaaattttcattattttacatgttagtaagtgaactcattaatgtttaaaaagaaaatactgtgcttttactacttttatttcctcacaatgcctagctaactgcatgagacagaatagtattcaataaataagttgctatcaaattatcacaagatcattatttgggctaaatgatgtaagttaaattcacattatacaccaaacttcttggaaagtgatttgcatttattataaagagcataaggttggtgacataatgtttttttttaaaaaagcataaggaattccaaaataatttaaacaatagcctatcatttctaagatagacattaaaaactctgattctgcttatatttcttactcatggtaagaaactgtaaagaaatagttttttttttttttttaaacaaccacctcttgatcaaaaaataagtttttaatcagagaaatgggtacattttcctcacccctcctggagaaggagcatgaaagtctgttttttgttgttgttgtttttttcatttttttaaaaatttttttgaggtggagtctcactctgttgcctaggctggagtgcagtggcatgatctccactcactgcaacctcccaggttcaagcaattctcctgcctcagcctctcgagtagctgggattacagatgtgcaccaccatgcctggctaatttttgtacttttagtggagacgaggtttcaccatgttggtcaggctggtctcaaactcctgacctcaggtgagccacccgccttggcctcccaaaatgctgcaattataggtgtgagccaccacacctggcccaaatctggttttaagatgcagaattttgctggttattcccttccacagggtgcagcacagcctggagcagctatctcaacagcaaagttcagaatcaccagtcccccgccaccattattattaaggagcatgtttgaccagaggctcactcccacatctttattcaatactgctgacctagattttgttcttaaaactacacagcagaagcaggcaaactcccctgtagaaacaacagccttcagaataaattttttagcatacttgcaatctactcagagagtctatttcagtaaaactatggaaaatgaaattctaaacaagaagcaatttacataatgcagtagaaaaaatacttaccactaccactggccatccctagagactttgattctcctataaaagtagaatggggaaggacaggggacagttttctatctctgtgaaattgaaggcatttaacagaaaaggcatatggctaaacacttaaagtactaattaaacaagtagcatatctacatatcaaaactagactaattctgtcacatatgatccattccaagtgcaagatagactaatggattttaaataacagtacaaaaagttcattgatatggtttcagattccccattgcaaacaacctttaagaaactaccacttggctaggtgcagtagttcacccctgtaaaccacagcactttgggaggctgaggtgggagaactgcttgagaccaggaatatttttttcatttttggagacagagttttgctcttgctgcccaggctggagtgcaatggtgcaatctcggctcactgtaacctctacctcccgggttcaagcaactctcctgcctcagcctcccaggtagctgggattacaggcagccaccaccacacttggctaattttttgtatttttagtagagacggggttttaccatgctggccaagctggtctcaaactcctgatctcaggtgatccacccacctcggcctcccaaagtcctgggattacagcgcctggccagagcccaggaatttgagatcagcctgggcaacataatgagaccctatctctaccaaaaaaaaaaaaaaaaaaaaaaaaaaaggaagaagaagaagaaaagaaactaccatttgtgaagttttgatgtcaaatcaaatacccatagttacctggaaaaaaaactgtcaaaatattcctcctcctaactacatatttgtgtgaaatggattttcttcatatactgcaacccaaacaacatattgtgacagactgaatgcagaggcagatataaaaatacagctgtgttctattaagacagacattaaaaagatttttaaaagcgaaaccatggctgggctcggtggctcacgcctgtaatcccagcactttgggaggccgaggtgggcggatcaagaggtcaggagttcgagaccagcctggctaacatagtaaaacacagtctctactaaaaaaacaaaaacaaaaaaaaaaaaaactgggcatggtggcgtgtgcctgtaatcccagctactcaggaggttgaggcaggaggactgtttgaacccgggaggcagaggttgcaatgagctgagatcgtgccattgcactccagcctgggcaacagggcaagactccgtctcaaaaaaaaaaaaaaaaaggcgaaaacgctaccactgttcttactaatctccttcatttttgaaactatacttctcaataaaaatattgtttattattactttttaaaatgagataagtatttttcaggtttctccagttttagtttgataaatagatataaccctcacaaacacaagctctttgggggtctttactaagggctgtgctagtatttggtctctaaactcctttacagttttagaagtctgttagtccaaatccctatatactccagtgcaagctcacacttctagcctcctacagccccgttcttccctctccccattccctgcagaaagtcaagaaatccaagacaaagttcaggcttcattatgcttttgggatagaagcttagccatgtgagaaatgaaaaaatacacaacacagtatctcattaagagctaaacttaatcataaagacgttaaaatggcataacaataaaaattaagaaaaattaatgctggcaaaggtgcttcacagaaaagaaaggggaaaatgtctgaatgtggtattttcatttactactgacagttttttttaaattaaaaacttttttttctatttatttttagagatggggtctcactttgttgcctaggctggagtgcagtagctattcacaggcataattatagctcactgcagccttgactgagctcctggccccaagtgattctcccacatcagcttcccatgtagcagggactacaggtacatgccactgtgccctgacaatcaccactgtttttgttttttgttttttgcttttttcatgcacacagggataccagttactgttgacattgtaagtaacacatgtgagaacatcttagattattagatcaaacaaaggtgacaaggaaaatacgtgtatattcatatacatacatatcttacagaatgctaaaatagttgtggtaaaatcgtattgattgttgaatctggaaaaatgtataaagttctttcaacttttctataaatttgaaattatttcaaaataagctgggcatggcggctcacacctgtaatcatcgcaatttgggaggtggaggcaggaggatcgcctgagcccaggcattggagaccagcttgggcaatgtagcaagaccccaacctctacaaaaaaaatttaaaaaattagccaggcacggtagtgcacacctgtcgtcccagttactttggaggctgaggtgggaggattgcttgagccaggatttcaagattgcagtgagctatgatagaaccactgtattcctgggcaacagaccaagaccctgtctccaaaaacacaaaagaaaaaaaactttcaaaataaaaataaaagtatttcaataaaaaaagtgacaggagaaagcctactcctttctcagattttcagccgactccattttttataattaaatagatccaaatgttcatatccaactatattagcgtccttctccactgtattaaactagcaaaaagcccactaacctttcttgatttaaaataatattttaggccagatgcggtggctcatgcctgtaatcccagcactttgggaggctgaggcccacagatgacatgaggtcaagagttcaagaccagtctgacccatgtggtgaaaccccatctctactaaaaatacaaaaattagccaggcgtgatggtgcatgtctgtaatcacagccactgagactgaggcagaagaattgcttgaactcgggaggcagagggtgcagtgagcccagatcccgtactgcattccagcctaggtgacaaaacaggactctttcccccactctccccaaaaaaggcttcaaacccatctcaattaaaaaaacaaaaataaattaatgatatttgacatccctacaatggttggaagactctgagtttagccctctagcaatatttgaaaacaccaaggcatttgaaggaaatctccagcaggaaggagataactttaagatcacatagcacacttgttttgcttcaaccagaaattctgctggatgtgtctcagagtggccacaggtgaaggatgctaccctgagaccacaatacaggctaagttggcagtagctgagctgtcaactcagaatactgaatagtttcagtattctacctcctacaacacttgatttattatcatactgaatgtacttgttcctataaacacacctctctacacaacttcctataaaaacatgtgtccctggcaaggcgtggtggctcacgcctgtaatctcagcactttgggaggctgaggcaggtggatcacaaggtcaggagatcaagaacagcctgatcaacatggtgaaaccctgtctctactaaaaatacaaaaattagctgggtgtggtggcacacgcctgtaatcccagctaatcaggaggctgaggcagaagaatggcttgaacctgggaggcggaggttgcagtgagccaagatcacgtcactgcactccagcctgggcgagagagcaaaactctgtctcaaaaacaaaaacaaaaacaaaatgtgtccccatgcaacttcctttctcattctccacagtctgttatacatactttcttttccagctcactccatccaaaatatagtattttactttatagaaaatgatattatatgactgctgtttcctctaccataaatttatctacatcagagtccatcattacttctttccttcctatttatgagaaaaatataatcccccatttttatttctttttaatttggggaaaatgctaaaccagagaatatgcaaaatacacgtgattctcctttccaaggacagcaaatatgccctttatcaccttcttgccacccagtcctccaaccttctagacttaatttttcattccttctctcctcatttctccccctctggctatgagcacagttaaatctctggcatctttaaaacacaagtaaaatccaaactgtttatatatatatcccctatagaagaatctatggattaaaataaatttagattctaattctaacgagctagttttttttttttaattatgagataactggtgaattgaatactgactggatatttggtactagggaaccggtgtgtgtttgttaatggtattgcaattatgctctaaaaaggaacctttttttttttttttttgagatacatgctaatataaagatcaaatgatctggggtttgcttccaaaaaacacctagggttaaatggagggagtgattgggaacagatgaaatcagattgctggccaggcgcggtggctcacacctgtaatcctagcactttgggaggctgaggcgggtgaatcacctgaggtcaggagttcgagaccagcctgacccacagggtgaaacccctctctactaaaaatacaaaaattagccaggcatggtggcatgcgactgcagtcccagctactcgggaggctgagacaggagaattgcttgaatccaggaagcagaggttgcagtgagctgagatctcataaatgtatgtcatgagaacctatgcatacatttaaaacatgtagcataggttctcataatgtatgcataagcaacctatgcatacatttaaacatctgaatacaagatacggttcctccattctctgtttagtcctttgagaacaaggactgtgtctttctcttcactattcccagcaccatgtatctggcctgatacctaggtggtgcctaataaaggatgttgaatggagaaatgattgtaatttggaggggaaaaaattcatctggagataaaaatactggctggtattcttatgagtttttcttaaaagatgcaatctacaaattaagattcttctttttgcaacacctttgttctactgaattttatttactttttttgctgaatattaaaatattataatttaatattttttatttttttggaggcagggtctcactctgtcacccaggctggagtgcagtggagcgatcttggctcactgcagcctcaacctcctgggctcaagtgacctcagtctcccaagtatctgggactacaggcacacatcaccacacccagctaattttttgtatttttctgtagagacagggcttcgccgtgttgccaagactggttttattttattttattttttttgagatggagtcttgctctgtcgcccaggctggagtgcagtggcacaatttcggctcactgcaagctctgcctcccaggttcatgccattctcctgcctcagcctcctgagtagctgggactacaggcgcccgccaccatgcttggctaatttttttttttttttgtagttttagtagagatggggtttcaccatgttagccaggatggtctcgatctactgaccttgtcatctgcccacctctgcctcccaaagtgctgggattacaggtgtgagccaccacacccggccccataacttaaatgctcaggactattacactaatttagtttaatttatactaaactaaatcaacacattctaagaaataaatttgcctggtcagagtaggccaaaacaagagtaaaataaacaactattggctgggcatgatggctcacgcctgtaatcccagcattttgggaggctgaggtgggcagatcacctgaggtcaggagttcaagaccagcctggccaacatggtgaaaccccatctctactaaaaatacaaaaattagccgggtgttgtggcacaaacctataatcccagctactcatgaggctgagacaggagaatcgcttgaacccaggaggcagaggttgcagtgagccaagattgtgccattgcactcctgtctgggtgacaaaggtgaaactccgtctcaaaaaaaaaaaaaaaaaaaaaaaaagaagcaactattaacaattatgtcaggataatagacataataaaccagggctatcatatatctatgatgtgatatacaaaacaggaattccctttaaatgtcaataacttataatgaaccctatttctattttcacattctgttaaacaggttaagcaggttatatttatgaaagtatttaaattatgccagaaatttaaaagtttttggtttaaagccagaaaaatgatttacaagtagccataatcaaaatcaactgtggcagaaatcacatgtaaacattaaactgtattcatatccacgctcaattttcaatggcttcaaacccattctaccaattgactccaggcaactataggtaactgagattctagctctaaactgaagaagaaaaaccactttcccaagtacagcaaattatttaaggatatttaatatcctccttatagaagattattagaatcctaaaacattacaagaattaaggaaatttatgtccaaacattgtacttttttcttgtctttggttccctcagattctgacagatttcttcacacttgaataagaagtctgccagcagggtcagtgggtccttggaggggttttccactccctttttaccccttcctcctcctggcacccagctggacttgtggcccaatctcctaccccaaggcagcagagccacattcagccaggtagggattttgattttaatccctggtcctctcattcaacactcaaccttgggtacctttctttcctactctgcctcatttcctcttagtgtacaacaagggaggaaaggccaaatcatctgccagaactctcctagaagagagaaatctcaagccgggtgtggtggctcatgcctgtaatcccaccactttgggaggccgaggagggcaaactgcctgagctcacgagttcgagaccagcctgggcacaatgaaactgcatttctactaaaatacaaaaaagttagccaggcgtggtggtgggcgcctgtagtcccagttactcgggaggctgaggcaagagaattgcttgaacccgggaggcagaggttgcagtgagccaagatcgcaccactgcactccagcctgggcgacagagagagtctcaaaaaaaaaaaaaaagaaaagaaaaaagaaaaaaagaaaagaaaacaaaaatctctgcttctttgcattactaataggtaattaaaggctatgacaacaatacttgatgcagcaatttgctttctaccttgaaacatgcaataaatacacaagtctatgtcttttgtacccactggtcataaccatgacctattctttctttttttttttgtcatggagtttcactcttgttgcccaggctggagtgcagtggcacaatcttggctcactgcaacctctgcctcctgggttcaagcgattctcctgactcaggctcccaagtagctgggactacaggtgcccgccaccacgcccggctaattttttgtatttttagtagagatgggatttcgccatgttgggaaggctggttgacctattcttttttttttttttttttcttgagataggtagggtctcagctctgttgcccaggatggagtgcagtgttgtgatcataattcactgcagtctcaacctcctgggctcaagcgatcctcctgcctcaacatatggagtagctgggactgtgggcatgtgccaccatgccaggctaatttttgtagagacaggtctcactatgttgcccaggctggtctcgaactcctgggctcaagcaatctttctgcctcagcctcccaaagtcttgggattacaagcgttgagtcaccacgcccaacccataattgtgacctattctatagaaaggggtgttaacagtgtgtacaaacacataccaagtcatcagaagaggggtcaatccatgctctggcaggtgatcaattttcttttttttgagacagagtctcgctctgttgcccaggctggagtgcagtggcgcaatctcggctcactgcaacccccgcctcccaggttcaatcagttctctgcctcagcctccctagtacctgggattacaggtgcccgccaccatacccaactaatttttttgtatttttagtagagacagggtttcaccatgttggccaggctggtcttgaactcctgacctcattatccacctgccttggcctcccaaagtgctgagattataggcgtgagccactgcgcccggccgatcaattttcttaaaccaaatcaaataaggtgtcctttaactcagccactcagaattctacattaatccatttcagttggttgactaggtcaaactgcagtttttctttcactaatttggatgaatctaacataaaaaagacaacaatttaacgctatcttgagctgtaatcacttattcattcaactatcccttaagtacatatactacgtgccaggttccatttaggttctagggataaagcaataaaaaatcaccacccagctgggcacggtggctcacgcctgtaatcccagcactttgggagcctgaggcgggcagatcacctgaggtcaggagttcaacaccagcctggccaacatggtgaaaccccgtctctactaagaatacaaaaactagcccagtgtggtggtgtgcatctgtagtcccagctactcagaaggctgagacaggagaattgcttgaacccaggaggcgggggttgcagtgagccgagattgtcccactgcactccaacctgggcaacagagcaagactgcgtcccaaaaaaaaaaaaaaaaaaaaaaaagaatcaccacccatagagagcttacattcttggcaagcaacatcaacaacatagtaccaggaatgatgcggagtggggtaggtatcctgctctacttatgctggctaaactacatctggaaattgtattccattctaggcataggttaagaggtatgatatattagttatcaatttattgcctttcagttccaaatctatactttactgctctgctttgcaataatgaagctggactcttcaaatgtttttcttatgccaatagcaagcactggaggaatactacaggaggaagaggatttcctcctggttccactgtgttttcctcttctttctcccgtggcctcatgtgatgcgtgggacacccagcggtgctcacccaccagttttagggataccacaatgagtggcttcaggtgagttccagtcaccccagctaacttcccagtgattttcgacagcaccacccagagcagcttcctagacagttttgttggcactccagcaaacaatactcttgcttttaaccctcggctggtgccatcctcaggaacttaaaactgcaacagactacagctttacctcctcaaaaggtctgaatctccgccttgggtaggctctctctccaatctgtctctttctttcatactctgcctcaggcacagagggagtagctgctcctatagctgatacacctacatctttcagagttctctttaccctttaatggttaatctattactagttaataattctttatgttaactttcccttgttcaaattgcaatatttctgtttccagactgaaccctgatccagaactggtacaaaaagtagggtgatctcagaggacggacttaaaaacatgggatttagaaattggtttggtggcactcttgggtttaagtgcagtgctaagcaccttgccaatgggaaaggggatgctagtaatccaggacatgcaagatcgtggcaataatatactggcaaaaaccttcagaacatgtgtaggagtagatcatatagctggaggtggctctaacagttcacctcattggttgactgaaattttagactcgagtaaattatgtttaaaaaaaaaaaccaaaaacaaatttcagctgtggcacatgactgggcttggtggagtttcaagatgctgatgaatttaaggtctggcgcttgaaagaatcagtgaagcttttcaagtagatgagatatatttgaatatgtaacctttagtaactacagaatagaggttgctttttttgtttttttggtccctttcataggggtagcaggggtgaattctgaggtggccccaatcatctgtaggaatattcacctgacagtttcgtgtttctccccatagctgagttggtcttgtagaaaatttctacggaattcaattccattatttaaagtagcttttctatgaaccagctgtggtctgtaacttgacagtgttaataccaaatagcaagacctaatcatggttcacatactcaacaaatatataagactagtttttcaagtaggtcagttttggaacacattaattgtaactagattagctattttacaattaagacaactttataaactgctttaatttataaaggttttaaaattacattcttttgactctaaagattgttgttttacagcatattcttaaatactactgttgagccatatatatgacaatggtgaactttaatgaatatctgcacatctgtagtaaaatgcaatgctaccttcatttttttgttggtatgctgaagaaactttttaaagtatctcactttttaaaaaattggtcagaccctctccctctccctcctctccctcctctccctctccccacggtctccctctccctctctttccacggtctccctctgatgccgagccgaagctgggctgtactgctgccatctcggctcactgcaacctccctgcctgattctcctgtctcagcctgcctagtgcctgcgattgcagacgcgcgccgccacgcctgactggttttcgtatttttttggtggagacagggtttcgctgtgttggccgggctggtctccagctcctaaccgcgagtgatccgccagccttggcctcccgaggtgccgggattgcagacggagtctcgttcactcagtgctcaatgttgcccaggctggagtgcagtggcgtgatctcggctcgctacaacctccacctcccagccacctgccttggcctcccaaagtgccgagattgcagcctctgcccggcagccaccccgtctgggaagtgaggagcgtctctgcctggccgcccatcgtctgggatgtgaggagcccctctgcctggctgcccagtctggaaagtgaggagcgtctctgcccgcccgccatcccatctaggaagtgaggagcgcctcttcccggccgccatcccaactaggaagtgtggagcgtctctgcccggccgcccactgtctgagatgtggggagcgcctctgccccgccaccccgtctgggatgtgaggagcgcctctgcccggccgcgaccccgtctgggaggtgaggagcgtctctgcccggccgccccgtctgagaagtgaggagaccctccgcccggcagctgccccgtctgagaagtgaggagcccctccgcccggcagccaccccgtctgggaagtgaggagcccctccgcccagcagccaccccgtctgggaagtgaggagcatctccacccggcagccgccccgtccgggagggaggtgggggggtcagcccccccgcccggccagccgccccatccgggagggaggtgaggggcgcctctgcccggccgcccctactgggaagtgaggagcccctctgcccggccaccacccagtctgggaggtgtacccaacagctcattgagaacgggccatgatgacaatggcggttttgtggaatagaaaagggggaaaggtggggaaaagattgagaaatcggatggttgctgtgtctgtgtagaaagaagtagacatgggagacttcattttgttctgtactaagaaaaattcttctgccttgggatcctgttgatctatgaccttacccccaaccctgtgctctctgaaacatgtgctgtgtccactcagggttaaatggaaaaaataaataaataaattaaaaaaaaaataaaaataaaaataaaaataaaaaattggtcagatcgcgagatcaggagttcgagaccagcctggccaatatggtgaaactctgtctctactaaaaaatacaaaaattggtcgggtgtggtggcatgagcctgtagtcccaactactcgggaggctgaggcagaaaaattgcttgaactttggaggcagaggttgtagtgagccgagatcgcaccattacactctagcctgagtgacagagcaagactccatctcaaaaaataaataaaatacaaaaaaaaaattggtttgtgtattttatatgcttacatatttttccatggtactgtaggtcattttagtgattaaatttgacacttttgacagaaaaacaggtcaattagttccttgggatcaaaaaggggttgattgcaaaggggcaggagggaattgatagagtgattttacaatggttctgcatcttgagtatggtatgactatgcatttgtcaaatcttagggtgaactttactgaatgtaaattcatgcttcaataaacaggactttaaaaacttacaaaaaaaaacacaaaacaacaacaaaaggactgggtgcagttcacacctgtaatctcagcaggggggccaaggtaggaggcttgagcccaggagttcaagcctagaatgagcaacacacagagaccccatctccacaaaaaataaaaaattaaccaggcacagtgtcacatgcctgtaatcccagctactcaggaggctgaggaaggaggactacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcaaaaaaaagctcggaagataatcctttcactcaggcattgagaaatccattagtgaggtgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgtactccagcctgggtgacagagtgagactctgtctcaaaaaaacaaaaaaaaaaacaaacaacaacaaaaaaagaaatgcattagtgaggggatcaccttcatccttgaaaagctctgtggttgctcccctttgcagtgtgtccctgttcccctagacatgggttggcaaactttatttataaagggccacagataaacattttaggttttacagtccctaaggtctctgtcacaacccctaggtatggccatgggaaatgccaccactaagtgggttccctgatttaaaggggtaacgggatcctaaaataacagaggccaagtagcagcatgtaatcaccaaagacaaggtgggaaatctactataaatacagtaaagttgtactggtaatcagaacaccttggcccaccaggatctttggcagtaattgatcacacagtattccacaagcagcctaccaaaacagattcatctgtacaactgaaaaaaactccagctctggtagtaaaaacctgactagaaaagttttgacctctcatctaatttctagacccaagtcaattaacaagcccaggtcccctgaggaaaaacctgtagtgttcccacaagtacaagtacatactgtaaatcctcatccaagcttccccaaaggccatttactagagtgactacggattagagaaaaggaaatacccagacctttcagggattactaattcctggggactcaaaatgctactgtggcctatcagtcaaagtgagtgctgacagtggtcaggtaatagatgaaatgcttagctcaagtccacctcacagtggaccccatagtacaatgggcctactttgttgttatctcctcagttcctgaataaatacttggaacagacatacttgactattggcagagctcccatattggctttctgacccaactgataagagtcattttaatagtaagggctaaatggaagcccctagaacttaccctccctactaagatattaagccagaagcaataccacatctcaagaattaaagagcttaatgtcaccatcaaaagacttgaaagaaacagggtagtgatacctattatatcttgatttaactcgccagtttgtcctgtgcagaagtcagatggatcttagtgactatcataaactcgtggactatcataaacttaatctggtgatgattccaattgcagctgatgccccagatatagcatctttactggagcaaatcaacatgggtcacggcacttggtatactgctattaacctgaataatgcctttttcttcatacaaatctgcaagaaccaccagaagcacattgcttttacctgccttttacgtgcctatgaatctagcctcagggctatgccattctcctaccataatgtagcccacagagatcttgatcgcgtgacattccaaaaaaataaataaataagcacgtacacacacacacacacacacacacacacacacacacacacacacactagtcaactatactgacattatgctaattgggtctgataaatagcaagtagcaaatacgttagatgctttagtaagacatatacaaagtagttgatgcgagataaaccctacaaaaattcagagacccactgcagcaatgaaatgtcaggattcaattgctcaaaacatgtcaaaatttcccttccaaggtgattaagttgctctaattaacatcaccaacaatgaaaaagagggtacaatgtttggtaggcttcaacccagctacaaagttacctacaaggttgacagtttagagtgggtttcagagcaagaaaagattctatagcaagttcaagctgtggttcaagctgctctgccatttgggccttatgatctggcagatccaatgatacttgaagtgtccatggcaaatagggatgctgaatggagcctttagcaagcaagaataagagaatcactgcccagacttctagaattttgagaaaatctatgccctcttttgcagaaaattattcacctttcaaaaaatagtttcaggcttgctattgggtcttggcagagaccaaatgcctaaccatgggacataatgcaaccacgtgtcctgagcttctcatcaggaactagatgttatccaacctatgtagtctagcttggcatgtgcagcacgatctatcatcaagtgaaaaacacgtaaaaaaaaaaattcaagcaggtccagaaatatgagtaagttacataggaggtagctcagacttcagcattgagttctgttgcattgcttcctctccctcaatccaagtcaatggcctcctgagagctccatatgaccagctgactggggaaagaaaaaactcaagtctggtttacacatagctctgcacaacatgccagtatcacccaaaagtggggagctgcagcactacagccccatttaaagaggtaggactgaagggcagtgatgaagaaaaatctttccttcagagggcagaacgttgaggggtacatttggttttcccttttgcctgaggtaagacatggccagaagcagagatttatactcatttatgaacaattattaaggattttgttggctagttaggaacttggaaggaaatggtgacaaggaaatctgggggaaagatatgcagatgaaactctcagaacaggcacagactgtgaagatatttgtgtcccatgtgaataatcatttgcattcactgtagaggaggctcttaataagcaagttgacaaaatgacgtacttcatgaatataaatgttagacactttccatagctacaagagtgcttgctcaataaaacccatggaaaaaatcatcatgaaggctgtgcatggactcaacaacatgatcttcccctaaacagggctgacctgactaaagctactgctaaatgtctaatctgttaatggcacagactaactctgagccctgaatatgcaccatttcccaaaaactagctaaccacctggtggcaagttgattacgctggacttctattatggggaataagggcaggggtgagggaagagatttgtcctcactagaatagacatgtattctggatacagatttgccttctctgcctataatgtttttggcagttccaccacccatgaacttatatataagtgcccaatctaccaccatgacattccacacagtgttgcggctgcttctttttttgagatgaggtctccctctgtcgcccagtctggagtgcagtggcacgatcttgtctcactgaaacctctgccttctgggttcaagtgattctcccgcctcagcctcccaagtagctgggactacaggcatgtgccaccatgcccggctaattttttttgaatttttagtagagatggggtttcaccatgttagccaggctggtctcgaactcctaacctcaggcaatctgcccgcctcagcctcccaaagtgctgggattacaggtgtgagccaccatgcttggccaaaaaaaaagatgtatttttaaaatagagacaaggtctcactatgttacccaggctggtctcaaactccttggctcaagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagggagacaacaccctgaaaggatggggtaatgatttcaatcagagacaccttacatggtgctgtctcctccctcaatcagaatatacaggtctgggaatcaaagggtagaagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgctacacagtgaaagcaaggaggactatgtctgaaacccaagggattatctaaggcacctcttaatacttccatgccaaaaataaagattaatggaaaactacagcaaccaaaaaaggactggactaatgagggaataaatgtttgagtcatttcaccaggtaaagaacctcaaccagctgaggttcgtgctgaaggcaagggaaacatgaaataggtaactgaagaaagaagcctagatatcaactgtggcctcattactaatcacagaaatgaggatgaactttctctttgttatatttggtatttgtttgtatattctaaccattttcttctttccttcttcccattattataagttggaattagttcagtttagttttgtttttttgagaccgagtctcactctgttgcccaggctggagtgcagtggtgcgatcttgactcactgcaacctccgcctcccagcttcaagtgattctcttgcctcagcctcctgagtagctgggattccaggggtgtgcaccacacccggctaattttttttttttttttttttgagaccaagtctcactctgtcatcaggatggagtgcagcggcaagatctcggctcactgcaacctccgcctcccaggttcaagcaattctcctgcctcagcctcccaagtagctgggtctataggcgtgcaccaccacacctggctaatttttgtatttttagtagagacggggtttcaccatgttggccaggatggtcttgatctcttgacctcgtgatccacccaactcggcctcccaaagtgctgaaattacaggcatgagccaccgcacccgccttgaaattagatttataatacaacttttggtaacaaactagtcagtggaactttgttttctgccacatgaaaatctttaaagcttatgctgacgcatatctgaatgcttgtcatcaaagtgtgcagtaaaaaaaaaaaaggcagtttaagaaaatttgagcatttcaaagaaagcacttttaaaaatgtatatacatgaaggtggccgggtgtggtaactcacacacctgtaatcccagcacttttggaggccaagcgggtggatcacctgaggtcaggagttcgagactagcctggagaacccccgtctctactaaaaatataaaaatcagccgagcgtggtagcacacacctgtggtcccagctacttgggaggctgagaggcaggagaatcgcttgaatctgggaggcggtggttgcagtgagccaagattgtgccactgcactccagcctgggcaaaagagcgattttcaagggaaaaaaaaaaaaatgtggctgggcgcagtggctcacgtctgtaatcccagcactttgggaggccgaggtgggcagatcacaaggtcaggagatcgagaccatcctggctaacacggtgaaaccccgtctctactaaaaatacaaaaagaaattagccggacgtggtggcgggagcctgtagtcccagctactcaggaggctgaggcaggagcatggcgtgaacccgggaggtggagcatgcagtgagccaagatcgcgccgctgcactccaccctgggcgacagagcgagactccatctcaaaaaaaaaaaaaaaaatgtatatacatgaagaacattttgctatatcatgaaataaatgtagcgctgtaagataaaggaagatgaatataaatggagttttggccatttttatttttttttgagatgaagtcttgttctgttgcccaggctggagtgcagtggtgcaatcttggttcaatgaaacctctgcctcctgggttcaagcaattctcctgcctcagcctcccaagtaactgggattacaggcactcaccaccatgcccagctaactttttgtatttttagtagagacagggtttcatcatgttggccgggctggtcttgaacttgggatctcaagtgatccgcctgcctcgcctcccaaagtgctgggattacaggtgtgagccaccatgcccgggcagagttatgcccattttgcccctccacatgctgcagccatctttaacctgtttaacttaatgattatagttttgtttttcttttttcatcttattcagtatatttcaggctattcagcagatgcttgtgattctggaggttcaaatcactggtaaaagtttattctgtttcctcagtttttcaggagcttttctccattaaatgatctgctgcctaaagtaccctctgtcttcctcatcaacaggcgctaaattcaaaaagtaccttactgaaacttttttgttcataactttcattgttggagttaggtcatatcctgctaacaacagtcttattgatcagttgtaaccccatatgttgtgtttttattcttacttataagaggtaaatttttgtaacagtcacatcctttaaatgatacttcattatattcaaattctatatgtagacaatcttcaatgcccacttccatcaggatagctggcaagttggtgaacagtaagatcacattctttttaccaagtctgtcagtcttcttactactaacacttcaatacatcaagaggacattagcaccaatgtaagattctcatgacttttcaacatgtataaattccaaatgacaacttctgagtcagctctccaggtaaggctagttctttcactaggtttacaaactcttgaatattactcttatcatagaaaagttcaatttgacgtacaaattcaattctaatgttgtggtgctctagctctttctagactctttcacctttcctgaaacagattctccatcatagaggagatggtgtttttctacttcgccattttcagttttcacttctgccattttctttgtttccttatcattaaggacaatatcaatctcacaaatcagaccaaaaaagcctccaaaaaacctcactgtcagtgatactgccacatcccccaatacttcactcctcttccctcagaactccaagcccctggctcccatcacatgaccttggccctctgaagctggaacttctatttgaggactgataaacagccagcaggccaagcacagtggctcacacctataatcccaggacattgggaggctgaggccggaggattgcttgagctcaggagtttgagactagcctgggcaacacagcaaaaccctgattctattaaaacaaacaaacaaacaaaaatatagccagcaatggatacaatgactatggggctgagcatgtcctcattcctcattttagaacaagggtgagagtttcaccctctgacatagctgtatcttgttaggtagaaacataagagtttcattgttatatgggagctcaaatgtgtgtaaagtgcatatggaagctaagtagccaaaataataggctatgcaagtaatcaatatattgcctctcaattccaaatctacctttcattgccctgcctgtaataatgtaaacatttcttcctagagagcgggcatgatgacactaagcttagtagagggcatggaaggaaagggtttctcttcctggttctagtgtgcttttgcatcttcttacttccatggtgctctgctggtgtgcagaacaccccatggtgctcatcccaacaagctttagtgggcattctcatggacatcttcccaggcaagttccaccagtgcctcaaacaggcttgctggtgatgccgcagcacccccaagtacagcttcctgcttaactacctttgaggtagaagaccagcaggacttaatttcctgtcgcaccctgctgattggaacaagatctggctgaaaccagcagatgctgacaaaagtaacctcgagttgccctcagggtttattagcataaagacactcctaccagtgccatggcagtttacaaatgccatggcaacagcctagaagttaccttatctgattcccagaaacttccagccccttttccagaaagttctaaataacctgcctcttaattagcatgtaattaataacagatataaacagctagctagcagctcacagacaccgattctgggcacactgcctatgggttagccctgctcagcaagaagcagcactggttcaataaaagtttctttctctcactactggctcacccttaaattctttcctggcaaagccaagaaccctcctgggttaagccccagtctgggggcttgtttgccccacatcaccctgacctgcagcaactcagcaaacatctttactaccaaatggagacttcctccaagatatgcaatcagctttgggggcagggtgggggaggggcgcatacttttccaaatttgttatttctttgtgtactctgccccagccctaagggtagtgactattccctatatctgtcattcctgtattctttagagttctctttacccctatagtaaattctctgttcaatttatggtgtagcttctgtctcctgaatagactctgatccaaatattggccattaaaaacagcataaatctacataataggaaagagtggaagaaaaaatgaaagatgtttaacccaaagaaaataaatcagaaggcaaatgttaatctctaaatgtctaaaaagctatcacctaccgcagaacatactgtatctctgttgctcagcactaacagcagcagcagaaacagcagaatgcctgttcgttttacacagaaaaactgaagaccagaaatattaatttgttaaatagaaagcaaaatccttcaatgaagacctctaaggagtctaatgttaatacttaagtttacagttgacatagttttgcatcttctcatttcattttaaattgctgaaaacccactggagggccaggcttgccagttttttgcagtgagagtcctaagttaattttttcacaagaaacaaaacaaaaaaactcttctttcagtctgcctggagctcacttttgaagtttcacctccagttttgtcctctagaaacagagcatttctgcttcacaatggaccaatatgctccagttacatccgattaaaatactgttacacaaccaattaagtaggaaaaggggctgatggtcaaacagaatgatttaacaaaagtatataatgggttgaactgtaagaactttctatgtggacattaatcatcattctaatatcatcttacatttaaatattaaccccttcaacgaggtttcaaagcactgaaaataatttctgtcacttcaggcaaacaactatttttatagagctctccttttacacagcaggaatcttagcctcaaagagggcaaacaacttgcctaagaaatcaaagctagtaggtgctctatccacagcttcctcaaaatttaaacaaattcatgacagataacatatttccagaaagatgcgtaccaataacctggcaagaattattacgattgtatctggtcttgtttttaagtttcttttcccatgtgaggccagaaacaaatagatattaaagattattcattcaatagctacagaggatctactatccaccagacagtgttctaggtgctgggccacagcagtgaccaaaacaaaagccctgtccctctcataaaatttgtttctataatatcttcttctggtggggaaaggcagatgagataagtaaactatacaaattattagaaagtgacatgacaaaagccacgaagaaaattcaagtagaacagtgggacgaaaaaatagaaggggtgcaatttttaaaaagatagtcgagaagtactcattgagaaagtgaagagtcaatcatgaatatatcaaagggaagaacattccaggcagagaaaactgctagtgctcagagctcaaggcagatgcccacctggcttgttcaaggaacagtagcaagaacaccatgaagcaaagtaagtaaaggggtaactaagaaaagatctggtcagaaagatgacaacgacatcatagggccttgtggtatttcataaggactttggcttttactttgagatgggcaaccactggagggttctgtgcaaaagaacagcatgatcaatgtacaggaccactgtagatgtttttaagaatatgctgcagggagcaagcaaatggaagcagagagactaatttgggaagttattacagtagccaaggttaatgatggtggtccaatcagggagagagcagtggaggtggtgagatgtggtcaggttccaaatatctttttctgacaaactgggtgtggggtgtgagaggagcagaagaggatagggaaaccaaatgtttagccttaacaaccaggacagaatttccatttaaggagatggggaggcaggtggtttttttcttctttttcttctctgttttgattttggggtggggcaatcatgaattcagtttagaacatttcaaatttgagatatcaattctacatccaaatggagatttcaagctcgaatttcaaatttccttagttctcactcaaccccctcatggaatttaaccaatattgtatctgttcttacaaaatgttccccataactgcttagcatttaagcaatgttgacatatttgtgtatttctctctgcaactggacaaaccagaacaaacgtacaaaatacctaacatataaagcatccctttaattctgaagagatctgtgatatgatggttaatttgaaatttttttccctttaaatatgagctgcatttgtttatttctacgattttaacgatttttaagtgtacagttcagtggtattaagtacattcacactgttgtgcaatcatcaccaccatccatctccagaactttttcatcttgcaaatcagaaactttgtacccattaagcaacaccaaacacatccattccccgcctctcccagcccctgggaaccaccattctactttgtttctgtaaatttgactacttaaggtaatttatataaatggagtatatttatatttgtttctgtaaatttgactactttaggtaccgcatataaatttgtatttttgtgactggcttttttcacttagcatagtgtcttcaaggtttattcatgttgtaccatatcagaatttccttcctttttaaggctaaataacgttccattatatgaatgtaccacatttttgtttattcattccatgtgttgatgggacatctgggttgcttccatcttttggccactgtgaataatgctgctacaaacatgagtgtacaaatatctgttcaagtccctgattccaattcctttgggcatatatccagaagttgggttgctggatcttacaataattctgtttttaattttttgaggagccaccatactattttccatagcactttcattttacattcctatcagcagtacacaagggttctaatttttccacatcctcgtaaacacttgttaatttctgttcttgttttcatactagccatcctaatgagtatgaagtgatatttcattgtggttttgatttgcatttctctaatgattaatgatgctgagcatcttttcatgtatttcttggcaatttttgtatcttttatgaagaaatgtttcttcaagtcctttgcccatatttttaatttttttttgttgagctctagaagttatttacatattctggatattaactcctgagaagatataagatttgcaaatattttgcctccatgggttgccttttcactctacagagatagacaaaaattttcaattttcatatagcctaatttatctgttttttcttttgtcgtctgtgtttttggtgtatatccaagaaaacactgccaaatccaatgtcatgaagatttccctctatgttttcttctaagaaatgtatagccttggtgctttgtttaggtctttgatccattttaagttaatttttgaatataagataatggtcccaacttaaaaaaaagagagggagagacaggatttctctctgtctcccagggtgaatgcagcggtgtactttaccatagctcactgcagccttgaactcctcagctcaaaggatcctcctgcctcagtttcctgagtagctgggactacaggcccacactacctttttttttttttttttttttttttttttttttttttgagacagagtcttgctctgttgcccaggctgaagtgcagtggcgcaatcttggcttatgtaagctctgcctcctaggttcatgccattctcctgcctcagcctcctgagtagctgggactacaggcgcctgccaccatgcccggctaattttttgtattttttagtagagacggggtttcaccatgttagccaggatggtctcgatctcctgacctcatgatctgccctcctgggactcccaaagtgttgggattacaggtgtgagccaccgcacctggccaatttttttttcttttaagagatgaggtcttcctatagtgcctaggctggtcttgaactccttgcctcaagcaatcctctcacttggcctcccaaagcgctgggattattggcataaaccactgttcccagcaggatccaacttttttatgtggatatccagttttcccctcatcatttattgaaaacaccatcctttcccattgaatggtcctggtaccgttgtctaaaatcatcttaccatgtataaaagagtttatttctgggctttccattccgttccttgatctatatgtctccctttaagtcaataccacacagttttgattattatagcatttcagtaagttttgaaaatcaacaaatgagacttccaactttgttctttttcaagattgttttgtctattcaggagggctccttgagattccgaatggatttttctatttctgcaaaaaacattgttcagattttgaggaaaaaatatcatcttttaaaaacacatttagggccgggtgcagtggctcatgcctgtaatcccagcactttgggaggccgaggcgggcagatgacctgaggtcaggagtttgagaccagcctgaccaacatggagaaaccccatctctactaaaaatacaaaattagctgggcgtggtggcacatgcctgtaatcccatctacttggaaggctgaggcaggagaattgcttgaacccggaggcggaggttgcagtgagccatgaacgggtcactgcactccagcctgggcgacagagcgagactccgtcacaaaaaacaaaacaaaacaaaacaaaaaacacatttaggctgggtgcagtggcttacgcctgcaatcccaacactttgggaggctgagatgggcagatcactgaggtcaggagtttgagaccagcctggccaacatggtaaaatgctgtttctactgaaaatacaaaaattagctgggcatggcggcaggcgcctgtaatctcggctactcggcagggtgaggcaagagaatcacctgaacctggaaggtggaggctgcagtgagccaagatcatgccactgcattccagcctgtgcaacaaagcaagactccttctcaaaaataataaaataaaatacacatttaggccgggcacagtgactcacacctgtaatcccagtactttgggaggccgaggtgggaagaacacttgaagcaaagagttcaagcccatcctgtgcaaaaaagcaagaccctgtctctacaaaagattttaaaaattagccaggcatggtggtgtgcacctgtagtcctagctacttgggaaactgaggcgggaggattacttgaacccagagttccaggctgctatgatcacaccactgcactccagcctgggtgacagagtaagaccctgcctcaaaacaaaaaaacactttaaatcgtcctaccagcgaccgacatttcaactgctgcttctgaggctcatagttgtagcgatcatttgtgtgtatctttcttatccacaaccgtagcatttttcacaaggaatttatccttgagaaatgtaaaaagcatgtaaaatttaaagctaacagaacttgagcaaacaatagactactcaataataattgttggatactgcaatacctcactttcactaatggatagaacaacaagacagaataccaacgaggaaagagaagacctatataacactatacaccaactacatctaatggacatcttacagaacattccacccgcatcaagagccgaatatacattcttcttcaggacagaccatatgttaggccagaaaacaagcctccatatattgaaagggattgaaagaataccaattatgttctccaaccacaatgggatgaaattagaaagtaaacagaagattggggaatgcacaaatatgcagaaattaacacactcctaaataatcaacacgtcaaagaaatcccaaaagaaattagaaaatactttcagatgaatgaaaatgaaaacacaacatatcaaatcttaagaggtacagctaaaacagtggtaagagggaaatttatagccataaacacctatattaaaagaataaaataaaataaaaatcaccaatcactaacataaccttctaccaaaagaaactagaaaaatagcaaactaaactcaaatgaggcagaaggaaggaaataaaaaagattaaagtggaaataaaggaaacagaggagagaaaatagagaaaactcaccaaaactgaaagttggttctttcaaaagatgaaaaaaattgacaaacttttaactacatttatgaagaaaaaaggagagaggattcaaactactaaaaccagaaatgaaaaggagatatcactatgaatcttacaggaataaaaaaggtttataagggaatactaagaactgtaggcaaacaaattatataacctagatgaaatgaacaaatttctagaaacataaaaactactaaaactaactaaagaaaaaaacgtttgggtggaaaattccaaaactaacatctgtggctatctctatagtttctaacaatgcagctcaagaattagcacctggctaggtgcagtggctcacgcctgtaatcccagcactttgggaggcgaacatgggtggatcacctgaggtcaggagctcaagaacagcctggccaacatgctgaaaccccatctctactaaaaacacaaaaattagccagacatggtggtgggagcctgtaaccccagctactcgggaggctgaggcaagagaatcacaagccctggaggcagaggttgcagtgagccaagatcacgccattgcactccagcctgggcaataagagcaaaactctgtctcgcggggcgcggggagagaaaaaaaaaaaaggattagtaccataatagatggagttccttcaaatttcctctacagagttgaaggatctcatcctctatggtaaggcataagcagacaaatcttatgttaagagaatcttgctttgaagtaacctcttggttagacacttcttgtgcccccacctcacactctgttaagttcactatttattctagctattgctacagcatccagctgcacataggtgtgatttgacagcactttgtatcaaccaaaccagagttttctgccctacaacttctctgacaccaagagacaagacatctgcatcctggcaccacacatgtgcaaatccagaagtacaagagtgttaggcccaggaggcagagcttgcagtgggccgagatcgcaccactgcactccagcctgggcgacagagcaagactctgtctcaaaaaaaaaaaaaagagtcttaagcaatgagagatggtaaatggtgaataaatgttatccacttctataaccaagatactcaggtagtgaacactgagaggcattctatacaggtcctcaaaagaccccaaaagacttaagcccactttgcccacagcagtgactaggtcagtagtcatacttcactgtattcttttcctctaatttcacttttcccagtatcccactcttgtgccctggggccacttcccaaaataaactacctacatgcaaagcccttgcctcaatatggattttctctcagtaactagaacttaagataggttttttaaaaagtctttaaaagctgggcatggtggctcatgcctgtaatcccagcactttgggaggccgaggtgggtggatcacctgaggttgggagttcgagaccagcctgaccaacatggagaaaccccgtctctactaaaaatacaaaattagccaggtatggtggcgtgtgcctgtaatcccagctacttgggaggctgaggcaggagaattgcttgaacccaggaggtggaggttgtggtgagctgagattgtgccattgcactgcgctccagcctggggaacaagagcaaaactccatctcaaaaaacaagaacaaaaaaacccaaaaaacatcagaaggctgggcgtggtggctcacacctacaatcccagcactttgggaggcagaggcaggtggatcacctgaggtcaggagttcgagaccagcctggccaacatggtgaaactccatctgtactaaaaatacaaaaaattagctgggcatggtggcgggcacctgtaatcccagctacagcaacttgggaggctgaggcaggagaatcgctcgaacctgggagacggaggttgcagtgacctaagatcgtgccattgcattcaagcctgggcaacaagggcgaaacttcgtctcaaaaacaaaaacaaacaaaaaaaaatcagaattatattttcacttaaagctcaagaagaagctattttgtcttattcaatacaaagccccaaaagaaactgaaataacgtggcttagagtattaattaaatgcttggcttagaaaaggattgtagtccatgagctggtttcaatggagtcctaaacactctaaacgtaaatgtaacatcttgtatatgggtatatgtggacttttctgaagagaaattctgtatttttattagaaaaccatgaaccaaaaaaactttaagaaacattacgtgctgttaatttgctgatgtgtctccagcatgcaactcattaactggaaaatgaaagaaaagaaataaaactttgttccaggaatttggtggagttcggatggatgtcttgctgtctatacatagcaacataatgtgcagcttatgtctgggctccacttgtgagttatgatgccaatttacagcgtggctccaatagctgttcagaaactctaacacaccacagatttatttatctgttaatatttcacatttttggtgcttttgcatttttctgatgctaaatcctttgcatcctaccagatgagatagtgatgaagcacacagaataccttctgtgtcatgatattctaaaaaagtagatttactgtttcactgctggcatgactttacacatgcaaacagttatcacaatagtaaactgtttacctactctaattacgatggaaacaaccagtaacactgccatttgtacagcacttagtgcaatgtgtctagccccaaacactataaataagagtaatttacctccatggtcgcacagagctttatcccacaaataatttgtagttaagtcttgttaaaccttcactgtaatggaaacggcatcaacataaaattgaggataatacagtattacacatgatttaggaatgaaactaacattctgtgcctgctggaccagtcctgtgtctttgcctagaacaccctctagcctcccaccatattatcaagtcaataaggaggaagaatccaaatgaagccaggtttcacttcgcatcagggatgaggacaataacaaaattcaagaattgcttcaattaccaaaagctttaaacctagggtatgtataagaaagttaatggtcaattattccttatagtatttaaaatctgtgctttaaacctgagaacagattactgagctgttttaataaaaaggaaatctaaaaacattaaattaagtgttcttaactaaaatgtctgccaagcttaaaaagttccttatgctatgcaaattacttagatataaaatatttttaatgtcttaattcagtcaacatattgtacttgcaaccctactgtaaacaaacactaacccagaatggctagggaactgcgcattttgttgaattcttcccagatactgcatactgggttatcaaataacaaagttatcaaattaaatgttactgaatgtagtaaattttatctgataattcaggaggcactttaggaagactttgaatgtgaattttaactgcactaaactaaatgtagtgttagaaattaataaatgtagtattagaaagcatctaacaacaattgatataccatggaaacctccttttggaataacttcttcacacctttctgtcaagtgactttctcaccaaatgacattaaatatcagtagtcatttgaacttcttaacttttataattctggataaaagagagtttacaataactatcaaaaatcataagtgggctgggcgcggtggctcacgcctgtaatcccagcactttgggaggctaaggtggccggatcatgaggtcaggagatcgagaccatcctggctaacatggtgaaaccccgcctctactaaaaatacaaaaaattagctgggcgtggtggcgggcgcctgtagtcccagctactcaggaggctgaggcaggagaatggcgtgaacccgggaagcggagcttgcaatgagccgagatcatgccactgcactccagcctgggcgacagagcgagactccgtctcaaaaaaaaaaaagaaaaaagaaaaaaaaattcataagtgaaaatgcttgacaaaaacttaaaagtccatacaattaatccgggtgggattagaagctatattagacctagaacttgggcctcaagtctttacccaacttgtgttttagtaacattatatttcaacaattatgaccccaaccaaatccagtccataaggtgttaatgtaagatgtttattagtggaatttatttagtacagtaatcacattagaagtcccaatatacaaactgttgaagtccaaagtcacaaaaaatacaaacttaggtatacgaatgaaattataaaaacattatttaaaaacaaagttctacatcttcaacattgggccaaaaaaggaaaaaaaaagagagagagaaagagaaagaaggcatatgaaaatcatcacatttcaacaaagcagccctgaccagtctggctgcctcaccattgagatactggaccacttgggtgtgaccactatggcaatacagcatttcattatgggactggctactttgtataaaactatatgtgaaacataaaatttctttctttcaaaatgaaacgtccaagtgaaacagatagagctaacatataccaaattttagctggctgttagtagaaaatttcaacaattctgtaagttcaaaaaggaaacatatttgaaaaaaacaaatttcaaacaaaaataagcataaccaaatggaaataaaagaataaataaatgtcaatcatgaagtgtgagtgtacacaacggaaagtcatacccaggcttctccacccataacttagacagctacagggactggttacgagcaatagaaagatgtcaaacatgatttttaaaaataactactaccagttttgaaaagatccctggcgaaagaaaccccaaaatcaacttaataaataactgtacaccaaagggaaagggttgtgttttctttgatggtgtattctctatggcaagagagttttaatattttatcaactgctaagaagataagcataacctctttcctttaaaacatatcaccctcaagtgtcttctgtccagaatccatagaagaaatttttgtcagagaatccagcccttgtgaccagacccctgtagaagagggaatgcttcctaaattccggaagtcgctgcaaggattcagtttaaactttcatgatattctaatcttaccatctcaaaagtagttctgtatcaggggatctaaaacaatgtatatctggccaggcacagtgtctcacacctgtaatcccagcactttgggtggccaaggcgggtggatcacttgagatcaggagttcgagaccagcctggccaacaaagtaaaaccccgtctctactaaaaatacaaaaattagctggtgtggtggcgcacacctataatcccagctacttgggaggctgaggcaggagaaccacttgaacctgggaggcagagggtgcagtaagccaagatcgcgccaccgcactccagcctaggcaagagtgagaccctgtctcaaaaacaaaaaacaatgtatatctcaaaatctttctcagaacatggtgccaattatttcttttaagctgaaataatctgtaccttgggggttataagaagctgcataatcagtaaaaggatagaaaactttaaagtatttcagattttaaaccagaattcctctaagatttcaaaacatggtccatgttttatgttatatttctataaatacaatcaaagcataccattgtacagtactaatctcaactggttctagatttaagcaattagtttgaaaaaattaggaatgggaataagaaagtcctgttgaaacaatcttagattgttaagagtccgtctccaaaaaaaaaaaaatttggcccaacttgcaaataataaaggattatttaatttggaaaaatattctaggattactcagaactactcaatttaaaaacttaaaatatctatcattatttagattttagtaaggtggagagaaacataggtagcctgtaagattaaccttccctaaaagcaagctcagagaaggaaggaggagggagaagaaaaggaaattcgctgcagtactggtggcctcaacccctttatgaaaacacatgttctcatttggtgttacactattctgattcatgttgaacatttgaaaaccaaaggaaaaaggtcaactaaaaatatttaaaggaaaaaaatgtgagaatgaatcaaatgataaaatcataaagaaaacaagaaataaaagacattagataacctttgtaaaaattactaaaattaaaaagaattcattttgcactttgtgttcacaaagggaaatgaggctccatcaaaccctgcagagcacaagaggaagcaggttgtttgctcaggcatcagcagaaataggccccgaagaactaccctcagtttcttctacatcatgtccaggaatgaaaagcaaagctctgcaaaatgctgaaggttttagaagtataacgatgcttaggaaagatcactggtctggtgttgcagcagccccagtgttgagagacacgctaggcttctaggaggagaaaaatagagagggaggaagaagtaggaaggggaagaaaagggtggaaaagcacaggtcattagtaaacagcaagttcaatatcacaagatgctcataaaccaaagctattaatgaagctggtttgctctcgggactatagataacattctgaaggaaacagaaatgggaattttcaaaatggcattgagttagatgctccaggtagtgatggccaaattagaatgaagtcaccacatgctccaaaaacatgcactgccatcccctccctccaccttccctccccaaataaaacatgcatattttcagtaaagtatctttttttttttttttgagacggagtcttgctctgttgaccaggctggagtgcagtggtgcgatctcggctcactgaaacctccgcctcctgggttcaagcgattcttctgcctcagcctcccaagtagctgggactacaggcacgtgccaccacgtccagctaatttttgtatttttagcagagatggggtttcaccatattggctaggctggtctcaaactcccaacctcaggtgatccgcccgcctcggtctcccaaagtgctgggattacaggcgtgagccaccgcgcccggcctagtatctattttaatacagttaagtggttcaattcaaaactcaatccaggtgtgcaaactatatgctacctaagggcagagaggtatccaagaacagaacgacctactctcataatgccactgggtagttcataaagagccaggttcttttttgtcacaagggaatcctgaaacagtgagggccaggatacagtttttacccttctattctgtactactaaggcctggcagcggtaagcacctgctacacagagtttgagtctcttctggtcaggcatgacttcctactggagaagaaatctactcgtttttgtagttgtttccttcctggatgaaaatggcatccactctttcaactgcctaatcaagtcaatcccctccagcctttccttaccctggttaactggttcctgcttaaagaaagctgaatttactcattttttaaaagttcatgttcaaacttctcctttaatcacagggatatttgcataaatgttttcttaaaaaccacatcacatagatgactgctttcaaagcagacacagaaagtcaatactacatttgactgagattatcaaagaaatacaaaaacatcaattcacaaaactggaagataaagtggcatttctggttgtttctagcttctaaagtaaagagttcctaatttattaagttgctaataaggatgtatatgtcacttggtaaacattcacaacaaaaagaacttggtcatcaaaaaatctgatgtataaagatatatacaactttcctatggtcatagaataaagaataaatcctagaatagctgctattgctaacagaaggctttctggaagccttagaaaaagagaaatactgtggtgcctcacagaagggcttctcatagctgaggtatgcatataagagaaatacagaaatatgacaaatctagtaactacctccactgcaataatatgaatcaaatgtatggcccagttaagagcacacttgcaggaaacaatgggattgatcattagaagtcaactcatttgggttagcagtgttggcctgatcacaactgcaaagtaaatgcaggtatttatgaaaataaaacacgcaactctcacatcagctacttaagaaaatatttatatagtatatccctgggactcctgctactgctttgagaattttgctcactacaaagacattggggcagggggttggtgctggttatgagacaggaacccacagaaactcaatgctaactgaaagaatatcaaaaccctagtaaagagctaagagtttaattagaagtaaatttcaaaagcaacagttaagggaaagataaaggaaacacactgggggcaaaataaataactcctaatttgttgttcactggcttcctaacattgaactgtagaaagctaaacgcaatgtgattcagggaacagacctgctgttttaagagttgtagtggccaaattcctcccatgtaacatattttggtgatcattattctgcatctacaaaagtattttaaggttgatccagttcttgtgtggtacagctccaataaatattcaaaaaatatcaaagcaaactcattattctccttccattgttggagattttacatggcaatgtcctgggtttaaatacctccaacaagaacactaccaccctcagaaataattcatatgcttccattaataatgctcttcaaaggagattatcaaggtgttcattgtaagtgcatcacctacacatttggggaatcctgggaatcacttacctgtagtatcgctcccttctactccatgaccaccattggctaggagtgttggtttagaagatggagtatctgcaacaatgacaaataattacccattgtgacagacagaaaaatgaaaaacagatccaaccactgtcttattaatggagtttttctcactctttgtagcattaggttaaagcaattaaaaactgttcaaaatttaaacatttaacaaaaggaaacccagaaacagaactgaacagaatcattaattcctagggcacccaagctctgtaaagtaccagttccataggagagcccctcataatagcaagtctaaatctttttcattctgtaaattatcaaagattaccattaaattcagtaaaaccatcatggagcaacacaggtttggtatcagcaattcaaatccaaatcaaacgctccaagaacacgagggcatttgttttattattattattatttttgagatggggttttgctcttgtcacccagactggagtgccatggtgcaacctcggctcactgcaacctccgccttctgggttcgagtgattctcctgcctcagcctcccgagtagttgggattgcaggcacccgcccccatgaccagctaatttttgtatttttagtagaaatgggatttcaccatgttggccaggcgggctcaaactcctgacctcaggtgattcaccgccttggcctcccaaagtgctgagattacagatgtgagccaccatgcccagcggaggccatttattaattacttattaattcccacacaggaaatccagggtaccatcattgcttctggatgaagattgcatggaggtaaccagctgtatttctggaagcagaggactcctttttttttttccctcttttttttttttttaaggaaattagttgtatcttattccctaatgactaaggatgttgagcatcttttcatgtgtttctctgccatccctttgtcttctttggtgacttgaatggtcaaattttttgactattttaaaactgaactgtttattttcttattattgagttttgaaaattctttatgtattccaaatatcactcctttatcagataaattttgtaaaaatttcttccctgtttctaacttatactgtattttcatttacttaactgtgcctttcaaatagtttttaatttttatgaagtaggtcacaggatttttttccccatgttttcttctagaagtcttatagttttcatatttacatttcatattgaggcctacggtacattttgagttaaattttgtatatggtgtaatgatgtgggtctaagtttctattcctgtacattcctaagtttctattcctgtacctaataattaggtgattaggtagttacctaatcacctaataattaggtaattaggtaattattacagagtcatttgtggaaaaagtcatctgcattctattgaattgcctttgcacctttgtaaaaaaatcaactgaccatattacattgggtttatttctgggctgttatgttccatcaatttgtaaggctatccattttgccaataccatcctgtcttgattactgtatttgtacagtaagtcttcttgacagggagtctctctctgtcgcccaggctggagtgcagtggcgcaatcttgacgctctgcaacctccacctcctgggttcaagagattctccaggctcagcctccccaagtagctgggactacaggcacgtgccaccacgtccagctaatttttttttgtatttttagtagagacgaggtttcactatgttggccaagctggtctcaaactcttgacctcaggtgatccgcctgcttcggcctcccaaagtgctgggattacaggcatgagccactgtgcccagccataagtcttaaataaggtaatatgagccctccaacttgagtcttttccaaaaatgtttttgtttgttttgttttgttttttcgagacagggtctcattctgtcactcaggctggagtgcagtagtgcaatcgtggctcactggagcctcgactgctcaggctcaagcaatcctcccgcctcagcctcccaagtagctgggaccacaggtgcatgctaccacgcctgcctaatttttcattattattattttttggaaaaacggggtctccctatgtttcccagactgctctcaaactcctgacctcaagcaatcctcccaccttggcctcccaaagtgttggtattacaggtgtgagtcactgcgcctggccttgttttgtttctttgcttttccatataaattttagaatcagtttttgatttatactaaaattcttgatgggatcttatatgcaattgcatataagactatatagatcaatttggggattgactatatagatcaatttggggatgtacaactttttctgaaagtctctgactatatctaacattttagcaaccagcctagctctgcagtcaccttgctgaccgaagaattcagagatattattcctaagacaataagtgaatatctacaatatatgctactaaaataaaaaatgcaagattttactttggaagaccacaaacatgctgtccaaccccttagtcctcataaatacaaggcagaaatctttcacacaagcttcttgttgaaaagatcattcattctgttacttaagaggaacagccaaagagaacaatctaaaagaacaaggcagtccaaaaccagaatataatttaaataaaagaaagaaataaggaaggaaagacaacagaattctattaaatagccgctatgtaacatataccctgctaagtcttcacaaactgcattttacttatccagagagatgccataaatatgctccatcccacatttggcataagtaaattccctttcacattcacacaataagcttataagatttattcttcctcgctcaagaaagaatgcatatttttaaaaacttgcttcattaaagaatgcatattataagaaaatggaaattacaaaaactgatatccagcgagtggtataagagcagctattacagtgataaaaccttttaaaatttgataaccagcattgacaagggtaatttcattacatcatttgggggaatgtaaataggaataacctttttatgagacaatttggcagcctatcaaattctgcaatactcaactcaacaatcagttttaggtatttagttcaaaaagagacataaaagtataaaaaagtgaatataaacagaatgtttatgatggcactgcttaaaaacaacaaatgtccaccaacagattataatattgtaaaatagtacacagtaataaaagaaatgagagcacttcgtgttaccgatacaggaagataacaggtatctaatagctaaatatagataaaggccaagacaccctagggtatgcctatagtcccagctattagggaggctaaggcagaggggtgtcttgagtccaggaatttgagaccagcctgggcaacatagtgtgaccccatctctaaaaataaataaataaataaataaattagctgggtgtggtggcacacgcctatagtccttatctcgtaataaaaaataataataataaaaaagaacctggccaggtgcagtggctcaagcctataatcccagcactttgggaggctgaggcaggtggatcacttgaggtcaggagttcgagacctgcctggccaatgcggtgaaaccccatatctactaaaatacaaaaaattagccaggcatagtggcgtgtgaatcacaactactctagaggctgaagcacaagaatagcttgaacctgggaggcagaggttgcagtgagctgagatcgtgccactgcactccagtctgggcgacagagcaagactccatctcccaaaaaaaaaaaaaagctttattcccatatatttacctatgtgattagggtttcttcactatgatagctacaaaaacaggaaaaattgccaatcctatttcatcagagaaagaaatattgatccacagacccatgatttaattgagaaaaataacagaccccatcatctcataagaaaagcatttccaataaaattcaacttgtatagtaataacatcaaaaattacaacctatgttggccgggcacagtggctcatgcctgtaatcccagcaatttgggaagccaaggtgagcagatcacttgaggccaggaattcgagaccagcctggtcaacacagtaaagcccatctctactcttcttgaggaaacaaataggattaagtgaaaatgaagggagatttaaaaaaaacataatacatgcaatagactgataaatttcctctggaccaagttaaaacacagaacctttgtcacaggaactttaaaaattaaaatttaagtttacatacatatttagtagcagaaacatattagcacaatcaagaaaaaacttttaagcataaaaatatattacattaggataaaagtctgagacatgttatggaaataaaagttcaaggactcaaaagaagaatttaaatttccaatgataaagaacagcttgttcgtatatttttaaactagatgatggaaaccaaaatgctatatatttagaagcatttggatacatttagcagaatgaggtaacttatttttatgtggcaaaagtaaaacattctcaaaattacatgttttacaactaaacttttgctacaaaattttagatgtaaacttaatgtacaaagagacagaatttatcagaattctgagtatgtgaccaaaagttaagaccactactttagaccaagttaaaaagaaagcttgatatatactgacagaaagttttctaagataataaactaaaaaaagcaagttaaaattcatacgatttgattccatttgtaaaatggaatcaaatgaaagtaaagccactaaattttttattgtatgtttgtaactgcaaagaataaagtcttaaaagatctacccttcttgaggaaataaataagattacatgaaaatgaagggagttttctttgttttttgtttgagacagagtctagctctatcgccaagactggagtgcagtggcgcaatcttggctcactgcaacctctgtctcccgggttcaagcaattctcctgtctcaacatcccaagtagctggtagctgggactacaggcgtgcgccaccactctcagctaatttttttatcttcattagagacaggttttcaccatattggccaggctgatgtcaaactcccgacctcaagtgatctgcctgcctcagcctcccaaagtgatagaattacaggcatgagccatggcacccggcaaagattttgacttaatttttaagagagagggttttgctctgttgcccaggctggaatgcagtggtataatcacacctcactgtaacctcaaaatgctgggttcaaatgatcctcctccctcagcctcccaagtatatggtgacaacaggtgtgcaccgccacagttggcttatttatttatttatttatttatttaatttgagactgagtctccctctgtcacccaggctggagtgcagtggcacaatctcagctcactgcaacctctgcctcccaggttcaagcgattctcatgcctcagcctcctgagtagctggggctacaggcatgtgccaccatgcccggctaattttttgtatttttagtagaaacaggatttcaccgtgttggccaggctggtctctaactcctgacctcaggtgatccacctgcttcggcctcccaaagtgctgggattacaggagtgagccaccacgcccagacaattctatttgtataaagacagggtctcactaagttgctcaggctggtctcaaactcctgggctcaagtggtactcctgcctcagtctcccaagtagctgggactacaggcgtgagccaccatgatcagcctcgtccactgagctttaattcaatgctactttatttattttgttgctcaaatttttccagtgttggctattgggaactctttcagttgactcctgtgtccctctgacacactatctctgtcattgtgggctttggagcataactccaacagtctttttataaatgatctgtgcaattaaaggtaatttttttttccagtgaagggcataaataatgagatttaattgcgaataatatgcataatggaagtctcatttgcacatatctgtttactttctccctgcctttcctcctgcctcagcctcctgagtagttaagactaccaccacacccagttaattttttattttttttttctttgtagagatgcagtcttgctgtgttgctggggctggtatcaaactcctggcttcaagtactcttcccgcctctgcctcccaaagagctaggattacaagtgtgagtcaccatgcccggcctccctggtatttttgacctaaaatgtgcaaaagggaatttctgattcataaaatgtgactttcatataagatgcagcagaacacatttcaactggcttggaaaccagaaaattattcaaaagctatttgcttagatactaaaatagtaggtgaaagttggattagatacaggatacatacatagcctcaaaatatctcctcacaaattacttattcattacaaggagaaaaatataaattttacagtaaagaggctgggcgtggtggctcatgcctgtaatcctagcactttgggagggtggggagagcagatggcttgagcccaggagttcaagaccagcctgggtaacatcacaaaaccctgtctctattaaaaaaaaaaaaatacacaaattaaccaggtggccaggggtggtggctcagcactttgggagaccgaggcaggcagatcacatgaggtcaggagttcgagactagcctggccaatatggtgaaaacctgtctctaataaagatacaaaaattagccaggtgtggtggcacgcacctgtaatcccagctactcaggaggctgaggcaggagaatcacttgaacccagaaggcggaggttgcagtgagccgagatcatgccactgccctccagactgggagacaaagtgagaccccgtcttaaaaaaaattaaaaaataaaaataaaaattaggctggggggtggctcatgcctgtaatcccagcactttgggaggcagaggtgggtgaatcacctgaggtcaggagtttgagaccagcctggccaacgtggtgaaaccccatctctaccaaaaatacaaaaattagccaggcatggtggtgcatgcctgtaatcccagctactcgggaggctgaggcaggaggatcacctgaacctgggaggcggaggttgcagtgagccaagatggtgccactgcactccagtctgggcaacagagcaagactttgtcaaaaaaaaaaattaaccaggcatggtggtgcatgcctgcagtcccagctacttgggaggctgaggctggaagactgcttgagcctggggaggtcaaggctgcagggagccaagattgtgccactgcactccagctagggtgacagagtaaggccctgtctctaaataaataaatgcttttttttaattggaaaaaaattacagtaaagaaaacaggcagacactaacaagtgatgaaagttattatcaccaataatgtgatttagtgacatcatgtgcttcctgatgtggtgcacttaggacacatcatatttacatagtactactgccaaaaatgtggaacttgaatctaattatgaggaaatgccaggcaaacccaaattaggggacttctaaaaaataacttgcccatactattcaaaatattaaggtcatgaaagacaaagaagagttgaggaactgttccaattaaagaagactgaagagacatgaaaactaacgtgattccagatttaattgcagacaagaagaaaaaaatgagaaaggaatgtgttgaatctgttgggacaactgatgacaatgaaataaggttcgtggattagacaggaatatctcatcagcatttaacttctgatctctatcatcgtattcttgtaatgtgctaatgcctagttcttcggggaaagaggtgtgagttctgcagtttgttctcaaataatccaaggggaaggaactatatgtaaatataacaagaatgataaagcaaatgtgcaaaacagtaatgataaatccaagtaaagggtacatggtaggttcttggctctgttcttgcagtgtgaagtttaacaaagtcatttgcttgcagaatattatttaagaggtggggtctttggggtcttgctatgttacccaggctggactcaaactcctaggcttaagcaatcctccttcctattaagtagctcgggcagggctacaggtacataccaccatcctggcttgcttgcagaatatttttagcaatgaagtggtttttttgttgctttgttttttgttttttggggggtttttttgtattttttttgagatggagtcactctgtcgcccaggctggagtgcagtggcacaatctcagctcactgcaacctccacctcctgggttcaagcaattctcgtttctcagcctcctgagcagccgggattacaggcgcatgccaccacacctggctaatttttgtatttttagtagaggcggggttttgccatgttggccaggctggtctcaaactcctgacctcaggtgatccatctgcctcggcctcccaagtgctgagattacaggcttgagcccccgggtcccggtcccctgctcttctttcagactagggtactattattatgaactatacattttggtacgatattttttttccccaaaaagaactattagttatgagataaaagtctgttttcaaatcaaagtcagaaaataactatttttgcaaaaatgtcacactaattttttatgcatatatataaacttccctaaatatgatcatgagactattaagagggtttaggattagaccaagtacacctaccctaaataaatatctaccattttggagacacaattgtttgttagtctgtacattaacacaacccaaacctgaataaactgacaaacaaaaaccatttcaattcagtgtaataagcaatgattacacatctatcatgtgccaagagcagtggtctctaatgcagatctggccaggtttctcagtacccctgcgccctcagtttctcacaaaccatgagattcttcataatttcacttgatctgcttctccatgattctctccggtcacttgtcactgtaacctttgatttcttaaccctgagaaacttgaggtcgctagtaaactttgattatgctgtgccatcctgctttcgctaaatgtgtcattctccatgaaatatggcagtaaacaaaatattattcctgtgctagagcatgttaataagtgtaagataacaaatagcttaattatgatcttacaagtaccacagaggaaagaggaaagttcagggaagaaaagcacttaccaagaggaagatgaaaagaaaggctggcagggtgtgggggtagtgggaggtctagaagggaaagggaacagaagtcagggaatgttctggaaagttacatctaaatccaatcttaaaggattttagaacaacaactctagcaaaagctttatataacatcaacctccagcccagaaccgtcctccaaactccggactccttatctgtgtatccatcttctccatttcgatgactagcaggtaactaaatgtgaacatatcccaagctaaatttcttctcttcccttcaaatcctactccttctgtagctttccccatctcagatgatggcaattctttcctttcagttgctcaggcaaaacccctggagtaatactggatttgtccttggcaacatcaaggccttatactttaggtaagagaagttttggggtcatgcatatgttaaagtctgatgagagtgaattcaagaggaaatggaaggaaaggaattggtgacaggtagtagaaacgtctctttaaaagaaggcaggccgggcacggtggctcacgcctgtaatcccagcactttgggaggctacggtgggcggatcacgaggtcaggagattgagaccatcctggctaacacggtgaaaccccgtctctactaaaaatacaaaaaattagccgggcgtggcggcacacgcctgtagtcccagctactcaggaggctgaggcaggagaatggcgtgaacccgggaggcggagcttgcagtgagccaagatcgcgccactgcactccagcctgggtgacatagcaagactccgtctcaaaaaaaaaaaaaaagaaagcaaagcaaaaagatagatgagatggatgtgagattcagacaggattttttttttaatgataaaaaaattatagtatgtttgatgctggtgaatgacccaattgaaagaaaagaactgatgatgcaggagacagaagaggtaactgtgacagcagtggcctgagtgacagcatgaacagttcacccataacagaaaaagagcagacaataagggcatagatgaacataggtgaggaggaaatatgtggtgggaccatgtggaagttctgttctgattaagccaattaatttatgaatatgacttatgaatatgaacaggagagcaagtgccagaagtttcagagagtagatgtgaaacagttgtctaggaaagtgaaatattttacaaactcatgtgaattagtggcagagtccctcagtttgtgctctgtattgaaatgaagcaagattcttttacatttcctgaacatacatctaataattctatttgaatttaaaaaatggatttttagtttttaaaaactatcagtgagatactagatcaagtagaaagtatgtgttcatgaaaaaggtatagtttcacagaaagaacaggggtttattttatttatttattttttgagacggagtctcgctgtcgcccaggcttgaatgcagtggcacgatcttggctcactgcaacctccaccttctgggttcaagactctcttgccccagccccctgagtagctgggattactggtgagcaccaccacgcctggctaattttttgtatttttagtagagatgagatttcaccatgttgatcaggctggtctcgaactcctgacttcgtgatctgcctgcttcagcctctcaaagtgctggggattacaggcatgagccaccatgcccagccagaacaggggtttaaaatgagaagatccagtagctcatgtctgtaatcccagcactttgggaggcctaggcggaagggctgcttgaggccaggagtttgagaccaacctgggcaatatagcaagaccacatctctatttaaaaaatattgttttaattgtttaataaaaataaaagtgagattagaagatctgggttcaggttgtgctgtcattattaactaaatgatcaaatgcaaccttctcatttctaatacttaagcttcacctgggaagtgggactaaatgcagtaatacaggatgtcaactgtacagtgctaaatagtaattgttattctcactgttattagctattgttattctcactgttattaactatatgttgaccaactgtaaatttatctatcaaccacctatagaataactgtaggctgatcaagaaactttactagaataaaataaaatgaaagcaagaagaggttagaaaggaagaagagaagctggattctactatacatacaacacctcacaatctaaaaatataagcccaggagagaataaaaacaacgtaacaacactaaaaacaataaggttgacaagtagaaaaaaggcttgtatatttccctgccagataagacatactggaccctaatcatactgcacattactggaaaagtcctaattcaaaagatgctataatgtgttttctcactgactgacttccccagagaacccccatttcatgaaatgaaaactttctcagtgaaatacacacagcatcgaaaatagcacactttttttttttagaaactaatcacattctctgagatataaagatattcaaatttactttattttgttgattccctctccccaggagatgtcagattcccacagcaggcaaatcagcttggcagagaagtagcaagaacctgagaaggcatgtgtgctgtgagtcagccttgggcaaaacagccaggtctcaatgcaagggaaccctctggtgctgtcagacccatgccaacactgccctctactggccaattaagctggttgcaattttctgcaaaagaaataccagtgtattaaggagaaattctgcagtatctattaatagttgtcacttaggcccttttccatggattagtgtttctcaatcatgcatgtgtatccgagtcacctattatggcttgttaaaacagactgctggtgtgtggcagggtacggtgtctcccacctgtaatcccagcactatgggaagtcaaggcaggaggatcacttgagcccagcagttcaaaaccagtccagtccaggcaacacagtgagaccttgtctttactaaaaatgcaaaaaacttagccaggccattgccctgtgttaacttcttattctatgggaataagcttttagcttcaaaggccttatggaatgttgaggagaaagcattttctcgacttcagaagaagaactatttaatcacacagagaacagaaaaattaagtgacttgttccataaatgtgctatttgtgtctgagggtcaatactgtgctagatgatcatctgaaagaacaagagtcacagatgtttgcttcgtcattcacatctaagagaaagggttctatcttttgtctccctcacctagaaaatagggccatataatgctgataatgaacaattaaggaaaacaccattttttaaggaaaaaagtcaggaagtacataattttctttttatttttttcttattacagccgtggtgcaaaacaagtagtacacatatcctgaaaaagtatttgagaattgtttcccaaggtgataggcattttagaagaagagtttgacaccaattttatttctaggtattggtatttagatggtttacacaggcaatgctaagataaaatacttgtagaagcaagaataagttgaagtgcaaaaggaaatgagtatagtagatccaaagaaaaggaataaaggtcggggggttcttgtgttgccaggcatgaaggcagaaatcatacttagagaaaaaagcaattttcctactttgtcataaatgccataaaagcaaccctgctttcttacttctcattttataagttgaagacaattagggtggacatgtaagaattaaaggaaataaaacaccattgttcaaagagttctattatgtgtaacctactcaaccgtcccttctatatctagaggcaagaaaatggttgataaacttccactggttggcctaactaagcctgttgtaagaacatatcgagagcactaggctgggtgtggtggctcacacctgtaatcccagtgctttgggaggctaaggcaggaggatcgcttgaggccatgagttccagaccagccagaggaacacagtctgactgtcgctataaaaataaaaggataagcaaggcacgcgcacctgtagtccaagctattcaggagcctgaggcaggaggaacgtttgagcccaggagttacgttagatgttgcagtaagctatgattgtgccactgcactccagcctaggtgacatggaaagaatctgtcttttcttttttttttttgagacggaatttcgctcttgttgcccaggctggagtgcaacaatggcacgatctcggctcacggcaacctctgcctcccgggttcaagtgattactcttgcctcagcctcctgagtagctgggattacaggtgcccaccaccacgcccagctaatttttttgtgtttttagtagagacagggtttcaccatgttagccaggctggtctcgaactcctgacctcaggtgatccacccgcctcagcctcccaaagtgctgggattataggcgtgaaccaccgcgcccagtaagaccctgtcttcaaaaaaaaaaaaagtgtcagcaatcagcagtagtttactgaacctcatctaagaacaaaatcaaacttaaagttagatgtataataaaacattaatgaagtctagggcccttccatcacttctaaagatgtattcagaagaacatcttgtttagaatgttctccaggaaaaacacaaatatgaaacctgtcattatggcaaaaaccatcagtccgataatgtataaaaatcagacccacagcagagaagtctccattcataaagaactcactaattgcaccagatttctacaagactaaataaggcggcttccttcgtttttcttatttgatgtctccaaacagccatcaccccttcctttaagttaagacttctacaacttttaggaagctggtatggaaaaaatgtagtaatttacaacctatcataattataaactttattattattattatttttagagacggggtctctctctgtcacccaggctgcagcacagtggtgcttttatggctcactgcagcctcgacctctggggctcaagtgattgcctcctacctcagcttcctgtgtagctcggactacaggcgcacactaccacgcccagctataattataaactttaaacatggtatcttcaacaagttcgtggaaaatgcattctatgaaaaaattattcatggatttcaagggagtttttttgtatcaaaataactcatactccagcctgaccaatatggcgaaaccccatctctactaaaaatacaaaaattagctgggcatggtagcatgtgcctataagcccagctactcaggaggctgaggcaggagaatctcttgaacacaggaggtagaggttgcagtgagccgagactgtgccaccgcactccagcctgggtgacagagagacactccatcttaaaaaaaaaaaaaaaaagctcatactaacttgttataacacgtctgaacaggatctagtttgaagcactaaaaaggataaaacatcagtttgaaaagagcccctaataaagcaacatgaattctgctaaaattgaagcaaaagcaaatggtaaatttatggtgaagcttggatgaaagaatggtgaaatcactgatgctttgtgtaaagtttatggggacaatgccccaaacaaatcagtagtttacacatgaataacttgttttaagacatcagccagatgcagtggtccgcacctatagtcccagctacttggaaggctgagacaggaggatcacttgagcccaggagttcaaggctgtagtgtgctatggttacacctgtaaatagtcactatactctaatttgggcaatgtagtaagactctgtctcaaaaaaagaaaaaaaataaaggaggagatgatgttgaagatgaagcccaccgtggcagaccaccaatatcaatttgagaggaaaaaagaatgatctaattgaagaggattgacaattagcagaaacaatagccaataccacagacatctcaattggttcagtttatacaattttggctgataaattaaaattgagcaaactttccactcaactggtgccaaaatggttgcatccagatgagctgcaaagagcagagctttcgatgtaaattttaaacaagtgggatcaagatcctgaagcatttctttgaagaattgtaacaggagatgaaatatggttttaccagtataatcctaaagacaaagcacaatcaaagcaatggctaccaagaggcgtaagtgctgtagtcaaagcaaaagtggatcagtcaagagcaaacacaagagttttttaggatgctcaaagcactttgtctgttgactttctggagagccaaagaatgacaacatcttattatgagggtgttttgagaaagtcagccaatgctttagcagaaaaacagccaggaaagcttcatcagagagtccttctccaccaggacaatgctcctgttcattcctttcatcaacaaagataatttgtgacagttttgatgagaaatcattaggcaaccaccttacaacagtcctgatttggttccttcttttttgtttcctaatctttaaaaaaatctttggtagcaacaaaaaattaaaaacttaaaccaaaaaaaactttaaagggcatccatttttcttcatttcttcatttttcttcatttaataatgtaaaaaagccaggcacagtggctcacacctataatcccagcacaaaagaaaaacaaatatttactccaaaaaatttggattccttaatggaaaacgggaaaatctattctctcttaatccataatgcacggtggagacatttgttctttgactgactaacataaacaaagaaaacctagtatgaagaaaggaatgataagatgtaaatatggtagcaactagtcatggttgagatgctcttcccatcctaatattaacttaccctcatcagtcataggtgaaagaagctagctgcttttcgttttctaatttcctttaactgtgcattgtttccatcatctgggaatgagcctaggtggataaggacagtgaggtggtagcagtagattttcttgtgcttcatcttgagttatttgatccatgtaacattaacttggcccaagaggaggaaagtttttaagacattattttatttataaaaaattaaatcctccctgctacttttgatatgtaaatggtggctcatgcctgtaatcccagcactttgggaggccaaggcaagtggatcacctgaggtcaggagtttgagaccagcctggccaacagggcgaaaccccatctctactaaaaatacaaaaattagccaggcatggtggtgcaggcctgtaatcccagctactggggtgttgaggcaggaggatcgcttgaacctgggaggcggaggatgcagtgagcagagatcgtgccactgcactccagcctgtgcaatagagcgggactccatctcaaaaaaaaaaaaaaaaagttcattaactcagaaagactactccagaaattggcgagtggttactccaggaaggagaactgtctggctagggtgtagggattgggagaatttgttttaccgtacatccctttggaccaattggattttgtacatgtgtattttttagcctgttcaaaaaatgtatgagtttctggaaaattgaattaaaggataaaaataaaatatgaactttacttctcaacataagcttttgcaacatcaagatacttttgtaagcaatgatagcaactttttttcttttcttttttttttttttttttgagacagagtctcgttctctcgcccaggctggagtgcagtggcacgctctccactcactgccacctccgcctcccaggttcaagtgattcttgtacctcagcctcctgagtacctgggattacaggtgcacaccattacccctggctaatttttgtatttttagtagaggtatggtttcaccatgttggccaggctggtctcaaactcctgacctcaggtgagccacctgccttggtctcccaaagtgctgggattacaggcgtgagccactgcacctggtctggagtaaatatttatatggatataattagaactctcggtacttttttaaatgagttgtggtctgccccccctccccaacacacaaattaaacatatattaaggaagcaggttttcttcttccacttggctgtagaaagccaaaagcaacgtcactcccaccctaacaacaagaaacagccatatcaactacaaaaaacttgaattaattggaaagccacctagtagtatgaaatccaaagaaaaacaagcccctccaggaaatatgggaggtgaacaccagctctcctgtatcagagcatgtgcagaagagacattgggtaccctacaagcaggtaagaaaaattcaagtaaaaattgtagtgatttgtcaaaggtaaatgaaggctagcatgagactatggggcccctcaaatccacagacacaaagggaattcacactcatttgcaggattgtcttcacagatgtctgccgcatgctcacaggaaagattggaagcagggtgagggaccagacagagcctccctccatggtacagacctggagaaggccaccaccattaagggaaaagcatgaacccctcccactgggatctttctctcctggggaaggagtacaaaccctgtcaaccccagagcacacaagaagaccggctgtagctagggaaagagtaatagaaacatactttataaacctgagagaggagcaagaaaaactcctcatccaggatcctacaccaataccatgagaagacgctactactgtgaaaaggataataacgttgagaaagacccaaaccgtgagattaagcacaggattaagcacaaaatgggacaataaaaaaacaaactctgcctgccacctggctagaactcttccgataagagagaaaagagcatggacaaggacccctctgaggcacgggtacacagggaaggctgaaagagtggagcaagcacattaaagaaataccttccagggcctcagtccccactctaagcatagaattaaagggattgaagacagtagtacactgaaggcaattacggtaatgacaaaacccaaaactagctcagctcctgttaaaatgactaaacccaagagacatgcctatttccaaccataacaccttttggcctcagcctactattttacatgtgagatccagcattcaatcaaaaactaagacacacacacacacacacacacacacacacacacagagcaatcagactgagagatgacccagattttcaaattatcacacagagatttaaaacaactatgattaatatgttaaagtctacagtagaaaaggtggaaaacataggtgaacagatgggaaattttgacagaaataaggaagcttataagagaggcaaacagaaatgctagaaattaaaaacataaaaaatgctaaagtagataatgccactgaaagctcatcattagattcaacacaactatgaaaagatcagggaattggaagataggtcaaaagaaagtacccaaagtaaaacacaaacagaaataaagagagaaaaaaaccaacaatgcatccaagagatacaggacactatccaacaatttaacaaaaatataattggaatcccaggagaaaagaaaaagaatggggcagaagaaatattttaaaagataatggccaaaaatttcccagctgacttaaccacttcaaaagcacagatcaagaagctcagaaaagcccaagaagaaaacttccaaaatatcatctaaacacaacatatttaaactgctaaaaaaaaaaaaaaaaaaagataaaatcttaaaggcagacacaaagaggaattcacaaaggaaatatttttaaatatttttaaatgaatgaaaataaaaatacaacatatcaaaatccatgggacacagctaaaatggtgattagagggtaatttataacattaagtaattacattagaaaagaaatgtctcagatcaaaacctgatttaagctgtcaccttaagaaaccagaaaaagaataaatcaacttaagtaaacagaagaaaggaaaaaacaaagatatgagaagaaattaaaaacagaaagacaatagaaaaaaattaatgaaaccaaaagctggatctttcaatacaattgataaacctctacctagacttatcaaagaaagaaagaaagaaagaaagaaagaaacatcacaaattactagtataagaaatgaaaaaggggacataatagatcctacagacattaaaagcatatctccattaatctgcaacatttatgccaggaaagggaccaaggaattccttgaaagatacaaactaccaaagctaacttaagaaacagataactggaatagttctatgatctctgaaagaaactaaattcctagtttaaaaatccgacagaaaattccaggcccagatagctttattgatgaattctatcaaacactgaaaagaagaaaaaatatcaattctatgcaaactattctagaaaagagaaagaagggaacacttcccaattcattttatgaagtcggcgtgacctcaattctaaaactggacagaagacattatgagaaaactacagaccaattccctcatgaacacagatacaaaaatactcagccaattattagcacatctgatccaggaaaatggcaaatttctcttaaaggctttaattatgctttaatcctgaggtgggatgactccaaagacaacaaatggcatctgattccagtctaaatgaagttctgatataaccgcagaattttatttaacttttcaaagctactttcagagaaaaggcacagtagacagtttaatttaggaaattaagaagaagattatatggttgttgaaacattagagaagaaacattagggttaaaagtcatccacagactcatgaacgctcactcaaagggtggtaagtctacctcctcggtatctaacaaagaaacataaagttactagcctacactaaaaaaactcagctcaattctcagtttccaagattataccaaaggcataatccctaacctgctttctgaacatatataagcagtctggtttaaatacttaccttcaatctggctagtttctgagcacggtttcttctttgactctgagttcccggttttctcatcaacatccaggagaggaatatagtctgtttttccaacagtttctcccacaacatcatcaaaggcctctgcctctagtgtggcaatgaagtcccgctttatctctccctcaatgtctggagatggttctgttaatgcatctgcaagactgaggtcagccattctgcaccactgcaactgcctggtgaagaggaaaaagatctttcatgtaacgagcactgcaaaaggaaaaacatttctagaaactcttgtcaattgtttgaaacaaacaaaagaatcaaaatctaagattttacagctagaagaggctccctcatttgaaagatgagaaaaataaagctaagaaatggacagtctgacccaaggtaactcaccgctagttactcttttctcacatttctgggggtggagggaggtggtggtggcaggacaaagcaattgcaattgtgtcctttctatttataagaaaagtgaggtgtaaaaaaaccccacaatcaacatatccaaagctatagccagtaagattcaaatcaggtctttacatagttacattactatcggacaaatgaaatcaactttcttgaccaaagactgtgagtatggatcttatcttggagtgagtacctgcttcttcatgaatcacttgtggatagtcctgtcaaccaaactacttagccctgccagcataaaaaaaaaaagacacgtttccctcaattagctaagggagatggtccctctctgtagtcacgtatattaccatttttacagactaccagcttcttaattacataatctgcagttaagtaaatctactggcagccataaaaaagaacgagatcatgtcctttgtgggaacatagatgggaagcaggaggatattatccgcagcaaactgacgcaggaacagaaaaccaaataccacatgttcttacttgtaagtggaagctaaatgataacttacgaatacaaagaaactgcagacactggggtctcctggagggtggagggtgggaggagggaaaggagcagaaaagataactattgggtactagacttaattgaaataatctgtacaacaaacccttgtgacatgtgtttacctatgcaacaaaccttcacatatacccttgaacctaaaataaagtttaaaaaaaaaaaaaaagtaaatctataagcaaaccataggtgaatagcctagaaaatacagaaataatgtagtaaaaagagccaaaggggccaggtgcagtggctcacacctgtaatcccagcactttgggaggccgaggcaggaggatcacttgagaccaggagttcaagaccagcctggccaacatggtgaaaccccatctctactaaaaatgcaaaaattagcaaggcatggtggtggacacctataatcccagctacttgtgaggctgaggtacgagaatcgcttgaacccgggagatggaggctacagtgaaccgaggttgcgccactgcactccagcatgggcgacagaggaagtctccgactcccccatcaaaaaaaaaaaaaaaaaaaaaaaaaagagccaaaggcctgcaataaattgggcaccattcaaatgcagggcataataggaaataaagtgtgcaaggtactacgcctgctttcaaaaagtctaacagaaactccaagagactccataggataagttgacatataagctatgttgttgacaaggtaaatacaagtcaaacagatccttagttgcacaatgtaatggccactacttgtgtttgtccagaaatctattcttcctatctcccctaatacaaaccaatccctacccctatagggtttgggacatgactagagttgggtcaatcagaagtcaagaagaagacagttggaaaggatcatttattgactacacgctggaagaaaagtccatgagtgacagctatttagttgccctggttgactacttcaagtctaagtgagcggccttcatctttcttttgcctaatttagccaatctatttctgttgtttacaatggaagaatctcaactaatacacagtctttctccaacccaaacttgaaaaagtaaaaatatactatgattcaagccacttaattttcaggctttcctttcaagctgttatccaccgtctacctctctccaacaaatgtacttaggaaaaagaaatagaattaaagcaaggaatatggtcctatcttccttccttcttattttatcttcatctttgttcccacacactcctctcctcccacttacatgctgtgaggctaccatgattacaaaacatgtacaaagcaaatacttccagaccctgaaaaatcagaagtcatcgtacccccaattcccaaatccaacaagcaaagggtgttgctatatattagagtggtggcacagaggcttaagaatcaagatccgatacccaaataagtacagacaggataattaaggccaggggcaagatctacatcttctaggcaagtgtctagaaaaaaaagatagtatgtgttcagtactgggaatgctggagatagtttgtctctacctatatggagcttagtgaaaacattcattacatattctttatattatctaagaaaaaaatacaataccaagatttggaaagatattaaataatcaattatatttatatagacttccaaataaaatctaaaaatttcaaataaatttaagccttcttccatgtgcctaattttatgagttttcctatttgaaataacaaccttaattcctcatcaataattttaaatgattatcttttcaaattctaggtagtaccattatacaaaaatgtagtagaaaagagctgtttctctgatttcttttctttttgaggcagagtcttgcctcactgcaacctccacctcccaggttcaagtgatcctcctgcctcagcctctctagtagctgggattacaggtacgcaccgccacacccagctaatttttgcatttttagtagagacagggtgccaccatgttggttaggctggtctcgaactcctgacctcaaagtgatccacccacctcggcctcccaaagtgccaggattacaggtgtgagcccctgcgcccagcctgcttacttttcttaaagcaaatgtgatatttaaatttcctgtgactatactaatgagttcctaaatcatatctttttattttttatttttttcagacagagtttcactcttgttgcccaggctggagtgcaacggcaccatctcagctcaccggaacctccacctcccaggttcatgcgactctgtcatcatactacttggaatttgatgaagttcatttaggtctcaaaaaatgtcaaaagatacgtgtgacccagatgtggtggcatgcacctgtagttctagcctttcaggaggctggggcagggagattgtaactaggagttccaagctatagtgtgcaatgatcacgtctgtgaatagccaccacaactccaggtgtggagccacgattgcatcactgcactctagcctgggtgacagagcaagactctagtctcaaaaagaaaaaaaaaagaaaaaaaaaatcacactctgagccaggcgtggtggttcacacctgtaatcccagcactttcagaggctgaagtgggaggattacttgagactaggaattcaagaccagctaggcaacatactgagaccctgcctctacaaaaactaaaaaaaaattagctgggtacggtggcatacacttatagtcctagctactcaggaagctgaagtgtcacaatcgcttgaacccgggagtttaagactgcagtgagccatgattgtgatggcaccactgtactccagcctgggtgacagagtgagaccctgtctcaaaaaatttttaaaaataaaaataaaaaataaatagggtacagaggctcatgcctgtaaccccaacaatttgagagcctgaggcagctggatcacttgaggccaggagttcgagaccagcctggccaacacggtgaaaccccatttctactaaaaacacaaaaattagctgggcgtggtatcacatacttgtggtcccagttaggaggctgaggcatgagaatcactggaacctgggaggtggaggttgcagtgagccgagattgcaccactgtactccagcctgggtgacagaaaatttgtctcaaaaaacaaaaattaaatttaaaaacttttaaataaataagtaaaaaataaatcacactctggctgttaacattaaggccaaaaataaataaataaataaataaataaataaataaataaatttaattccatttagaaatatctaataactataataaagttaaatccaatttaatcagtctgttagaagaaaaatagcgacaagagcaaattatgtcaaagaaagacacgcactgagagagtttaataatagatgtcataaagaagctgttgaatcttctccataaaaaagtaaatatgggccgggcgcaatggctcacacctgtaatcccagcactttgggaggctgacgtaggcagatcacaaagtcagaagatcgagaccatcctggttaacatggtgaaacctcctctctactaaaaatacaaaatattagccaagcatggtggtgggcacctgtaatcccagctgctcgggaggctgaggcaggagaatcgcttgaacccaggaggtggaggttgcagtgagcagagatcgcgccactgcactccagcctgggtgacagagtgagactccttctcaaaaaaaaaaaaaaaaaaaacatattaaattgtacaaaactgttatgatcagccattccaaagcactggacatcaacaaactgtagaacacaagttgagaagctttgcattctcgaaatctgcttgagctttggttaagaccaggaagagtctatggcccttttgtctagagctgtttccactcccatcttagcccacagctcagtttggtcagcaagaattacacttttattagtgtgatggttaacactgagcatcaacttgattggaataaaggatgcaacattgatcctgggtgtgtctgtgagggtgttgccaaaggagattaacatttgagtcagtgggctggggaaggcagacacacccttaattgggtgggcaccatctaatcagccaccagcgaacataaagcaggcagaaaaatatgaagaggcaagaggggcctagcctcccagtctacatctttctcctgtgctggatactttctgccctcgaacatcggactccacgttcttcagttttgggacttggactggctttcctcgctcctcagcttgcagacagccttttgtgggaccctgtgattgtgtaagtcaatacttactaaattcctctttttataaacatacatatatatcctattagttctgttcctctaagaaaactctgaccccagactaacacagactctggtaccaggagtggttccagaggaacagaatgttaaggatggagttcttttgttggtttgggggtttctggagttggctgcttaatatgattgatccaaaaatgctgaggactctacttctaatagcatggagaacattcatagtccttggcgtgaactatttagagagttatgcaaaataaatgcatttgacactcctgattcactgctcatgaaaggtaaggactttagtgactctatacataatacctttgaccatatgtggaaaaccaacgaacataatgaagctggttggttgctcctaagttcagtgaacaaagtgatgaaagaaaatgatgaactcagggattctgtttcctggcttcagaagcagatactgagtctcaaatctgctaagattgccctgagtgagagtcttagctcctgttgagaaagagctgaaattgtggaaaaacagacataagctcttatcatgcgagtggctgacctgcaacaaaagatgcatgcacagccacctgaggtgtctactgctaaagtgagggcattgattggaaaagaatgagacccagaaacttggaatggggatgtgtgggaggaccctgatgaagctgggaacactgagtttataaactctggtgaactttttttgccagaaggaacagcttccccatcccccatagtggcagcataaccccccatccccgccatcaacctttccatctttgtctacggacataaaccctgagctgcctgaggcaagagtcatggcctcctctcaggcagttgccaggcaagataatgttgattctccttagaaggtacctgcaacacccatttgcttctagacctataactcaagtcccacaggtccctagaggtgaggttgagagtgtgacccaggaggaggtgcgctacactcaaaaagaactgttctcggccaggcacggtggctcacgcctgtaatcccaatactttgtgaggccgaggtgggcggatcacgaggtcaggagttcaagaccagtctggccaacatagtgaaaccctgtctctactaaaaatacaaaaaattagccgggcgtggtggtgcacccctgtaatcccagctactcggcaggctgaggcaggagaattgcatgaacccgggaggcggaggttgcagtgagctgagattgtgccactgcactctaacctggcaacagaacgagactccctctaagaaaaaaaaaagaactgttctctaatttatataaacagcaatctggagaacaggcatgggaatgggtattaagggtatgggataatggtggaaggaacatagagttggatcaggctgaatttattgatttgggcccactaagtagggactctgcatttaatgttgcagctcggggagttaaaataaggttctaatagtttatttgcttggttagctgaaatatgcattaaaagatggcccactgtgagggagctggaaatgcctgatatctcttggtttaatgtagaggaaggcatccaaaagcttagggagattgaggtggtggagtggattactcactttagacctactcatcccagctgggagggtccagaagatatacccttgaccaatgccttgtgaaatagatttgtgagggcagcacttgaatctttgaagagccctgtaattgctcttctctgcatgtcagacctaatggtgagaaccgcagtcactcaattacaaaattgaaatacgaggggaataactggatcccaaggtggcaggggccaagtagcagcactcaaccatcaaaggcaaggtgggcgtagctaccgtaatggacagcagaggcaaagtgacaatcagaatagtctgactcatgtagagctctggcattggctaattaatcacggtattcctagaagtgaaacggacaggaagcctactgcattcccacttaatttatacaaacacaaaacttctaggtcgaatggacaaaagactaatttgaattataaaaagagaatcatggcccctcactcaatccatttccagacttcagccagtttacagacccagaaccccttgaatgaaggggaggccaggtacccttgagaaaggaccccactactttactgacaatttatgcagtgaatctttctcccatccttccccaaggagacctccatccaacctttcactttggggactactggacactggctctgggctgatgatgactccaggggacttaaaacatcactgtggtcttccagttaaactaggggctcatggaagtcaggtaattaatgaagttttagcttaggtctgacttacagtgggcccagtgggtccctggactcatcctgtggtcattaccccagtgccagaatgcataattggcatagacatacttagcagctggcaaaacccccacactggctccctgactgctaggttgagggctatcatggtgggaaaggccaaatagaagcccttagagttgcctctacctaaaaaaatagtaaatcaaaaacaatatcacatccctggaaggtatgcagagatcagtgccaccatcaaggacttgaaagatgcagaagtggtgattcccaccacatccccattaactctctcatttggcctgtgcagaagacagatggatcctggagaatgatagtggattatcataagcttaaccaagtggtgactccaattgctgctgctgttaccagatgtggtttcattgcttgagcaaattaacacatctcctggtacctgctatgcagccactgactctgcaaatgcctttttctctattcctgtccataaggcccatcagaagcaatctgccttcagctggcaaggccagcaatatacctttactgtcctacctcaggggtatatcaactctccggctttgtgtcataatcttatttggagagatcttgatcgcttttcgcttccgcaagatatcacactggtccattacattgatgacattatgctgactggatccagtgatcaagaaatagcaaacacactggacttattggtgtgacatttgcatgccagaggatgagaaataaatccgactaaaattcagggaccttctgtctcagtaaaatttctagggatctagtgttgtgggacctgttgagatattccctttaagttaaaggataagttgttgtgtttggtctctcccacaaccaagaaagaggcacaatgcctagtgggcatatttggattttggaagcaacacgttcctcatttgggtgtattactccggcccatttactgagtgacctgaaaggctgccagttttgagtggggtccagaacaggagaaggctctgcaacaggtccaggctgctgtgcaagctgctctgccacctgggccatatgacccagcagatccaatggtgcttaatgtgtcagtggcagatggggatgttgtttggagtctttggcaggctcccataggtgaatcgcaatggagacttctaggattttggagcaaggccctgccatcttctacagataactactctcctttttttttttttttgagacgcagtgtcactctgttgccaaactggagtgcagtggtgcgatctcggctcaatgcaacctccacctcccaggttcaagcgattctcctgcctcagcctcccaagtagctgggaatacaggtgcgtgccaccacatccagctaatttttgtatttttagtaaagatggggtttcaccatgttggccaggatggtctcgatctcttgaccttgtgatccgcccacctcagcctcccaaagtgctgattacagctaactactctccttttgagagtcagctcttggcctgttactgggctttagtggaaattgaatgtttgactatgggtcatcaagtcaccatgcgacctgaactgccctgcctatcatgagctgggtgctttcagacccatctagccatacagtggattgtgcacagcagcattccatcatcaaatggaagtggtatatacgtgatcgggctcaagcacgtcctgaaggcacaagtaaattacatgaggaagtggctcaaatgcccatggcctccactcctgccaccctgccttctctctcccagcctgcactgatggcctcatggggagttccctatgatcagctgacagaggaaaagaagattagggcctgcttcacagacggttctgcatcatatgcagacaacacccgaaagtggagagctgcagcactacaacccctttctaggacatccctgaaggacaacaatgaagggaaatcttcccagtgggcagaacttcgagcagtgcacctggttgtgcactttgaatggaaggagaaatggccagatgtgtgattatatactcattcatgggctgtagccaatggtttggctggtcagggacttggaaggagcatgattggaaacttggtgacaaatttggggaagaggtatgtggatggacctctctgagtggtcaaagacaagatatttgtatcccatgtgagtgctcaccaacaagtgacctcagcggaggaggggtttaataatctagtggataggatgacccattttgtggacaccactcagcctctttcccctgccatcgcccatggccaacaaagtggccatggtggcagggatggaagtaatgcttgggctcagcaacatggacttccactcaccaaggctgacctggctacggccactgctgagtgcctaatttgccagcagcagagaccgacaccaagccctcagtatgtcaccattccttgggtgatcagccagctacctggtggcggattgattatattggacctcttccatcatggaaagggcagaggattgtcctcactcaaatagacacttactctggatatgggttcgcctatcctgtatgcaatgcttctaccaagactaccatttgtggaatgtttttttggtttgttgttgttgttgttgttgttgttttgagaaggggtctcactctgttgcccaggctggagtgcagtggcacaatcttggctcattgcaacatccgcctcccgggttcaagtgattctcctgcctccgcctcccaagtagctaggattacaggcacccgccaccacacccagctaatttttgtattttcagtagagacagggtttcaccatgttggccaggctggtcttgaactcctgacttcaagtgatctgcctgcctcggcctcccaaagtgctgggattacaggcgtgagccaccgcacccagctgactcatggaatgccttatccaccatcatggtatgccacgcagcattgcctctgaccaaggcactcactttacagctaaagaagtgcggcagtaggctcatgctcatggaattcactggtcttaccatgctctccatcatcctaaagcagctggattgacagaacagtggaatggcctattgaagtcacaattacaacgccaactaggtgacaatactttgcagaactgtgggaaagtcctccagaaggccgtgtatcctctgaatcagcgtccaatataaggtactgtttctcccatagccaggattcacaggtccaggaatcgaggggtggaactggaagtggcaccactcaccatcacccctagtgatccactagcaaaatttttgcttcctctcctgcaacattatgttctgctggcctagaggtcttaattccagagggaagaatgctgccaccaggagacacaacaatgattccattaaactggaagttaagattgtcacctggacactttgggctcctcctccctttaagtcaacaggctcagagggggagttacagtgttggctaaggtgactgacccagactatcaagatgaaatcagtctacaacttcacaacggaagtaaggaagagtatgcatggaatacatgagacccattagggcatctcttcgtattaccatgccctgtgattactgtcaatgcaaaaccacaacagccaaatccaggcaggactacaaatgatccggaccattcaggaatgaaggtttggatcactccaccaggaaaaaaacccatgacctgctgaggtatttggggaaggcaaagttaatacagaatgggtagaagaaggtagtcatcaataccagctatgaccacgtgaccagctgcagaaatgaggactgtaactgccatgagtatttcctccttcatttgttaaaaacatgtttgtgtatgtatacacatgtactaatatcttcactttatatttccttttcctttatcatgtgacataagatttattgatttcataacagcatttaagtattattaactttatgtaatagtatttgggttggggattggtgtgtttctggttgtatgaaggatagttttattacattaggtgtaattatgaccttattattgtctttattttaagattacatacgatctcagatgtatatgggttcaagttgacaaggagtggacttgtaatgttaatactgtcaacttgattggactgaaggatgcaatattgatcctgggtgtatctgtgagggtgttgccaaaggagattaacatttgagtcagtgggctggggaaggcagacccacccttaactgggtgggcaccatctaatcagccaccagcgaatatagagcaggaagaaaaacatgaagagatgggcctagcctcccagcctatatctttctcccgtgctggatgcttcctgccctcgaacatcggactccaagttcttcattttggggactcggattggctctccttgcttctcagcttgcagacagcctactgtgggaccttgtgatcacgtaaatcaatacttaataaactctcctttggagatatatcctattagttctgtccctctaagagaatcctgactaaaacaagtagtgtggggctcgtgacaaaaactgatagctttgctgccaaaggggctcctgtggcatgacagagctgttgtccacagcaaatgccatctcacactactggaattataaattccactatttgaataaccactgccgaattcaggatttagcagcttttctgaaggaaccataaataggaattcaatggttcctatagtaggaactggacttggtaatcccagcctgtaatctcccagcactttgggaggccaaggcgggtggatcacttgaagccaggagattgagaccagcctggccaacacagtaaaaccctatctctactaaaaatacaaaaacagaataactagctgggcactgatttttattatttagatggtatgcacctgtaatcccagctactcaggaggctgaggcaggaaaattgcttgaacccaggaggtggaggctgcagtgagccaagatcacgccactgcactccagcctacgtaacagagcaagactccgtctcaaaaaaaaaaaaaaaagttcctatagtagtagtggcacacctgtgacccatttacaacagacgaatgtgggtgggaagccctattctatgctcgtccagcctactttacatataaagtattattgtaactccagatcatgacagggaaaatgctgagaaatgagttcattaaagagcttttaaaagcctaacagattataatgtcaaagggttccatgaaaagcaactattcagttgcttttactattcggttatgccatttccctattctatctctgacaactattattagtagttatcctttgggagctgttatgaaccaaaaactaaaaaggacgtctgtaactagttttgatagaggcaagaggcaaacaaatgtctaggcagacaggggcgggtcctcagtgaaacccgaactttaatccggaaactgtcctgggtaaatcctgagatcggattaagaacctgccttcccgtttggcatgattgatccccatccttcacctatttaacctgtacctaccctttcctaattggttttctacactgtcctgcccaccttggagtggtgtcttcgctttgaccttttttgcatactcacaaaccaatgaccacacactcccattctgaaccaataaagagccccaggctcagccatattacggaactttcctgtcttcaggtagtagaaccacctaccatgttctctctttttgctaagagctttcctttcgattaatagattctactccactcactctttgatgtccacgtgcctaattcttccgctcctgagataagaacctggacctagttgagctaaggagcaaaaatcctgcatcagtttcatggtcaaagagaacttaaaaggacatctgtgccatccttaacaacataccataaaaatccaaaatttaattttccccagaaatacataatgacataagatgcaatctactcaaatcttttcctcatttaaggcacagggtaaaaatacagtcaaaaacaccaatacattttaaatatcatttatcagaatgcagattatcaaagggcagcttttatccattgtaatctttcccctatccaaccctcagcacccccaccccgcccccagccacacactctcagatgacttcctgggctgcatgtggttcatggaatatgaacagtagctgaaattcagcctaagagggtaaaactgatagaaaattatacaattggaaagtgggaaggtcatgaagctatgagcacatctagctagccacttagcatctgtatttcatcaacagttaagctattctttacttgtcaccacataaatagaatatgattttaaaatacacacacacacccccttatggaaaatgatcctagaaaggtaatgctagtgtcatctttcaagttaaagtactgttgttttttttttcccagaaatccccagttttcaataaattaaagcgattatccaattttatagttattttattctgaaacatgtataagtacaatacactctttaaatgctctatagatgttaaactggttcaagtattccaaaattaattttaataaattcatgtatgaatttcatctcacacagaatcacttgaagttacttactattcggttatgccttaaatgcttagttacatattttatggataaaaggatatgacactattattttcaaatctggatgttcaggaggatcaaaaaatgaacccttgtgaatgagaagcatttactctaaaaaaaaaacctctcactgaccaattgaccatttatactattcctcttctatccatacagataataaagttaactttaaatagatttgtgagtaagagtcaagagaatttgaaagctgggtacagaagtctgtatgctttactgaagcaccagtttaatctgacactcactgtggccttgaatgagtcacctttcagggctgagttctctaatctgtaaaatgagagtgttatgttaaatgtttactgaggttgattattctatcagctacttgtaattcagctgcatcatttcagttagctataaataaaccccctaagaccctcagtgtgaatatgaacaactatcatttcatattatttcatatatcaagtattctcatttataattgggttgaggtttattaaaaaaaaaaaaaaaagctttttggcaaagggagggactgaaaacaaattcaccactgcatggtgccctgcttgagccaatctgactggagcttaagaaactccacccagttctggctaacatcaaaggagactcaacaccactctgccagaaaataagccctgtattatctaaccaggcactaagggaacacacagttttcaagcacagcactttgtatatctgatctttcattctgatgacatgcctgaagtgaaactattagtgagccgggttttttaaaataggtaaactaaggcaagaggcaactacatggcatgatgataaaatactctcttgactacaatctcactattaagagctaggtgctcataaacaggaaataaggatatatgatgaggccacagtactttgttgtatgctttactttggatagttcacaaactctggaattaattactgtactaaaaatattttacaggtctatacagattaaacagtgttaatatctaacttaattacacagaagttctgaagaaccttttaagctccatgaagtcctcctgaaaattttaggtcattcgcatctagagccactcactcggggtctgtgctcattctgtctgatgagaaattggcaatctggtttaccaatggcctgttgctgtctctgtcctcttctattcaccccttgaaaggtgctactatgggagctaaaatgcagggaaaaaactcatgaaaagctagaacagagcttgggcaaaatggcaaaaccccatctctacaaaaacatgtaaaaattagccaggcatggtggcacatgcctgtagtccctgctactcaggaggctgaggtgggaggactgattgagcccaggaggttgaggctgcagtgagccactattgcaccactgcactccggcgtgggcaacagagtgaaaccctgactcaaaaaaaaaaagcaagaacagaagcctgattcccaccatcatactcacttttcctaaccactgtgttaggaaaccttcattttactgtgtcacattagccaaatttctaccgacattcatttgcagtagccagcattctctttttaaaagtatagaatcctatttcttaatttaaaagtgggtaagaaaatgtacatccctggaaagaccattgttcatcccagagatggttctattgaagatgtctgagttcttggttctggtgtgaaaaaggaagaaaaatattatggcaacatgggaactttcagggaataaagcagatatagatatggtatcaaagtagggaaagggtatacaggcccaggagccctaggaggcaaaagaaagggagttaataccatgccaaagacaagcttgctatctttcaaaatatcgcctcctgtcagtttcagcagaaagaaataaactttcttctcagtgacctaggctactttgaggcaaatcattttgagttccaaacaacccatttaataaactttaaataattattactaaaggtaggatactgcttataatgctcacttatattttctctataactgatagcctgtcctttttgggtgggtgggggcgggggcggttatggacaagacaaggaaccataaagatatctgggttaatgttttcttttatacgtttgtttttgcatgacatttaaatgacagagaattctaaagccaacactaagctgctatcctaggacattagtgagaatgctgtggccaaaatatagtgctcattcctcaggcttgaaaggaaccccacgtcgccagtgtgggagatcatttataatcttgatggatacaggtatagcctgcttcataataatttaatattcaacatcagatttttttttagtatgcctagcaggtttttagttactaattaactttattacccagatttgtttcttactgaacttctttcagaggcctgttatacatcaagctgaactttgtctggcagctgtgctgtttttaatttatttaaccacaaaaccttgatttatactttcaagcaaaatgatattttacttaaaaataaatctttagcaaggatgtctacaggaatcaactaccaacttacacagttcacagacacatatgattcctcagacaaatctgaatttctcctgcttctcctccaaaccagacttgcagatagcaacagacaactgaggaagatcttgactatcctgagcaataaactacaacccccctgaagaatatattaactgtccacccctaggttcctccctacacagttcaaggacaacagctgtgctattacaaactgatggaatttccaggcttgacagggttctgttcgtaaccaccatttgtcctgttcatcataggattagcaacagcagagagcccttgattactagaatagctgaggccatcacacagctacattcctacatgaaagaacacactgatataggtttaaagaagttatattttactttcatgtagttaccagagtcccccccaccccccatttaagggagccctgttctctggatataaaaatactgtatacacttgcacacacatactcacatacataaaaccttgcatcacaaagttaaaaggctaccttgcttacttacaggaactatccaggcagcttgtgttcagtcctgactaaatgcattttggatcaggcacctgccttcaacatttctgtccaaatgaatttcaatctatttctccaggaagaacacaccagatacctcccactgttagccatgtgatacaggcagcatgatgtctgaagtctggttacggttatgtaggccaaaataagaaatgacaatgacacagcacttacatttctgatatcaccaaccttaagaatgaatcttccattttatctaaattttttaaatgagtaaaactttaaaagattcttaatacctaacccctcaaaattttgaaaaaggagcattttttttaaactttacatttatcccacttccttcctctaacacaggaaaacattcagagttaatctataccaatccaaaaattatttctaaccacattctaaaggcattttttttttttttgagacagggtcttggcctgttgcccaggctggagaatgcagtggcatgatctcagctcactacaacctccgcctcctgggttcaagtgattctcctaactcagcctcctgagtagctgcgattgcaggcatgcacaccaccatgcctggctaatttttgtatcttcagtagagacgaggtttcatcatgttggccagactggtctcaaactcctggcctcaagtgatccacccatcttggcctcccaaagtgctgggattacaggcatgagccaccatgcctggctctaaaggcttacaccagttgaactgatctaggatccaatcccctcactttaatagatggaaaaaaaaatgagaaatggaaaaaacaagtcacttacaaatgaggctgagacaaaggatcggcgaaaagagccacagaacaccaaaaacagaagcagagcgtgacaaaataagcaaaaccttacagttttgtagtttctgcttttatctaacacaatgacttcgctgtacttcatataccttttgaattatacctgcttatacatacctttacctacctactacttatacctacctatcttttcttctgcaaggagggaggcaggcaggaagaatcctgaacatcaggaaaacattccacctgatctttaaagggaccccaatgcctagatgtctttttcttttttctttttttttttttttgtaaatccaaactcttacgtgtaatatcaaggctgactgacaagactcagtcctatcacccaccataatcatcagcagctttccatgtagggtctccctacaatttagtcacatgggaccatctaccatcttacattatcactgtacaccctatgctcatttgctctccaaacttgaagttatcttctctccctcctcatttgtgaaagtcttgaaatcaaggtccacataaattgtcttaccaccttttctgtgactgctttttagaatctttctcccagtagtattcagaactaatacatcatctgtacttgtaacagtagagtctgatctatactgtagttcagtggtccccaaaccttttggcaccagggacaggtttcgtggaaaacaatttttccacagatagcaggaggggtgagagggaggagatggtttcgggatgaaactcttccacctccgatcatcagtcattagattctcacaggagcatgcaacctagatccatcgcatgtgcagttcacaatagggtttgcgctcctatgataatctaaaaccactgctgatctgacagaaggcagaactcaggcacacttatcgcaaagttaatgtaatgctgttcacctgctgctcacctcctgccgtgcagcccagttcctaactggccatggactggtaccaatctacagaccgagggttggggaccccccactgtagttagttgtatataccagctcctgtaaactgctgggtcccagaagagaggaccacatcaaagtgatgtgcacaccttctctgttcctagtagactacagaggagacaggccaaaatgataaaaaccaacaaaacaaggggctaaaaacacatttctaaaatgacacgatgaaagttattagaaattgaatctaatttgaaattaatcagaagttccaaaattacaaaaactcttcacaactagaaaaagaataaacagattcaaggctgaaaggttatcaccaattacaaatattcaccttggctaggtgtggtggctcatgcttgtaatcccagcactcagcactttgggaggctgaggtgggtggattatgaggtcaagagattgagaccatcctggccaacaaggtgaaacccctctctactaaaaatacaaaaattagccgggcgtggtggtgtgcacctgtagtcccagctactcgagaggctgaggcaggagaatcacttgaacctgggaggtggaggttgcagtgagccaagatcgtgtcactgcactccagcctgggtgacagagtgagactctgtctcaaaaaaataaaaataaaaaagaatattcacctattttcttccactttctaaacacagtttgtacaagagcaagcatgttgtctggaattatagaaagaaagccagtaaggagtaaccgtacgaaccagctctccatgctggtcatcttatcattattaggcatagcaataaaaatagctctctctgcttttagaaaagcatgacatgatgcaatgtggcaaaaacaaatattcaagatggtcgaccagttactggcctggcatggtgactcacacctgtaatcccagaactctgggaggccaaagcaggaagaccacttgagcccaggaattcaagactagcctgggcaagatggcaagacaccatctctacaaaaaaaaatgtttttaattagctgggcatggtggtgtgtgcctgtagtgccagcctctcaggaggctgaggcagtaggattccttgagcccaggagcttgaggatgcagtgagctatgattacaacactgtactccagtctgggcgagaaagtgagaccacatctctgagggacagagagagaaagagagaaagatatcagccactaccatcatgttaatatgatcatataaatattaaaactttataattattaaaatattaaatctctatagttatcagctcatatatctgtcagaaagtaataagcatatcatgtaactttaggatgacttagtgctgaggagattggaagaaaggaagaatattcatacttgatcagctcttagcttttgagaactattttattaaagaaaaaactctcttttggctgggcatggtggttcatgcctataatcccaacattctggaaggctgaggcaggaaaactgcttgagcccaagagtacaagaccagcctgggcaacacagttgagactgcgtctccacagaaaacattttaaaattagcctgcacacctgtggtcccagctcttgggaggctgaggtggacggatcacttcagcagaggaagttcaaggctgcagtgagccgtgatagcaccactgcactccagcctgggctacagagtgaggccctgtcttgaaaataatagataacaaaagaaaaacttctcccattaagcaaagtgaagtttcactctattttatatcagtgaaaataaagaaaagtggaaggtagaagaggacataggaatttgtgctgccaattctataatttttgttttgttttgttttttgtggggtttttgagacggagatttttgtatttttagtagagacagggtttcaccatgttagtcaggctggtcttgaactcctgacctcaagtgattcgcctgcctcagcctcccaaagtgttgggattacaggtgtgagccaccatgcccacccttgtaattgtttatttacaatgtgtgtcccacccagagttccccttaacgcttgagttcctcgatggctaggatagcatctttctcaccttttatcctggacatctaaatataataaacttgaaacctcacaggctctcattaaatgcacatttgtcctgctaggtgcgctctgctccataccataccagccttctcttgctggggttgatgtttgcacagctggaagcaccctcatagttcttctaagtattggttctaggcacgactaagggtagagtagctcagcttttctgagcaagaaggagaagatacaaactctatgggagtacttaacaagcattttgtagtcgtggcaaaggccttactttgacctaatatcttacagatgctttcaaaaaggagggggggaatatcattattaaatgaaaattgaacagcaaaagttgaagagatctttcaagttattagtaacataacttttaatattttacctgaaatacaagtaaaaatctgaattaaaagtattaaaaaaacaaaaaaaacacgctggatcagaattgttcagggacagggttaagcaatatgagtattatttgttgttgttgttttgttttttttagagacaagtcacactatgttgcccaggctggagtgcattggctagtcacaggtgtgctcattgtacactacagcttcaagctcctgggctcaagcgatcctccagcctcaacctcccaggtagctgagactagaagcatgtgctactgcaccaaaaatctcagtgttgttggttttcttgcagtaagggtaatcatgacacagagaaatctcattaaagttgagtccgagaggcacccacaattgagggtcactgaattaatcaacaatctacctaatccattcaagataaaattcactgaaatgaaatgcaacacaggattaatacaacttaacaatagaaagacatcacactcccccttgttaggaaggtgttttagaatcagtttactagatgtagaatctgaggcacggatttttgtacaagtgatttactaagggagtgcttttaggaaaaacctataaggttttattttattttaaggttttatgatattttaaaggtatcaactatccccaaactaatctatagtttttgtttgtttttgtttttttttttagacagagtctcactctgttgcccaggctggagtgcagtggcacatgatcttggctcactgcaacctccgcctcccaggttcaagcaattctcctgcctcagcctcctgaatagctgggaccacaggcgtgcgccaccacatccggctaatttttgtatttttagtagagacagggtttcaccatgttggccaggctgttctcaaactcctgaccttgtgatccacctgtcttggcctcctaaagtgttgggattacaggcgtgagacaccacgcccggcctaatctatagatttaacataaccccaagcaaagtccagtaggttttttcttttcaaatcaaactgaaaagttgatcctaagttttacatagtaatttaaaaagtcaagaacagctaagataatctttgagaacaaacttagaggaacttaaactactggatatcaaaacttactgatggattgaaccatgtgaaaatgctgaaaactgatgagtttctaacctatggcaatgtcatatgtttgaaactaaaaatacataaatatagtaatgaaaacattgtggtacctgcacaatcaccaagaaagaggccaatgtacttggtgtgctgaacatatggaaaaacaaaacaaaacaaaacaagaggccaatgcaaaaaaatggttttgaaacggaaccacatgcatatggatacttaatatctgacaaatgtgacactgcaaaatagtgggggaattaactgtcttttcaataagtggtgctgggtcaactggatattttgagctctacctcacagtatatacaaaaagtaattccaggtggatggcagccctaaatgtgaacggtaaacaataacatggcgaatattttcatgatcacagaggcagatgaagaaaacgaacagacaatggagagagtagagagacagggacaaaagaaggaaaaaagaaaagcaaaaagaagatgatgaggtgggaggatcatttgagcccaggaatttgaatacagcctcggcaaggtggcaagaagggagggagggaaattcccctcagcagtacttaccaacttacaagaaacagatgggcttatttctaattgtaacactaaatgattttttttaaaaaatgaagtgatgcctttaaaactgagaaaaactattttgaagctagatttttacagccaactcatccattaagtgaaggctaaaatgggaaattcaaacacacaatttaaaaaaaattattggctgggcgtggtggctcatgcctgtaatcccagcactttgcgaggctgaggcgagcggatcacaaggtcaagagatggagaccatcctagccaacatggtgaaaccccgtctctacgaaaaacacaacaaaattagctgtgcgtggtggcatgcgcctatagtcccagctactcagggggctgaggcagaagaatcacttgaacccgggaggcagaggttgcagtgagccaagattgcgccacggcactccagcctgggcaacagagtgacactccatctcaggggggaaaaaaaaaaatttattttccaggcattctttctgaaaatgaacttcagcacagactccaggaaatgaaaaatgaacacagcatcctattaaagctgcaatatccaaaaaatagtaccattagcctacaagagaaatgaaatgcaatcctaggatgacgataatgcactaggatctagaaacaactctgtccaaaattaacctttccatagtgtaatttaaaaagaccaatgacttagacatgtggtgcaaatggtatatgaaaaaaggtgcaattaaaaacaggggaggggagcagtttactgaaagagaactacacaagaaagtactaatccaaacataaggcaaactgaactatggcattattctgagataattatatattttaaggagacaaggcttagaattagaacactctcatcaaacttaccaacataagatggatccataaagaaggatattttgtatttacatacaaatgaacatgtacaatataatgtatcaagaaagaacaaaaaaggagaaaagagaaggaggcttcggaaagatggagatgactccaaaacagcagctgaaatcaactgaaagacttttgctgactctctgagtttactcttaagtgggcagaagtcaaagagaactttgcctgctcactggaatgtgtttctctattggtctctaagtctgcatgtgctgacctttaaaagacagtataaggtttgtctgttttcccttctgctagcaggctgctagactgaacatggtagacaatgactttccctctgaagttggctgtgttcaatattctattgtttttcttatacaagcactgggagatttttgcaattgatgtatttttaatcatttaaaactaagcaagccatgacaatataaaagacaaacttacaccacaaatgaaactactaacaaaaataacaaatatactcatctggggatggcaggggttggggggagaccctctcctaaacatagcaagcaccaaagggctgctttgacttgcaatactaaactccttccaagaaatttggaagtaaattcagagtaaccaaagatacaaaaagcaatatgcaacaggagaaagtatttgggtgtgaataaagaatcaaaaaatgggccaggtgcagtggctcacgccagtaatcccagcacttggggaggccgaggcaggtggatcatgaggtcaagagatcgagaccatccaggccaacatggtgaaatcctgtctctactaaaaatacaaaaattagctgggcgtggtggagcgtgcctgtagtcccagctactcgggaggctgaggcaggagaatcgcttgaacctgggaggcagaggttgcagtgagctgagatcacaccactgcactccagcctgggcaacagagtttgactctgtctttaaaaaaaataataaataaaaaaattttaaaaatgtacaaaatgaaagggaccgtggcaaagatggggattctgtttcttctccctgggtgctcagaaagacatttcctatttcccttggagttagaagttgagaccatgtgagtgggttctagacagtgcaatgtgagctgaagaattatgcttcactacaaagcacttgatgaaattctgcttgctggtgctctttgctatcaaccaactaaatacaaagaatccagcaggagactccaagacaccagatggaaggagttgaaattcctcaattacatgacagccacaggctaaacactcacactatgacgtgagcaagaaataaaccattattgtgttaagtcactgaaatgctagttatgttaaagagttagcatcaactatcctaattaatacagagatcttacatatctaacatcctcattttacaaataaggaaactgatgaacaatgagctttccaaaaattatactagttggtaggagaaacaggtctcctgactttctattcagggacttttacaaagtaaaagatttctgtgctacatttataagtaaaagttattatcacaatatttgttccaaaaccaaaaaaaggcagtgcaatcatttctttttctttttttttttgaagcagggtctcactctggtgtccaggctcgagtgcagtggcatgaccatgacttactgcagcctcgacctcccagtcacctctgtttgcaaaaagaaaagaattctccacgaagttctttttcagtctaccattttatgatttgactctcttcatgtcgacaaaatttcttgagtatctattagaactgtataagattgtggatatctgaacatttatttactgacaaaatgtgatttcatatggcttgacttaatagtaaatgacaagcactgcatttttagaaagcgctaattttattaggtatacatacctacacacttttttttttttttttttgagacagagtctctgtcatgcaggctagagtgcaatggtgcgatctcggctcactgccacctctgcctcctgggttcaagtaattctcatgcctcagcctcccaagtagcgggcagtacaggcgtgcatcaccatgcccagctaatttttgtattattagtagagacgggttttcaccacaccgggcaggctgatctccaactcctgacctcaggtgatctgcacacctcagcctcccaaagtgctgagattacaggcatgagccaccatgacatctttttacaagaagaaataatatgctgacttggccaggtgtggtggctcacacctataatcccagcactttgggcggtcaaggcgggcagctcacctgaggtcaggagttcaagaccagcctggccgacgtggtaaaaaccctgtctctactaaaaatacaaaaattagccaggcgtggtggtgcacacccataatcccagctactcaggaggctgaggcaggagaattacttgaacctggaaggcggaggttgcagtgagccgagatcgtaccactgcactccagcctgggctacaagtgcgaaactctgcctcaaaaataataataataataataataataataataataacaataataataatatgctgacttagaggctcctggactattgtcattagaactataaagcaaagtctatacatctgaagagaaatttcttttaaatatactcttctcctgtgtccttactgctttgtattaccttacaaagaaactactacatatacaatttcagctaatgaacataaaggatcaaaattagtgactattaggccaaatgttttggccaaaattgttgcaattaccatgtaaacataaatcctgcttgcctattattccatcagtttatacttccacttaatcaaggatttaagattgagtttgccttgtcaggctcacagaggcttaaattacttgtaaataaacattcccacaagagactacatcataaacgctcatatttattacatcccactcaaatacaacagtttctcttttaaaaattggcaatctatacaaaacagcaatttagattggccttcaggacagagaggtatgattcttagtaaatcacattacatcaagatgctttattctgaagatgtaagaaacgaatatatttttacaaaaacactatatgtcaagtgaatatatggttagagtgtaagaaaaacttatttcccttgtctttaagatttttctagaagaatcttaatcttcctataaaaccacctgtctgataaaaggaagtctgaaatcttatctccaaataaatcttatctcaaattaataaaagactaaatttcagaagtttctcagatttcatttttgctgttacagtaattaagttatgccattatcttatgcagttgattttaagtgatgaacacccacctacatcattatttccatatagaaccaccaacaattaattagttcaaactaaaaataatgaaataaagtattaaaatgttctccataactaagaaaatactgtcactgtcagctttactatttctacccatcaccacgactaccccccaaaaaccctacatatcaatacagctttcatcaaattagaatcaatttgcttgaaaaaacagaaacatatgcatcacccattactatgtacacatctgccagataatgattagaggcggcaagtatgccaagagtccaaaaagcaggtgagaatcttctgtagcctagaaaaaagtgtatctagagaaaacataatagtctcctctattcccaaagcacttaagactagtaagacttcctgaagtctccaactcataaatggtcattgtttcacagctcaagtaaatacatgtatgaacatgtaaaataaaaaagagtaagggagaaccttaaattctccagtttactctcaaattttaaaactcagaaaagagagatccaaagtggtttccctttgccaaaagccatctagaaaactagagacaaagctacaattaggacaaacatctcccaactcccaccaagcccagagttccctccccaaaatgaatactcactgaacccacaagagaagcaccagttcagagtgcaaacctaggtcaaacaggccccttggtgcagtggcccatatagtgttttgaaaaatggccaatatctccaaaatcagtaatctttgaatgaaaatacagttttacagcttttttaaaaaacagggccaggcgcgttggctcagtcctgtaatcccagaactttaggaggctgaaatgggaggatcccttaagcccaggggctcgagaccagcctgggcagcacagtgaaactccgtgtctacaaaaaataaaaaaaattagccgagcatgcacctgtggttccagctactcaggagactaaaatgggaggatcgtttgagcccgggaggtcaaggctgcagtgagccatgattgcggaactgcacctcagccttgggtgatagtgtaagaccctgtctcaaaaaaataaaaaatccgaagatcaggccatgactatgtatttccacttagcaacaatatactggagctgagaaataactgcctctgtagatacccattcacacaatatctgcagcataagttcttaatcaagaccaacttcactcactttaacttcaagaacgttgcaggggccaggcactgtggctcacgcctgtaatcccagtactttgggaggccaaggtgggcagatcacctgaggccaggagtttgagatcagcctggccaacatagtgaaacctcatctctactaaaaacacaaaaattagccaggtgtggtagcacacgcctatagtcccaactacttgggaggctgacgcaggagaatcactcaaacccaggaggcggaggttgtagcgagccaaaatcgcaccactgtactctagcatgggcaacaaagcaagacaccatctctggggggggagggaaatttgcaggagtttaagtacgacacagctgcactaaagctatttaaatcaacatcaactctaaacatttcttattggtagtagaattttggctgggttttagtggcttggtttaactaaatcacaaagtcagtagacaggaaaggtgtgagagggagagaaatggaaaacaaaagtaccacaaaatggctgggcacggtggctcacacctgtaatcccagcactttgggagggtgaggcaggtggatcacaaggtcaggagttccagaccagcctggccaagatggtgaaaccccgtctctactaaaaatacgaaaattagctgggcatggtggccggcgcctgtagtcccaattactcaggaggctgaggcagagaactgcttgaacccaggaggcggaggtggcagtgagccaagattgcgccactgcactccagcctaggcaacagagtgagactccttctcaaaaaaaaaaaaaggtaccacaaaactagtggtaattcctttagaacataatcagaacttcattcacacatccaaaatgtcttacttctggtcaggcaccgtggcaaaggtctgtaatcccagcatactgggaggccgaggcgggcagatcgcttgagcccaggagttcaagaccagcctgggcaacatggtgaacccctgcctcgataaaaaatacaaaaaaggttagctggttgtggtggcacacacctgtagtcccagctacttgggaggctgaggtgtgaggatcactggagtctgggaagttgaggatgagtgagtcgaaattgtgccactgcactccagcctgggcaacagagtgagactctgtctcaaaattaaataagccaggtggggtggctcacacctgtaatcccagcactttgtgaggccaaagcgggcagatcacttgaggtcaggagttcaagaccagcctggccgacatggtaaaaccctgtctctactaaaaatacaaaaattagccaggcgtggtggtgcacacccataatcccagctactcgggaggctggcatgagaatgcttaaaacccaggaggcggaggctgcagtgagccgagatggcgccactgaactccagcatgggtgacagagcgagactctgtctctaaataaataaataagtaaatgcatatttttttaagtcttacttccctaggaagcaataatcactaactcctttttcagttttgtcaatgacctgaaaagcttggtcctgacacctctgctttatggaaaaggcaagaatgcatactgattcctaaggtagtaatctgaacggtttaaaattccatacatgtagctacagacaactagtataatggcagagatcttacatgatattttaagatctagttccagtagtaataaaatcgtagtaaaaagaggtaggtcgggcacggtggcttacgcctgtaatcccagcactttgggaggccgaggtgggaggatcacgaggtcaggggatcaaggccattctggctaacacggtgaaaccccgtctctattaaaatacaaaaaattagctgggcgtggtggcatgcacctgtagtcccagctactcaggaggctgaggtagggaaatcgcttgaacccaggaggcagaggttgcagtgagccgagatccctactgcacagagcaactgagcaagattccatctcaaaaaaaaaaatatatatatataatatatgtattatatattcatatgtaatattatgtattatatattacatattcacatgtaatatatattatatattttatatatatggcatttctggccaggtgtggtggctcacgtctgtaatcccaccactttgaaaggctgaggtgggaggatcatctaaggctaagaatttgatttcagtcttggcaacacagtgagaccctgtctcaattagaaaataaaaaaaaatttaaacacagcatttccagtcctttcaaactcagatgaagtttaattaaaatcttcaggggacaccccagtaaagcaacagcatacctcacacccagatgctggtttctaataccattctctgataaagaaaccaagactctttggagaaatgactaattctaggactgagaacaaaatattcaagatgagcctgaagtaccttgtatttccagaaagttaggaagtgctaaaaataaaaataaaaaaaaaaaaacaacgataggggtaagttggccggacgaggtggctcaggcctgtaatgccagcactttgggaggccaaggcaggcagatcacctgaagtcaggagttcaagaccagcctgaccaacatgattaaaacccgtctctataaaaaacccaaatattaaccaggcatgatggtgggtgcctgtaatcccagctactcgggaggctgagacaggagaattgcttgaacccaggaagtgtaggtagcactgagccgagattgtaccactgcactccagcctgggcgacagagtaagactccatctcaaaaaaaaaaaaaaaaaaaaaaaaaagataggggtaactcaattacacaggagtcaactaaaaaagttcccaatgaccaaagctggaacaatataaacaatagactgaataaataaatgagagagaataagcaagtcttcagtgaagaattccaaacaagatactccacttccaagaggtagaacataacccttcatcctttacatgtgcatagcacatagtgacctccttctaaagagtacaatatgaaaatgggaggggggggtaagagaaatatgacaaatactacctaagccaagtgatcaagactaatatcaatagtgataaatcagctgggtgcaatggcttacatctgtaatcccagcactttggcaggccaaggcaggaggttcacttgaggccaggagttctgacaccaacttaggcaagcaacatggcgaaaccccatctctatgaaaaatacaaaaattaggctgggtgcggtggctcacacctgtaatcccagcactttgggaagccaaagtagggggatctcaaggtcaggagattgagatcatcctggctaacatggtgaaaccctgtctctactaaaaatacaaaaagttagctgggtgtggtggcacatgcctgtagtcccacctacttgggaggccgaggcaggagaatcacttgaacccaggagacggaagttacagtgagccaaggtcgcgccactgcactccagcctgggcgacagagcaagactccatctcaaaaaaaaacaaaaaaacaaaaaaattagccaggcatggtggtacgtgcctgtagtcccaactacccgggaggctgaggtgggaggatcacttgggccctggaggccagggttgcggtaagccacgatcgtgccactgcaacccagcctgggcaacagagcaagactctttctcaaaaaaaaattagctgggcttggtggcatgtgcctatggtcccagctatttgggaagctgagttgagaggaagcttgagtcgagtccaggaggttccagtgaactgtgatcacagcactgtactccagcttgagtgataaagcaaaacacacacatacacacacacatacacacacacacacacacagacataaatcatgctgacatgatttgatagtatgcacccttgatataatgtgataagagtggcactttacctctgtgatcttccttctaaaaagcataacctctgtctaatcatgagaaaaagatcagacaactcccaactgaaggacactctacaaaatatcagaccagtactcctcaaaactgtcaaagtcatcaaaaacaagggaggtgtaagaaactgtcatagccaagagaaagctaagtatgataactaaacataatgtggtatcctagatgagatcctagaacagaaaaaggtatttaggtaaaaattaaggaaatctaaataaactatgaactttagttaataataatgtatgaaaattgaggtcaggagttcgcgagcggcctggccaacatggtgaaactgcatttctactaaaaaaaaataataaaaaaattagatgggcatggtggtgtgcgcctgtaatcccagctactagggagactcaggcaggagaattacttgaatctcggaggcggaggttgcagttagcccaagatcgcaccactacactccagcctgggcaagagagcaagactccgtctcaaaaaaaaaaaaattagccaggtgtggtggcaggcacctgtaatcccagctactcaggaggctgaggcaggagaatcgcttgaacccaggagacagaggttgcagtgagctgagattgtggcactgcactccagcctgggtgacagagaaagactccttctcaaaaacaaacaaaaacaaaaaattctagtaataaccattatttacttccaacttaaatctgatccacgacctaaaactgcactctgaaataatctacaattcccctgagaaacttaataaatatagacaaaagtgtgtatatcaattaacttacaagtctctaatcactgcaaactagctgactctcgttaaagcttcaaatcttaaagttctaccactggtactcttagaagctaacttacccttgttgatcacagagagacaacagtgaccaagtctaataaaagcttattcatgtacacagaaacaaaacaaagtaacttggtgatgtgcacatctaatatttccaaccaaatcacaaaactttagaaagggcatttgaatccaacctccttattttaaaagtgagaaaagtccaaggagattaacaaatatatttgttcaaagtcatccctgagttctcaactaaaagtagaatttcttttctgtcctatatcccaaatcaggaagcaaggggaaaaggtaggaggtattatcattctgatcatcatttcctctgctaacttagaatgctttcgtttctcagggataaagaaggtaagtccagctatatctatgtattggaaatagcatcacatagctctcctttttaaaatggcatgccctcctcatgtggatttttatcttctatttaactatcagttatcgcactatgcttctacagttagtatctatgatgtgaaagttgaagccctggttaaagcttcttaaatctaccattttattttgtacaaacagaaaagtatattagttttctttccagctgtccttaatttttttaattgaagtgaagtttacataacatacaattaaccattttaaagtacattatgatttctctccagtttcaaactgtccttaagaatttttttatttttatttttaatttttttgaaacgggagtctcgctctgtcacccaggcttgagtgcagtggtaggatctcagctcactgcaacctccgcctccgaggttcaagtgattctcctgcctcagcctccagagtagctgggattataggtgcacgccaccacagccagctagtttttgtatttttagtaaagacggattttttcactatgttggccaggctggtttcgaactcctgatcctaggtgatctgcccgcctcaacctcccaaagtgctgggattacaggtgtaagccaccgtgtccagccaagaatttttaattaaagatgcactaatccaaatgtagatgagctactcaattttcagttaattaatcacatctgaagataatgatggcctatgccctcatatcaagtgtatcctgagcccttttatcattctaatctctttctacacgtggccaaccagagtgcatacatattgtgccaagtacctttcacctttttctacatatcagtagtattctatttcacagaaaactcacactcctgccctaaacataaccacagagttaggcttattgtgtggttagcctatctggcatgcctttgtctcacaaatgcttagaggacatttcacactacttagaaaggaatgatctcatcccactgacccaacagctaattttatcaaaaagctttttgttaaaagctgtgataacccaggaaaccagatctatttttacttttatggcaaggaaaaggaacagagaaaaccataaggaaaaaacagctcacacattgaccatttaaaaaaatcacttaggggcccagcacagtggctcatacctgtaatcccagcactttgggagcccaagacaggtgaattacttgaggtcaggagttcgagaccagcctggccaacatagtgaaaccccgtctctactaaaaatacaaaaaaagagctaagcattgtggcacacacctgtaatcccagctacttgggagtatgaggcatgagaatcgcttgaacctggagggggaggttgcagtgagctgagatcatgccaccacactccaccctgggcgacagagagagactctgtatccaaaaaataaaaaattttttttcacttaggccaggtgcagtggctcacacctgtaatcccagcactttgtgaggctgaggtgggaggattgcttgagtccaggagttcaagaccagcctaggcaacatactgagaccttgtctctacaaaatatacaaaaattagccaggcatggtggcacatgcctgtaatcccagctccttgggaggctgaggtgaaagatttgcttgagaccaggaggttgagtctacagtgagctgtgactgcaccactgcactccagcctgggagacagagagtgagacactgtcaaaaaaaataacttattctacagttttccccctttctttggtgtctgactacaagtgaacaaaaagaaaaactttcagaattgtttaatgcaagaaaaaaatcattattttaacaattaaaaagcaaacttcatattacagtccaaacactaaacctaccttgggtctgatttgtatgaaaaaaaaaaaaaaaaaaggatttctctccaataagaccccaagaaatatacaagtcttcagtgggagatgcaatataataaaatgacaaaatattaaaattgaagaagaaaaaggaaaaaaaaaaaagaaactccaacccatataaaaaaataagaactagaccagatgcagtggctgacacctgcaatcccagcactttgggaggccgatgagggaggactgcttcagcacaggtgttccagatcagcctgggaaacatagggagatcccgtctcaacaaaaaatttaaaaattagccaggcatggtggtatgtgcctgtggtcccagctactcaggaggctgaggtgggaggattgctggaacccaggaggttgaggctgcagtgagtcgtgatggcaccactgcactcactcaacagagtgagatcctgtctcaatagactaaaaataaaaataagaagagccagctgggcattgtggctcacacttgtaatcccagcactttgggaggccaaggcaggaggagcacatgaggtcaggagttcgagatcagcctggccaacatgatgaaaccccgcctctactaaaattacaaaaattagccaggtgtggtggcacacacctgtaatcccagctactcgggaggctgaggcatgagaattgcttgaacctgggtggtggaggttgcagtgagccgagatcccaccactgcattccagcctgggcgacagagcgagactccatccccccctctcaaaaaaaaacagcagttattgcagacttatattccagagaccattctaatcactttacataaattactttgcttaatatgttgaacaactctaggacatagataaccccatttaaaatgaggacaccagggcacttagaggttaaataacttgcctaagattgctcagctagtaaagtggcacaactcttaatttactaccaaatattgtctctcacagcaatctttatagcaagctctatgcaaagcaaaatgatcattcaacagactgaaaagtcaaaggctatgataatagcctttaacaattgaacactagtttaattgtttataacgctacctcccaccttttccacccacagccacccaatcccatccaggctgggtaaccagttagctcccttcaccaacaccactaccgacctgaccctcaaatgtaacacgtgaaactgccacacattaagcattcatctcctattaactttatgcctcctgttttttaattcttaaaaacagttgttattcatcatttatcatatttctgtgtactcaaagtacatgaatgtgccttctgtcttcgtaggtccaagggggcgccttcttgatatcgtcatgtatagagctatggccaaatgctgtgacatagggtatgcccctccagactcttgacgaggctgttctttctatgtaaacagtaccagtctctgagctaaaacacttaagaaacacaaaatagatcaagagcactgtttagagtgaatctccctaagtttatatgtatcaatcagtatgcatatgaaaaccaaatgagtgaaggcggctgatgtaaacaaaagagcctgcaacaggcaaacataagcaatgaaagctaatatagtatcttctggtgtgtagaccagctgtctgactttctaatggtgaatgttagcctacagtaagataaaacaaaagatgactataaggctgagagataaagactaaaatgaggttactggcttacagcctgaaaagtattctgaagccaaaaatcagatacagaatttggacccctatgaaatgcataaggctctccccaaatctcaactacacctccctaccctgtcattgattcttagtgggtcagaatacattcagtaagaatactagcatcaacatgaaataaaatctaaaaaggaaataaactctagtaaataaagttctgaggaaagtaaaaaagggtccctccaagaataggaaaagctgtcacaagaggtacagaacctccctttagctcttcatgtgctggattgatcctatatactcaaaagctgcatcagaatgagtaacatatgaataagagtggataagaatactaaatcaaaaatgatttatatcaattattgtccatcttcaatactaaaataattctttcacgcttaataattaaaatgctattcttcttctccaccttttcactttatttatttatgagacagggtctcattctgttactcaggctggcgtgcagtgacacaatcttggcttactgcagcctcgatctcctgaggctcaggtgatcctcccacctcagcctcccaagtagctggaactccaagcacatgccaccatgcctggctaatttttgtattttttgtagagacagggcttctccatgttgcccaggctggtctcaaactcctgggcccaagcgatcctgtcaccttggcctcccaaagtgctaggattacaggtgtgaaccacagcacccagcttcaatattttcagtacctacccctcaacctacctccatccctatgaaagtcgccatgacttcaggagcactctatatgatatgtacttctagtacacagttaatgtatgacatgtgcttctactataccactttattatttatgtgcctattaccctctataaactgtgagctcaagagtgaggattttcggccaggcacagtggctcacgcctgtaatcccagcactttgggaggccaaggtgggtggatcacctgaggtcaggagtttgaaaccagcctggccaacatggcaaaatgccatctctactaaatatacaaaaattagccaagcattggtggcaggcgtctataatcccagctactcaggaggctgaggcaagagaatcgcttcaacccagcaggtggagtttgcagtgagccgagatcacgccattgcattccagcctgggcatcagagcaagactccatctccaaaaaaagaaaaaaaaaaaaaaaaaagagtgaggattttcggaatatttggatgctcacccagcacctatcccagttccaggagcatggcagatgcaaaagaacgtatgaaagagtgaaggaaagaaaaatatgtgtttttctaattctcaagtcttcatttttttctttttatcaccatccatggcaaaaaaaaatttatattatgatccatattcacatacacatatataaatgaaacagaagttttataaatcaatactcatccatactatgtacaatgcactgaaactttttttttttttttttttgagatggagtcccactctgttgcccaggctggagtgcagtggcacgatcttggctcactgcaagctctgccttccaggttcatgccattctcccgcctcagcctcccaagcagcggggactacaggcgcctgccaccacgcccagctaattttttgtatttttagcagggacggggtttcaccgtgttagccaggatggtcttgagctcctgacctcgtgatccgcccgcctcggcctcccagagtgctgggattacaggcgtgagccactgtgcccggcctactgaaatcttctattccattatcttctagtgttgttttgcttttaagagttggctgtaggccaagggcgatggctcatgcctgtaatcccagcattttgggaggctgaggtaggcagatcacacgagcccaggagttcaagatcagcctgggcaacatggtgagatccagtctctacaaaaaatacaaaaattagccaggcatggtgatgcacgcctatagtcccacctatttgggagggctaagataggagaattacctaagcctggggaggtaaaggctgcagtgagccgagatcataccactgcactccagcctgggagacagagggaaactctgtctcaaaaaaaacaaacaaacaaaaacagcaacagaaaaaatagttggcagtgagtcataatttgaaaaatttcagtcctggtaaaaaccaatctcttaacagaaagaggtactattaaaactggttttcagttttccagtgctgacgatcccctcacgagaacaggcctctcacaaagaatctccctccctctccagaaaaaaagagcaagcacaagaagtgcctggtgcagagccccaattcttacttcctgaacgtgaaatgcccaggatgctataaaatcaccatggtcgtcagtcatgcacaatagtagttgtgtgtctggctgctctgctgtcctctgccagcctacaggaaggctctccttcagatagagacagcactgaaagaaccctgaatcaagatgagtgggaaactatatcaataaacacatatggatgccaaaaataaataaaagtagttttcaaactttaacgtggacatcccatggaaaggtggtttaaaagagattatgaagttctattcccagaatttgatttagtaaatctgggtaggagtccagaaatctgtattttaaagcagtccaaatggttctgatgcagatgataaaacaatccttatcagaaacatgcttacataatttaagatttaatctcaaaagtcatagcttgaactcttcttgcactaagttaaaggttaaacaaagtatctgcaagaggattctgtcctgctaacagactggtttttaatctgaacattgtttggctcaacagtcctttcatagacttcctctaaagcaacttggtaagccactaaaatctaactgttcctcttaactacagccctttgcaccaagaaaacagaagaatgatataaatgaaaggcatttctgttgcccagtcattggctctataactgaaagggcttttgaaaaccagtcacattgactatacaagtgacatatgcagtcatcagtttggaatctctaaggactacagctcaaaaacaatcactaacagctcaaagtctgaccccaaagtgcttaaaagccattgatgaaataaagccttcataagaacattctacaatccacgcttctactccttgctattacaagccaataggatcttaaggttttaaatttgacaaaatcatattatttatttttatttttttatttttttttgagacggcatcttgctctgtcccccaggctagagttcagtggcgtgatctcggctcactgcaagctccgcctcctgggttcaggccattctcctgcctcagcctcccgagtagctgagactacaggcgcctgcagccatgcccaactaatttttttttattgttagtagagatggggtttcaccatgttagccaggacggtctcgatctcctgaccttgtgatccgcccgcctcggcctcccaaagtgctgggattacaggcgtgagccaccgcgcccagcctatttatttattttgtaagacagagtctcactgtcacccagctggagtgcagtgccgcaacctcggctcactgcagcctctgcctcccaggttcaagcaattctcctgcctcagcctcctgagtagctgggactataggcatgcgccaccacacccagctaatttttgtatttttagtagagacggggtttcaccaattggtcaggctggtcttgaactgctgaccttatgatctgcccgcctcagcctcccaaagtgctgggattaaaggcgtgcgtgcgccaccacatccagccaatttttgtatttttgatagagacggggttttgccgttgttagccaggctggtcttgaacccctgacctcaggtatctgcaagccttggcctcccaaagtgctgggattacaggtataagccaccatgcccagccaataaaattgtattttaaatgcaccaagtacctgcgtcaacaatccaaaaatgatattaagaaaacaattctgcttaaaatagcataaaaaaatacttaaaagaagtgaacaatttatttatttattttgagatggagttttgctcctgctgcccaggctggagtgcagtggcacaatcttggctcactgcaacctccgcctcccgggttcaagcgattctcctgcctcagcctcctgagtaacagagattacaggcacatgccaccatgcccggctaatttttgtatttttagtagaaatggggtttcataatgttggtcaggctagtctcaaactcctgacctcaggtaatccacctgccttggcctcccaaagtgctgagataacaggcataagccaccgtgcccggctgaagtgaacaatttatactctgaaaaattaaaaaaaaaaaattcctgaaagaaattaaggaagatttaaataaatggaaagacatttaagttcatggatcagaagatttaacattgctaagatggcaatgcttcccaaactgatctacagattcaggcacagtggctcactcctgtaatcccaacactttggtaggccaaactgggcattattacttgagcccaggagttcaagaccagcctgggcaacatggcaaaaccccatctcagtctgggtgatgcggtgcgaccctgtgtccaaaaaaatacatgaaaatcacaccaagcttctttgtagaaattgacaatcaatcctaaaattcatatggaaattcaagggacccagaatagctaaaacaaccctgaaataaaaacaaggttgacggacacatactttccactttcataacatactacagaaagctataatagtcaagacaatgtggtactagtataagcacagacaaagtcctgggagggtagcacacccgaattccaccaggagagatgctcctgctctcaggacctttccagaccttgtcttatatatctcttcagctggctatttatgtgtatcctttaaaatatcctttgtaataaactggtaaacatgtgttttcgagttgtgcgagctgctctagcaagttaagcccatggctataaatgggaacaccaatttatagccagtcagtcagaagcacaggtaaaataagcgggagcttacaactggcatgtgaagtgtggggagaggcagtcttggaaactgagccctcaacctgtggaatcttgatgctatctccaggttgattatgtcagaattgagtggctgtcagctgcagaaatgactgcttgcttgcctgctggtggggagaaatccccacacatctgctttcagtagggtgctataagaatatcagcagtaggagaaacggagtttgttttttccacacacacctgtatctaaaataccaaaaactctggcaacttaataataaaaaggcaaattaatttaaaaatgaacaaagaatctgtacatttctccaaagataatatacaaatggccaataaacacattagtcaccagaaaaatgaaagtcaaaaccacaatgagatcctacacccagtagcatgactaaaataaaaaaaaacaggtaatgaatggcaagtgttttagatgtggcaagaactggaaccctcatatactgctaatgagaacataaaatggtgcagccaccttgaaaaagtctgggagctcctcaaaagattaaacagagttaccatatgaaagcagaaataacccaaatgttcctcaacaaataaatgataaataaaatgaggtacatacatacaatggaatattattcagccataaaagggaataaagtcctaatacatgctacaagatgggtgaaccctgaaaacatcacaaaagaccacctactatattaatctgtgtatataaaatatccagagtaggtaaatttatacagaaagtagattcatggttgcctggggcttggggtttattgtattagggagtgataaagaacatgggatttcttttgggggtcatgaaaatgttctagactttactgcactaatggtgcacatgtctgtgaatataccaaaaaacaatgaattgtacattttatttatttatttattttttgtgatggagtcttgctctgtcacccaggctggagtacaatggcatgatcttggctcactgcaacctccgcctcctgagttcaagcgattcttgtgcctcagcctcccaagtagccgggattacaggcacgtgtcgccatgcccggctaatttttgtatgtttagtagagacggggttttgccatgttggtcaggctggtctcgaactcctggcctcaagtgatctacctgcctcggccttccaaagtgctgtgattacaggcatgagccactgtgcctggcctgaattctacactttaagtgggtgaatggtatggtatataaaatatatctcaacaaaactgttaccaaaaagagagataacaccaaacacatgaaacttccttcctatgagattattcttaatactagctttaaggatatttcctttttgcattacttttagaatattttctacaaatattattttcagtcagtccaagttttttaaaagcaaaacttgtcaaaggaaacatactttgttagagatgcatatacaaactctgcaaagaaaaggctagttagggggtacccctaaaaactaagaagaaaaattaaactttccacagtttacaaacaggcagctttcattttacacaatagtgcaaaaccgtaaaagtaagaatgcacgctgaaaccatgcaaagtgatcataataattaatgagaaaaactgcaattgctctgtaatctttttttttttaaaattgagacggagtctcgctctgtgtccagtctagggtgcagtggcgcgaccttggctcactgcaatctccacttcctggggtcaagcgattctcctgcctcagcctcctgagtagctgggactacaggcacgtgccaccacacccagctaatgtttgtatttttagtagagatggggtttcaccatgttggccaggatggtctcgatctcctgacctcgtgatctgcccacctaagcctcccaaagtgctgggagtacaggcgtgagccactgcacccagccgctctgtaatttttttttgtttttgttttttgagacagtctcactctgttgcccaggctggagtgcagtggcgcaatctcggttcactgtaagctccacctcccaggttcatgccattctcctgcctcagcctcccgagtagctgggactacaggcacccgccaccacgcccggctaatttttttgtatttttagtagagacggggtttcaccatgttagccaggatggtctcgatctcctgacctcgtgatccacccgcatcagcctcccaaagtgctgggattacaggcgtaagccacagtgcccggccgccactctgtaatttttaaaaaattttgggccaggcacagtggctcatgcctgtaatcccagcactgggaggccgaggtgggcagatcacttgaggtcaggagttcgagaccaccctggccaacatggcgaaacctcatgtctactaaaaatacaaaaattagccaggggtagtggcacacgcctgtaatcccagctacttgggaggctgaggcaggagaattgtttgaacctaggacgggttcactacagaggttgcgtgagctgagactgcaccactgtactccagcctaagtgacacagtgagactccatctcaaaaaataatttaaaaaataaaataaatattacccaggggtggtggtgagcacctgtaatcccagctactcgggaggctgaggcaggagaattgcttgaatccaggaggtagaggttgcagtgagccgagatcacactactgcactccagcctgggcaacagagcaagatcctatctcaaaaaaaagaattttttttttgttgaggccaggcacagtgtctcacacctgagatcccagcactttgggaagctgaggcaggcaaatcacctgaggtcaggagttcaagaccagcctggacaacatggtgaaaacccatctctactaaaaatacaaaaaattagtcaggcatggtggtgcatgcctataatcccagctgctagggagcctgaggcaggagaatcgcttgaacccaggaggcggaggttgcagtgagccgagatcgcaccactgtgttccagcctgggtgacaagagtgagactcagtctcaaaaaaaaaaaaaaaaaaaatttcattgaaacattaaaaactctgtcagttataattataggaaaattgaaagaacaggaaaactaatcattaatgcactaaagcaggaggtgagcgaagggcaggcgagcatctctgcctcctgtcacatcagtcgtggcattagattctcataagagcacaaaccctactgtgaactgtgcatgcgagggctctagactgtgcactctttatgagaatccaatgcctgatgatcttctgaggtggaagagttttatcccgaaaacatcccctcccccagcgtccccttccatggaaaaactgtcttccactaaatcagtgctaaaaaggttgaggaccactgcactagagaacatagaaatattgaaaattataatgtttaagttctttgaaaaaatttattaggggtagtttaaatagtgcttacattcttctcatcatacaatagagacggggtttcaccctgttagccaggatggtctcgatctcctgaccttgtgatccgcctgcctcggcctcccaaagtgctgggattacaggcgtaagccaccgcgcccggctgcaatagacatcttttctatgccttagccaattgtcacactcctgtctgagtctggaatagcatcaaatactttatgtttcatatttcaatatcacagaataccttcgagagttctttcactacaaaatttcttgcatcacttcttttttttttttttttttttaccaaaccactttcttcacttatgtagataagctcaccttcactaagttatttcggctacatatccagagtgttttgaatgagagcatcagcattccctcagtgatctatttcttctataactccatttgagttcaatttgaatttcacttccactgttgttactttttggttttttcctgaactttcatctttttcggccaattctctctatcggttatcgatttttcttaactatcacatagatttatcactgggagacaaggaggtaacacaaacccatgctttgcacagttgttacttatgtagtgacagaagagctggcagcgaattttgtactttatacgattattcacagttaatatgctgtgtaaaatttaaaccatgttattagggaattggtattatttaaccaaaccatggtaagtgaaagtgtatatgagaaccacataaagcaacaactccctgtatatcacatcacaaaatcacagaacttaaaagccttcttcacagtaatctagccacagtgtgtatgtggacccttgatgtagtattaatgacccgtctacttcctgcctgaccatttcaagtgatgcccacattacttcacagggtggctctttcattgttgaacacttctaacagttagaaaaataaagcccccagctagtataatggtcaaaagcacaggttctaaaatcagaccacctgaattcctatcctttcttttcctctgttgagctaggtaaatttgggcaaggtatgtaatctctccatgactgtttactcatctataaaataaaaatgttagccgggcgcggtggctcacgcctgtaatcccagcactttgggaggctgaggcgggtggatcacgaggtcaggagatcgagaccatcctggttaacacggttaaaccccgtctctactaaaaatacaaaaaatgagccgggcgtggtggcaggcgcctgtagtcccagctactcgggaggctgaggcaggagaatggcgtgaacccaggaggcggagcttgcagtaagccgagaccacaccactgcactccagcctgggcaacagagtgagactccgtctcaaaaataaataaataaataaataaataaataaataaataaaaatgttaaggccttcaatcatgaagttgttatgagggatggcaagtgttcagtaaattataacctatataatttatcatattatcatcatcgtctgtagagtgcttagtcttccttatccatccccatgtactttggttcaaacccctcacctagattctgcactagactcaactgaacactgacagtctctcacccagttctccatatggtcaccagaattatctctctaaaaataaaatctgactccggtcagcataaacaatttagcctaaagccatcaggtagggtagagcaagcagagcaaaatcagagtcttcgtttaggggtggggaggaagccatggtggctgaaagcagggtatcaaataccaagcaaagtggggagggaattcatgtggtaaggtggcctggcccaacataacttataaggagtcaaaagacggctactattttaaaaagatgacatgaaacctacaaattgaggaaacacaatagtccaagagggaaagaaaacccaacatctgtcaagtagacacaattacttactttaactccatgttttcttgtttccttgtaaacacatgggtgttttggtgttcgttcattttgttattttcttagcactggttttcacaaaattcactttcggaataaaatttcatttggaatgatgtctctcttgaatttgtcaacaaaaggaaactcctagtgatgcctcatcatcagctacacaaatatttggtatttgaaaaaatgctggttctttaaaaaacacatttgtggttctctatcacttaaaaaataaagagacagagagagatgtttggcacagtgacacacagcctatagttccatctacttggaaggctgagacagaaaggattgcttgagtccaggagttcaaggctgcaatgagctatgattatgcctgtgaacagccactgtactgggcaatgtatctagactcccatcttttaaaaagagagagagaaagagaaagtacaaaagagaaaagaaaatgacaagaacaaagaaaaaagcagacaatattaactgtgaatctaaaataggttgtagagctcctcctgatgctgtaacctgatcatggtgcacactgataagctcccattacaacataagaaagccacagacaatggagcaagtcatcaccttccttgtattacaatctcatgtccttgctttggatgctgtgcctcctaaccacacctagtaaaagtagcatcacttatttggcaacatctagtatttaagaaccaagtaaaggcctgaaaggaattaccaggcaagactggatggtactgtgcaaggaacacacactttatcatcaggtagatccagatctcaattatcttttttttttttttttttttttttttttgagacaaagtcttcactctgtcactcaggctagagtgcagtggcagcgccaaggctcactgcatcctcaacctccaggactcaagtgatctcccacctcagcctccagagtagctgagaccacaggtgcatgccgccacactgggctaattttttaaatttttttgtagagacaggatctcactatgttgcccaggctggtctcaaacattatgacactgatacataactgttaactagactacagaccttattcagttttcactattttttttaacctgcatttgtgtgtgtatttctaagcagttttgtctcatgtatagatttttataaccacaactgcaatcaagatacagaactgttctgctacctctctgtatttatagcccctccacctactacccccctgtcccctggcaatcactaatctattcttcatctttacagttttgtcactttgagaatgtcatataaatggaactatataatatgtgacctcttgagataagcttttccactaagcacattacccttgtagtctattcaaggtgttgcaggttatctatagcttgcttgttccttttgattactcagtagtattccatgctatggatgtcatatgttttgctttacacttgttgacacaacatttggattggttcacattttgctgttttgaataagtctgctatgaacagttacgtacaagtttttaagtgaacataaattttattttatttggagtaaataaccaaaggagtgatttctgggtagtatggtaagtacatgtttaatttttaaagaaactgccagctggatccagcacctgtaatcctagcactttgggaggccaaggcaggaggatcgtttgagcctaggagtctgagaccagtctgagtaacataaccgtaccctgtctctacaaaaaatgcaaaaatcagccgggcatgatagtgcatacctatagacccagctacttgggaggatgaagtgggaagatcacttgagcccaggagttcaggttgcagtgagcaatgatggcaccactgcactccagccagggtaacagagtgagaccaggtctactaaaaaaattgactagtaaaaattaaattaaggccaggtgtggtggctcatgcctgtaatcccagcactttgggaggccaaggcaggcggatcgcgacgtcaggagtttgagaccagcctggccaacatagtgaaaccctgtctctactaaaaacacacacacaaaaaaatagctgggcatggtggcgcgtgcctgtagtcccagctactcgggaggctgaggtagtagaattgcttgaacccaggaggtggaggttgcagtgagccgagatcgcaccactgcactccagcttgggcaacagagtgagacttcgtctgggaaaaaaaataaattaattaaattaaattaaaaatttttggccgggtgcagtggcccatacctgtaatcccagcaatttgggaggccaaggcgggtggatcaccggaggtcaagagtttgagaccagcctggccaacatggtgaaaccccgtctctactaaaaatacaaaaagtagctgggcgtggtggcacacacctgtaatcccagctactcgggaggttgaggcaggagaatcgcttgaacccgggagccagagattgaagtgagccgagatgacactactgcactccagcctggcaaaagagcgagactccatctcaaaaaaaaaaaaaaaatagtaaagtcaaaaggcaaataacggagtagaagaaaatatttgtgttacatgtactacacaatggattaatttttataatatactaagtgctctcacaaacaaacagaacaactatcaacaacccaacagaaaaatgagtccaggacacaaactcttcatagaaatccaaataataaatgtgaaaaaaaaattcagcctctttcatctaaaaagaaatacaaattaaacaatgagatactatttttcatttctcagaaagattcggttttcatttaatattcctgtattatctgattttcttagtgttgtttcaatttatcataaacttaaaaaaaaaaaaaaactatagaggacgtgcgcggtggcccacaactgtaatcccaacactttgggaggctgaggcaggcggatcacaggtcaagagatcgagaccatcctggccaacatggtgaaatccatctctactgaaactacaaaacttagctgggcatggtggcgcatgcctgtaatcccagctactcgggaggctgaggcaagagaatcgcttgaacccaggaggcagaggttgcggtgagctgagatcgcgccattgcactccagcctgggcaacaagagtgaaactccatctcaaaaaaaaaaaaaaggcagaaagccaaaactattctaaaagatttttctttaatccctcatatatcgcggtacaaaaattgacaaacagagaaaagaatggaagaatgagggaagggaacacaaacatcttggattcacagtctatgcaaatgctaatcaaatcacctttgaaaaccattcaatttccacacacacacacacacacacacacacacacacacttaggctggctgtggtggctcatgcctgtaatcccagcactttgggaggccaaggtggatggatcatctgaggtcaggagttcaagaccagcctgggcaacatggcaaaaccccgtctctactaaaaatacaaaaattagctgggtgtggtggtgtgcacctgtaatcccagctaccaggaggctgaggcaggagaactgcttgaacccgggaggcagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattgattttggcaagataggaggattaaaagagggaatagtctatacagctatgtgaagtctaccaatctagatatccatcaattatgaaataactaagaatcattttagttcaaactaccaccacataatcatgttcattcaacaactacatcccaggctctagactagggttcatggctcccagcgaggacatcatactattccagactagactaaactgagtcccttaggtccctaagactcttttttctatcatctgtataaccccaatacatttaacaattttacataaattataaatcgaccatgtaagataatatcctactgccaatgtgagggctaaaaatttgatcttgcaatttgtttagtctaactctcttccagagtttcttaacaccttcactactgaaattttggacaagaaaattgttatgagaggttgtcctctaaactggaagatgtttaatagcatgccaatagcaccttcccagttgtgacccatgagaatgtttccagacactgtcaaatgtcccctaaagggcaaaatcacaactctacccctacgccaactgagagccatacaccataaaaatctaggagttgtgagtgcagggaaatggaaggattaggtggaagagtagctaaggagaacagggtgggtttttttgtttttgttttttgagacagagtctcgctctgtcgcccaggctggagtgcggtggcgcgatcttggctcactgcaacctccacgtcctggttcaagctattctcgtgcctcagcctcccgagtagctgggattataggcgtgcactatcacacccagctaactttttgtattcttaggaaagacagggtttcgctatatcggtcgggctggtcttgaactcctggcctcaagtgatctacccgcctcagcatcccaaagtgctgggattactggtgtgagccaccgcgtcctgcctgagtaatgaaaatgttctaaaactgattgtggtaatggatgcacaactgtgaaaatactgaaaaccactgaactgtacattttaagtggctgaactgtatgttttataaattgtatctcaatagagctattctttttaaaattcagattctggactccactccagatctcataaattagaatcaaaagcagaaagccaaaactattctaaaataccttccaggatcactaggaggacatttggggttcacagccagacagtgatgaacatctcaaaccacaagatgcacagaacggctaagaggaaaatgagcttgctgtgcactacccaatggttaactgcttggaaaaatatggaaactgataacgtgttaaatatgttcaataacacatctcaaatttatgtctaagaacacatttcaatttcaactccatgttaagttgaaaggatagcttcccaaattatgacatatgtaccttcacctttaaagaaacagaaactaaaacaactccaaatattatatgcttttacatctacattcattcattaagtggttttataattactggttttgagttatactgcagctactcacatcataagaaaaagacaacataaagtacaagaataaacttgagtataatttttaattagacctgatgcatcaatctgaatagctaataccaaaaatcctaagctatgaaatctaaatttcccaataaatctgaacatctgcaagtataccacatagcaattagaaaaaactgtactatggaaaagatttaagtcgttctggtttctgttttgcaagttccagcagaaaactaatgctagggttcattgaaacaacactgctagtatctcctatttcctccaagaacaaacaagaaagccattattatctcaaatgttcttctgaaaagtataatgacccttcttataatattatggaaaatatgaacaagaattttaatcaaaatagcattcgtaaagccacatgaacacttttattttttttatttttaaactttaaaatctaaatacctacccaaatacccagtgtttctaaaactaatgactaaatctgatttacttctaactctctctagtatataagtgatgtctgaactatgagattcatgtgaaaatgtacgtcgtttatttgtacatgatctgtctctcaggcactcgacctaggggagtaacacatattgatgatctccagaatgtgcacattacaacctgattgataccaaattggtgctatattcatgcatttattaacaaggaatgatgcttatatcgagcaaaaagttcatgagtagtatatatagttcttattttcacaagaaaaatatgtatatatattcacaggaaatgtctagaagaatatatatgaaaatgttattctcttttataatttttgtgtttctaaattatctacattaaataaaacttttgcaaaaagaaaaaataaatgtcattttaaaaacatacccagccaggcatggtggctcacacctgtgatcccaaaactttggaaggccgaggcaggcagatcatgaggttaagagaccaagaccatcctggccaacatggtgaaaccccatctctactaaaaatacaaaaattaggtgtggtggcacgcacctgtagtctcagcaagtcaggaggctgaggaaggagaatcacttgaacccaggaggcggagatcgcagtgagccgagatcgcgccattgcactccagcctggcgagagagcaagactctacctcaaaaaacaaaaaaaacaaaaaacaaaaacaaaaaatcagctggagcaggccaggcacggtggctcacgcctgtaatcccactttgggaggccaaggtgggtggatcatgaggtcagaagttcaagaccagcctggccaacatagtgaaaccccgtctctaccaaaaatacaataaagtagctaggattacaggtgtggtggcgggcgcctgtaatcctagctactcaggaggctgaggcaggagaatcacttgaactcgagaggcagaggttgcagtgagccgagatcatgccactgcacgccaacctgggcgacagtgtaagactccatctcaaaaaaaaaaaaaaaaaaaaaaaaaaaaattagctggccatggtggcgggctcctgtaatcccagctactcaggaggctgagacacgagaatcacttgaaacctgaaagcagaggttgcagtgagccaagatcataccactgcactccagcctgggcgacaaagcaagactctgtctccaaaaaaaaaaaagaaaagaaaagccccaacaaaagtcagtcttctttagctaaaagaccaagaaagtagcagtctagcaagacagaaaagttttagacaataaccaatctaccccagccaaacaccaagaaaatactgtggtttaaaacctacccgttctagcaaaggccaagtggggagcctagatttccaacctctcaaagctgtaattaagcactcaataccccttccaaggtggagacagaaagccaagtagggtatccaggaatttcatccctgcagaccagtaacaagatcagcggggaccacgtggggaacctgggcctccaccatattatatcaatacaaatggcagtttctttaaaaagtctccctctccctctccctctccgtctccgtctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcccgcgccgccacgcctgattggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatagtctgagacgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcgtctccgcccggcagccaccccgtccgggagggaggtgggggggggtcagccccccgcccggccagccgccccatccgggagggaggtggggggtcagcccccccgccccgccagccatgccgtccgggagggaggtgggggggtcagccccccgcctggccagccgtgccgtccgggagggaggtgggggggtcagccccccgcccggccagccgccccgtccgggaggtgaggggcgcctctgcccggccgcccctactgggaagtgaggagcccctcagcccggccagccaccccgtccgggagggagatgggggggtcagcccccccacccggccagccgccccgtccgggagggaggtgggggggtcagccccccgcctggccagccgccccgtccgggagggaggtggggggggtcagccctccccccggccagccgccccgtctgggaggtgaggggcgcctctgcccggccgcccctactgggaagtgaggagcccctcagccccgccagccgccccatccgggagggaggtgggggggtcagccccccgcccggccagccgccctgtctgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgacccgtccgggagggaggtggggggggggtcagcccccctgcccggccagccaccccgtccgggaggtgaggggcgcctctgcccggccagccgccccgtccgggagggaggtggggggttcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccaccaccccgtctgggaggtgtgcccactagctcattgagaacgggccaggatgacaatggcggctttgtggaatagaaaggcgggaaaggtggggaaaagattgagagatcggatggttgccgtgtctgtgtggaaggaagtagacatgggagacttttcattttgttctgcactaagaaaaattcctctgccttgggatcctgttgatctgtgaccttacccccaaccctgtgctctctgaaacatgtgctgtgtccactcagagttaaatggattaagggcggtgcaagatgtgctttgttaaacagatgcttgaaggcagcatgctcgttaagagtcatcaccaatccctaatctcaagtaaccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaataaataaataaataaaaaagaaaaaaaagaaaaaaaaaaaaaagtaagcatgcgactaccatatggcctagcaactgtactcctaggcaaactgccgaactatttttcagagtggctgtaccactttactgttaactgtttcaatgtcaataccctggttgtgatattgtaccatgattctgcaagaaatttccaccaggggaaactgggtaaagtgtacaagggatatctctgtattattgtttcttacaattgaatgtaaatctataattatctcaaaattattttaaaaaactgtgtttaaaaactaaattaaaaaacacaaatatactaaatatttagacttaaggctgaactatgagttacatatccttatatcccaagcacctacaccaaagcctagaacatattagacaataaatatttattgaattagattgaacatacaatcagcacttcaaaaatataagatgcttacaaacctaacagttccatttcgttggctgtaaataaagtaacaataccttaaaacaagtgcaaaaaagttaccttcaagaaaatataaagtattctggaattttttcaaagagaaaaatgactcagtcctagactacaatgacttagatattacctcattattttggctaatttattgtacggagagagggagggaggccagtaggccggctggccagcctgcgaggcttaaaaagtaccatgtacataatttaaaaattagcatatagtagggagtctttagaaaccaagtagcacacataaatactacacatacccacccacttgcaaaggtgttttaagccaaaaatcttactctacgtgtccaagtttcatcggtatttctgattttcactaggtctggctgaacaggattatgtcttatcttttagagtaactatcagaactggtgattatctccatcatctatgaacacagtccttttcatctgataaaactggcattcggtaacaagaaagcatcttattttaccagaatgacccaagtaattcattaattaaagaaaaaaatgtatacaggaatctttattgttgctttggtttgttggttttctaaaaccaataaaacaattgtcttttcctgcataaacacctgatttgaaaatctagatacaatattattttattttattttatttatttttgagatgaggtcttgctctgtcgcccaggctggagtgcaatggcactatctcggctcactgcaacctccacctcctgggttcaagtgattctccctgcctcagcctccgagtagctgagattacaggcgtgcaccaccacgcccggctaatttttgtatttttagtagagatgggtttcatcatgtgggccaggctgctcttgaactcctgacctcaggtgatctgccctccttggcctcccaaagtgctgagattacaggtgtgagccaccgtgcccggcattacaacattattttaaacagccttcatcattaagtaatgaaagtgaaagtagagtcagcagtcagtaaaaacactttgtgattgaataattcaagtacagaattaacagccaaaactacatgaactgaacagataatgataaaaacccaatcagggccaggcacagtggctcacaccttaatcccaacactttgggaggccaaggtggggagattgcctgagctcagtggttcgagaccaccctgggcaacatggtgaaaccccgtttctactaaaatacaaaaaattagccaggcatggtggcgtgcgcctgtagtcccagctacctgggaggctgaggcatgagaatcacttgagcctgggaggtggaggttacagtgagccgagatcgtgccactgcactccagcttgggcaacagagcaagactccatctcaaaaaaaaaaaaaaaaaaaaaaaaaagacctactcaggatagcaacattacaataatggcaagccatacttattttgatcctttatggtccatatgaacacatgaaatcttaattatttgagaattcaacaacttttgggctgggtgcagtggctcacacctgtaatcctagcattttgggaggctgaagcgggtggctcacgcctgtaatcctagcactttgggatgctgaggcaggcggattgcctgagctcgggagttcgagaccaccctgggggcaacatggtgaaaccccatctctactaaaatacaaaaaattagccggcttggtggtacacacctgtaatcccagcaactcaggaggctgaggcaggagaattgcttgaacctggaggatgcagtgggctgagattgtgccactgcactctggcctgggccacagagtgagactctgtctcaaaaaaaaaaaaaaacttttgaacatctctctcttaaacctctggcctttaaaatcccaatcatatcacatttaatatacatgggttattaaatgggttcaggaattgttagtctgcagtagaactctgcaacaaacaataaacagtttcatcaccaaaaggtacctggatgtaatctcaattagtaaaaactcagtcactcatatgtcactgacatatttcctttggacaaggcaactcattctgttgatctttctcagccactatgaagtttatcactcatgcctgtaaatggtacatggtcatgaactgctacagaataaagtccaagagaacccaccaaaactgtggaagattaaaagattgatggatcattaaaaaaaaatggattatagacctaaatgtaagatacgaaactataaaactcctagaggataacatagaagaaaatctaggtgacctagggtttggcaatgacttcttagatacaaccccaaaaacatgatgtaggaaagaaaaaactgataagctggactttactgaagttaaaaattctgatctgcaaaatacactgctaagagaatagaaactcaacagattgggagaaaatatttgcaaaacacatctctgacaaagaactggtatccaaaatatacagaggccaggcgcagtggctcacgcctataatcccagcactttgggaggccgagggagatggatcacaggagcccaggagttcaagaccagcctgggcaacgtgtcgaaaccctgtctctacaaaaaaaaaaataataataatacaaaaaaaatgtagccagtcttacaacccaatctcaaaataaataaaaaattaaaaacgaaacaaaatatacaaataactttttttatttttgagacggagtctcactgtcgcccaggctggaggacagtggtgcgatctcggctcactgcaagctccgtctcccaagtacacgccattctcctgcctcagcctcccaagtagctgggactacaggtacccgccaccacgcccggctaatttttttgtatttttagtagagatggggttttaccacattagccaggatggtttcaatctcctgacctcgtaatccacccacctcggccttccaaagtgctgggattacaggcgtgagccaccgcgcctggacccaaagagctcttaaaatttaatatgaaaatgaacacctccccctccccctccccctctccctctccctctctttccacggtctccctctgatgccgagccgaagctggactgtactgctgccatctctgctcactgcaacctccctgcctgattctcctccctcagcctgccgagtgcctgcgattgcaggcacgcgccgccacgcctgaccggttttcgtatttttttggtggagacggggtttcgcctgttggccgggctggtctccagctcctaactgcgagtgatctgccagcctaggcctcctgaggtgccgggattgcagatggagtctcgttcactcagtgctcaatgttgcccaggctggagtgcagtggcgtgatctcagctagctacaacctccacctcccagccgcctgccttggcctcccaaagtgccaagattgcagcctctgcccggccgccaccccgtctgggaagtgaggagcgtctctgcctggccgcccatcgtctgggatgtgaggagcccctctgcccggcagccgccccgtctgggaagtgaggagcgtctccacccggcagccgcccagtccgggaggtggggggcagcccccgcccggccagccgccccgtccgggagggaggtggggggcagcccccacccggccagccgccccatccgggagggaggtggggggcagcccccgcccggccagccaccccgtccgggaggtggggggcgcctccgcccggccgccaccccgtccgggaggtggggggcacctctgcccagccgccccttctgggaagtgaggagcccctctgcctgaccgccaccccgtctgggaggtgtacccaacagctcactgggaacgggccatgatgaggatggcggttttgtcgagtagaaaggggggaaatgtggggagaagatggagaaatcagattgttgctgtgtctgtgtggagagaagtgggcataggagactccattttgttctgtactaagaaaaattcttctgccttgggatgctgttgatctatgaccttacccccaacccggtgctctctgaaacatgtgctgtgtccactcagggttaaatggattaagggcggagcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccttctgcgagaaacacccaagaatgatcaataaaaaaaaaaaaaaaaaaaaaaacatcactatgtaccccatgactatgtacaattgttatctgtcaattaaaaataaaataatgtttaaaaaataaaaaaatttaaaaaattaaaaataaattaaaaaaaagaaaatgaacaatgtggctgggcgtggtggttcacgcctgtaatcccagcactttgggaggctgaggcgggcagatcacctgaggttgggagttcgagaccagcctgaccaacatgaagaaaccccatctctactaaaaatacaaaaaattagccaggcgtggtggcacatgcctgtaatcccagctactcgggaggctgaggaaggagaatcacttgaacctgggaggcgggaggttgttgtgagccaagatcgtgccattgcactccagcctaggcaacaagagtgaaactctgtctcaaaaaaaaaaaaaagaaagaaaatgaacaaccccattttaaaaataggcaaaagatctgaacagacacttcaccaacgatatacgaatggcaaataagcatatgaacgaaaagatgttcaataacatatgtcatcagagaattgccaattaagacaacaataattctgacaaccgtggttaaaagaaattattaataagaaaaaaagacttcaaattcattaaaaaaaaaaaagacaacaatgagatgccaccgtgtccgtatcagaatggccaaaatccaaagcacaacaccaagtgctgacaaggatgtcaaacaataggaaatctcattcattgctagtggaaatgcaaaatggtacagccagcaaggtgagctggaatcacctatagtcccagctactcaggacgctaagccaagaggattgcttgagcccaggagatgagtctagcctgaacaacatagcgagacctgtgtcttaaaaaaaaaaaaaaaaagttatacccagtttgggaggttcttacaatactaaacatactctctcaccacacaatccagcaattgcactccttgatatttacccaaagatgaaaactcatgtcaacacaaaaacctacatgtggacatttatagtagctttattcacaattgccaaaacttggaaccaactaggatgcctttaataggtgaatggataagcaaattgtagtgtacccagacaatggaatactattcagcaataaaaagaaatgagccatcaagccacaaaaagacattgagaaacctcaaatgcatattgctaggtgaaaaaaaagccaatctgaaaggctatatactgtataattctaactatacgacattgtgaaaaaggcaaaactatgaagacagaaagatattagtggttacagtagttaaggggaagaagtagggataaataggtggagtacaggggatttttagggcagtgaaactattccatatacatattattatgaaaccatctttgcaaaaattataactgagacaattattacagtgaaagagatctgatctaaccaactccatcctgcttctaacctcccagctgtccttgttcattcctagacttagcccaaactaactttgtttgggaggaacttagtttacagtttaggttagttttcccagaacaaacccccttcctggctggggactagactgcctttgcaggactaacaaattctaacaagattagaaatcatggtttaggagtcatgcagctagaggctgcaagattctaaacctccctaaattactcctggggataacatcattattgtaaaacccaagatcgtgtttgagatattttgcagaccctatattcaatggattagctggcaccacccagactgatataaactggcctatcttgtcttgtggcccccacccaggaactgactcagcacaagaggacagcttcaactacctatgatttcatctccaacccaatcaatcagaactcctgactcactggtcccctacccacaaaattatcctttaaaactccaattcacaaattctcggacagactgatttaagtaataataaaactctggtctcccacacagtcagttctgcttgaattactctttctctactgtaattcccatcttgataaataggttctgttgagccagcgggcaaggtgaccccgttgggtggttacaattagacagtcatgcatcacttaacaatgggaatacattctaagaaatgtgttaggtgacttcatcattgtgcaactgtcatagagtgtactaaacaaacctagatggtacagcctgctacacatctaggctatatggtataatctgttgctcctaggctacaaacctgtacagcatgtaactactgaatactgcaggcagttgtaacacaatggtaagcatctgtgtatctaaacatatctaaaaacagaaaaactaaggtgttatgccaagcattacatcactaggcaatgaaaaattttcagctccactatatagaaagtacccatctctacaaaaaaagaaaaaaaattgccagccttggtagtgtgcacgtgtagtcccatctactgtggaggctgaggcaggaggactgcttgaacccagaagttccaggctgcagtgagttatgatcgtgccactgcactccaacttgggtaacaaagcaagacactgtctcttaaaaaaaagaaaagtctattaattttaaaaaagaacctctgcacaatggaatgatcttcattctttatatactactgtaccacctcataaccatgactaacattactaataccactcacatctcaaacatagcaatctaactccttacaacttaaagtgtcatctgtagaccaacaggattagcatcaccttatagatcagaaatgcaaaatcttgggtcccacactaaaccttcagaatcagaatctgccttataaaaagatcatgtgatttgtatgcacactaaaatctatgaaggcctaatccaaagctttcaattcaaaggccacacaaggcaagggggacagaaatcaaggccctgggccctcccaaagttaagccttataagacaccccaccatatacctctccaatctaaaccaagccccaaatttttcactatccctagcggactatatagaagcctgccttggtgttgagcaaatcaaaagaataaaaaattcctgagaaatcatagccacgaggaatccctgtatgcactggcatcttagtttcttataatctggataagccaatgactgtcaagtcatgcagtttgaggaaataaaaaactagtgatgccacagagtacctgacagatattaacaccaaggctaacttctcaagcaacaatgtaagccagaagataatggaatgataagttcaaggctggacagggtggctcacacctgtaattccagcactttggaaggctgaggtgggaggattgcttgagtccaggagtttgagacaagcatgggcaacatagtaagaccccatctctacaaaaacaacaaaaaaagaaacgataaattcaataaactgaaagaaaataaaatgcaatactaataaacatacaaacaaacatacaatactatgccccccaaaaaagtagttttcaaggatgaaagaaaatatatacctatatagtatatccgtagaagttttctggggacagggtctttgctgttggttagattctcaaggggatatatactcatgaaattaagaaccatttatttacaaaaacattaaaggtcattcaacttaacttcctccccagtatctctaaataccctggctctgttttaacataagttaaactcagtatcttactttaacatgaggaaactcactatcttataagaaagttacattccatttttctctttaacttctacttgatggtccttgttcttttgtcaaagcaacaaaatactaaatctaatgcctattccacttgccagatctttgatatatagttagccctccaaagccacaggttccacatccttggattcagccatcacatatatatattttttattttattttattttttgagacacagtttcactctgcctcccaggctggagtgcagaggcgcaatctccgctcactgcaacctctgctacccgggttcaagtgattctcgtgcctgaacctcctaagtagctgggattacaggcgtgcgccaagtatatcgcaggacatgcagaggtacatcattttatatatgggaccttatcatcctcagattttcttatctgcaggaggtctgagaaccaatctcccatgaataccgagggacaactgtatttgaaaatagctgtccccacctctttattctctaaatgaaacatctctaattccttttttttttttttttttttttttttttttttttttgagacggagtctcgctctgtcgcccaggctggagagcagtggtacgatctcggctcactgcaagctccgcctcccaggttcacaccattctcctgcctcagcctcctgagcagctgggaccacaagcgcccatcaccacgcccggctaattttttgtattttcagtagagatggggtttcaccatgctagccaggatggtctcgatcttctgacctggtaatccgcccaccttagcctcccaaagtgctgagatcacaagcgtgagccaccgcgcccagcctctaattccttaaataatgtctcaaatcattttaattactccatcaccagacagactgttttctcctggaaagactctatccatgctccgaaaatgtgcctcttaaaactgaacactctcattttacagtagaggggaaaaaaaaacctcaacacaatactaaaggtctggaatattatgttcccctgtattttcatttatatttttaaattttttttggcgtgattgcgccaagctggattgcagtggtgcaatcatggcttactgcagcctctatctgctgggctcatgtaattctaccacctgagcctcccagagtagctaggactacaggcacaagccacagtgcacagctaatttttacatgttttgtagagacaggggtttcactttcttaggtttaaaaatatagaggcggtctgggcatttatgcttctgactacctgaataataccacctccccgttactgtctcaaagttaacaagagaaaccttttttttttttttttttaaatccccagacagagtctcactctgccacccaggctggagtgcggtggcacaatctcggctcactgcaacctctgcttcctgggttcaagcgattctcctgccttagcctcccgagtagctgggattataggcatgcaccaccatggccggctgatttctgtatttttagtagagatggggttttgccctgttggcaaggctggttttgaactcctggcctcaagcaatccacctgccttggcctcccaaagtgctgggattacaggcgtgagccactgcaactggcccagagaagcatttttttaaaaactattttaaataatatttaaggaccaggtgtgatggctcatacctgtaatcccagcactttgggaggctgaggtaggcagatcacttgagctcaggagttcaagactagcctggacaacatggtgaaaccccatctatacaaaaaatacaaaaattagccaggcatggtgccacacacctgtaatcccagctactcaggaggctgaggtgggaagatcatttgagcccaggaggcagaggctgcaatgagccaagatcgtgccactgcactccaacctgggtaacagagcaagattctgtctcaaaaaaaaaaaaaaaaaaaggaatatttaagtaataaacatccagctctactaattaaaaactaatgaaaattaactgaatccttggctgtgagtcaattcaacaaagcaccatgatctccttaaggcatttattttatttatttatattttagaggtaggatctcactatgttgtccaggttgtacttgaactccaaggctcaagtgattctcccgcctctgcttctcaagaagctgggactggccaggtgtggtggctcacgcctgtaatcccagcccttagggaggccaaggcgggcggatcacgaggagttccagaccagcccggccaacacggtgaaatcccatctctactaaaaatacaaaaaattagccaggtgtggtggcaggcgcctgtaatcccagctactcggaaggcagaggcaggagaatcgcttgaacccaggaagtggaggttgcagtgagccaagatcgcaccactgcactccagcctgggcaacagagcgtccgtctcaaagaagctgggactatgggtacagttcaccatgccaggctcctaagacattcatttaaatccacttagtcattcatacctatgcacaatatgtatagcatttacagtgtgtatcatgacacttttaataataaagtcagtgttttaaagtcagtgtgtattgtttcttctattttactttttaaaaaatcacctacagcacttaccacagtgtatgcacctagaaggtatataaatatccgtggtattaaattgaacacagtagaaagaatgctagagattaaagttcaaattctgactcagctacaacttagtaaatgaccttaggagaaggcagaattattctgggactcaaagtggttccagtaagtccatgagtttcatatttcacagccaatttgccatctatataacccaatgaaacttacagggaatgtaatttccattgaaaacatcaatgcttcaccaattccatatacacaaaaattattttctgatttgtatcactagacagtgtcttactagcattctgaaggtcacccatcccagtcacgaagcccttaattctcacaaccttgattttataaataaggaaacagatagactgatctgccccagacctcacagttattatgtggtacagatgaaacctgaaccttggtcttttgacactcagtccagtgctattactgccatactatagttgcctgtcactgataattgcaaagtttgttaatttgggcaagtctaccttagacttttagacaacacactgttgaaaggcaccccacctctggctgatgaaataggctgactggtttgcctctgaagcatctcagcaagtctcagctatactgagcacacaaagttattcagaatatctttcaaacatttttttgtccctattattgttatcttattttagcttgataaagaacaactgtctgggtagccactgacactcttaaaatatactcagcccaagagaacttgctaaaatggaacatactaaattggttgagtactaaagcaactggctatatcagagaacctcattatcggtgacccaaacttacctttaattatcagatatatgaccatgcaatactgatgttattgttttaagaaaatcagatgtgattaaaagtgtgagattatccctttttttaacctattaaactagcaatattagtgaaaaaaaattttttttctgagacagggtctcactccattacccaggctagaatgtagtggcacgatcatagctcactgtaacctcaaactcctgggctcaagtaagcctcctgccttagcctgctgagtagctgggactacagacaccaccatggctagataattttttttaactttttttttttcagagatggggtcttgctatgttggccaggatagtctcttttttctttttttttctccctcctcaggtgctacttaaccaggcttgttttgaactcctggcctcaagtgatcctcccacctcagcctcccaaagtgctgggattacaagtgtgagccaccatgcccaaccacggtttctttttatccttcttcttcttcacagagacctcttcttctaccactactacttttccttcttctccatcttcttcaattttaattttactcttggccttttttgctttctttgtggtaatttcatcttctttatctgttctgagttttttttaattttttactttttgtacaaatggggtctcactatgctgcttaggctggtcttgaactcctggcctcaagcaatcctcccatccttggtatccgaagtgctgggattccaggtgtaaaccactgtacctggccctattttgtgtttttgtagaacaggttggaagtgtggacccaccaatacattcttttaaaaaaatttttagtattttcttattaaaagggaactgtgggccaggtgtggtggctcacacctgtaatcccagcactttgggaggcagagacaggaggatcacttgaggccaggagttaagagaccagcctgggcaacatagtgagatctcgtctctacaggaaaaaaaaaaaaaaaagcaaaaacttagccaggtccaggtccatatggtggtgagcgcctgtagtcctatcaacttggtaggctaaggcaggaggatcactggagcctgggaggtcaaggctacagggagcagtgatcacaccactgcactccagcctgggtgacagagtgggaccttgtctcaaaaaaataaataaaatgaagtaaaaaggaactacccctttttgaagtacagtgtgcttttaaaaagcatttctccatgtctcgtaataaagggcagacaaaaatataacaaacaaatgggtcagatactgccctttaactgcaaatggtttgttacccccatgtctctgtaacttagtgaataagagggaaaggaaaataagtaagcttgagtttactcaagaagaaatctgagggccaggcacggtggctcacagctgtaatcccagaactctgggaggccaagatgggcagatcgctcgagctcaggagttcgagaccagcctgggcaacatagtgaaaccctgtctctacaaaaaaaataccaaaaaaaatcagccaggtgtggtggcacacgcctgcagtcccagatacccataaggctgaagttgggaggatcacctgaaaccagaaggtcaaggctgcaatgagccatgatgccaaaccacactccagagcctgggcaatggactgagacccatctcaagaaaaaaagaaaagagaaaaaatctgaacacagaattaacaatgaacatagccaatcattacgataaatacttctaaattcatgaaaaaagtagccgggtgcagtcgctcacacctgtaactccagcactttgggaggccaaggcaggtagatcactagaggtcaggagctcgagactggctgggctaatgtggtgaaaccccattagcagggtgtggtggtgcgtacctgtagtcccagatactcgggaggctaaagcaggagaattgcttgaacccaggaggcagaggttgcagcgagccaagatcgcgccacttcactccagcctaggcaacagagttagacttggtctcaaaaaaataaaaaataaaaataaataaattaatgaggccaggagcagtggctcacgtctgtaaccctagcattttgggaggcccaggcaggtggatcgcttgaggtcaggagttcgagaccagcctggctactaaaaacataaacattagccaggcatggtgacatgcgcctataatcccagctactcgggaggctgatgcaggagaatcacttgaacccaggaggcggaagttgcagtgagccaagatcatgtcacttcactccagcctgggatggaaactccatctcaaaaatactactactactactaataataaatttggccaggcacgctggctcatgcctgtaatcccagcactttgggaggccgaggtgggcggatcacttgaggtcaggcattcacaagaccagcctggccaacatggcaaaactgcgtctctacaaaaattacctgggtgtggcagcgtgtgcctgtagtcccagctacttgggagggtgagacaggagaatcacttgaacccaggaagcagaggctgcagtgagccaagaaggcgccactgcactccagcctgggcaacagagtgagactctgtcccaaaaaaataaattataaattcatgaaaaaactatttttttaatgaggccagaacacatttccctagggaaataatatataaaatcaaattaatgttcctattcttaaatgcctaactttatgatccttagtattctgagttccagaaacaaaggataattaggggcaaaaggtatagaagagcagagacaaacgtgagaattgcctttcctggacctcaggaagcattttataataggtaaaaatagttttacaatatcccacttcccttctgtgccattttccaagtcattagtggcattatgctccgctaagtcccactactgtagcacctgactgcagcatcaattgaacatacatttgccagtagagaaagagaaacaagaaatgaagtatggtctctgacttcaagggactctcaggccagtgacaagatatatttaattttaggccaagtgcagtggctcacgcctgtaatcccagcactttgggaggctgaagctggtggatcacttgaggtcaggagttggagacgagcctggccaacatggtgaaaccctgtctactaaaaatggtggcacatgcccgtaatcccacctactcaggaggctgaggcaggagaatcatttgaacctgggaagcagaggttacagtgagcagagattgtgccactgcactccagcctgggcaacagagaggctccatctcaaaaaataatcataattttaaaacaatatggaaatccaaaggaatacacacacacacacacacacacacacacacacacacacacacacacacacacaaattagcattagtaaacaagttcagccgggtgcggtggctcacacctgtaatcccagcacttagggaagctgaggcgggtgggatcacctgaggtcgggagtatgagatcagcctgaccaagatggagaaaccccgactctactaaaaatacaaaattagccaggcatggtggcacatgcctgtaatcacagctacttgggaggctgaggcaggagaatcgcttgaacccaggaggcggaggttgcggagagccgagatcgctccattgcactccagtttgggtgataaaagcaaaactccatttcaaaaaaaaaaaagaagaaaaaaaaagttcagcaaggccacagaataccagatctataaaaatcttttatttctctataccagcaatcaacaacacaaaatgaaataagaaaataattccattttcaatagcatcaaaaggaataaaatactaaggaataaatttaaagtaaaagacttgtacactaaaaactacaaaatagctggagaggatgtggagaaataggaactcttttacactgttggtgggactgtaaaactagttcaaccattgtggactacagtgtggcgattcctcaaggatctagaactagaaataccatttgacccagcgatcccattactgggcatatacccaaaagattataaatcatgtgtcttttaaagacacatgcacatgtatgtttactgcggcactattcacaatagcaaagacttggaaccaacccaaatgtccatcaatgatagactggactaagaaaatgtggcacatatacaccatggaacactatgcagccataaaaaaggatgagttcatgtcctttgtagggacatggatgaagctggaaaccatcattctgagcaaactatcacaaggacagaaaaccaaacaccgcatgttctcactcataggtgggaattgaacaatgagaacacctggacacagggtggggaacgtcacacactagggcctgtcatggggtggggggaggggggagggaaagcattaggagttatacctaatgtaaatgatgagttaatgggtgcagcacaccaacatggcacatgtatacatatgtaacaaacctgcacattgtgcccatgtaccctagaacttgtaagtataataataaaagaaaaaaaaactacaaaatacattatatatatatatacacacacttttttttttttttttttttttgagacagaggctcactctgttgcccatgctggattgcaatggcaggatcacagatcgacgtcctgggctgaagggatcctcccaccttatcctcaccctgatgagtagctaggattacaggggcaagccaccacatccagctaattgtgtgtgtgtgtgtgtgtgtgtgtgtgtgtgtgtgtgtgtgtgtgtgtgatatgtcggccagactggtctcgaactcctgggctcaagcaatcttctcacctcagcctcccaaagtgctgggattacaggtgtcagccaccaccacactcagcttaaaaaatattcttgaaagaaattaaagacataaacaaatggaaaggcatcccacgttcatgaagtggaagatctgacattgttaagatggcagcactctctaaattgatctacagatttaaggcattccctatcaaaattccaactgccttttctgcaaaagttgccaagttaatcctaaagctcaaatggaaatgccaaggatccagaatagccaaaacaatcttcaaaaaaacaaaattagaaaactcacacttcctaatttcaaaacatattacaaaagtacattaatcaagacagcatatttatgcagatagtagcagatagtagtaccacagggtgaaaatacaagaaagcaagcatgatggtactggcatagacgtacaccaatgcaatagaattgaaagtccaggccgggcacggtggctcacacctgtaatcccagaactttgggaggccgagtcaggcggatcacttgaggtcaggagttcaagacccgtctgaccaaaatggtgaaaccccgtctctaccaaaaatataaaaattagctgggtgtggtggtgcatgcctgtaatcccagctactcaagacgcagaggcaggagaattgcttgaacctggaaggcagagaggttacagtgagctgcgatcacgccactgcactccagcctgggcaacggagcaagactgtctcaaaaaaaaagaaagtccagaaataagcccacacctctgtggtcaattgactcaaaacatggatgctaagatgatacacaattcaatggaaaaagaagtcttttcaacaactggttcaaggacaactagatatccacacaccaaaaaaaacaaatgaaaaagattttgggccgggcgcagtggttcacgcctgtaatcccagcactttgggaggctaaagcaggtgaatcacccgaggtcaggagttcgagaccagcctggccaacatggtgaaaccccagtctctactaaaaatacaaaaattagctgggtgtggtagcgggcacctgtaatcccagctacttgggaggctgaggcaggagaatcgcttgaacccgggaggtggaggctgcagtgagccgagatcacgtcattgcacttcagcctgggcgacagagtgaaactccatctcaaaaaaaaaaaaaaaaaagaaacaaagaaaaagattttggattcctacctcacacatcatgtataaaaattaatttgaaattgataaaaaaaaaactaaatacaacagctaaaactataaaattatttaaagaaacataaattacacctataatcccagcattttgggaggcaaggaaagcggatcacttgagcccaggagttcgagatcagcctggacaacatagtaagaccacatctcagccgggcgcagtggctcacgcctgtaatcctagcactttgggagcccgaggtgggcagatcatgaggtcaggagatcaagaccattctggctaacatggtgaaacttcatctctactaaaaatacaaaaaaaaaaaattagccgggcatggtggtgggcacctgtagtcccagctacttgggaggctgaggcaggagaatggcatgaacccgggaggtggagcttacagtgagcagagatcgcaccactgcactccagcctgggtgacagaacgagactacatcttaaaaaaaaaaaaaaaaaggttaccaaaattagccaagcatcatggtgcacacctgtagtcctacctactcaggagactgaggtggaaggatagcttgagcctgagaggtggaggctgcagtgggcagatatcatgccactgcactccagcctggacaaaagacagagaccctgtctcggaaagaagaaagaacgaacgaacgaaagaacaaacgaatgaaaaaaacaaacaaaagagaaatctttatcaccttaaattaggcaatcgtttcttagatgtgacacctatagcacaagcaaccaagaaaaaactagataaactggacttcatcaaaatttaaaacttttgtgtttcaaaagatactatcagtcaggcatggtggctcacacctgtaatcccagcactttgggtggccaagcaagaggattgcttcagcccaggagttcactgggcaatataaggagaccccatctctaattaaaattgttttttttaattatccaggtgtggtggcacacacctacaatgccagctatccagaaggctgaggtggaagaatcacctgagccctggaggtcaaggctgcagtgaatcatgatcgcatcactgcactctagcctgagtgacagagcaagatcttgtctcaaaaaagaaaagaaagccaggcacggtggctcacgcctgtaatcccagcactttgggaggcggaggtgggcagatcacctgaggttgggagttcgagcccagcctcaccaacatggagaaaccccactctactaaaaatacaaaattagccgggcatggtggcacatgcctgtaatcccagctactcaggaggctgaggcaggagaatcgaatcacttgaacccgggaggcggaggttgccatgagctgagatcgtgccattgcactccagcctgggcaacaagaacgaaactcagtctcaaaaaaaaaaaaaagaaagaaagaaagagaagaaaaaaataattttctggttttaatttttttttttttatagagacagggtctcaccatattgcctgccccaggctggtcttgaattgctgggctcaagcagtccaccctcctcagcctcccaaaatgctaggattacaggcatgtgccaccacgcctggcgataaataattttttaaaaggttaaacataattaacacataaccaagcaattctccttctaggtatttagacaaaaataaatgtccatataaaagcatatcaatcttcacagagcattattcataatagctaaaaaatgcaacccaaatgttcatcaatggatgaatgcataaacaaaatgcattatatccatgtaatgtaatattattcagccataaaaatgaatgaaatgatacatgctacaacatggatgaacctaaaagcattatgctaaatgaaagaagccaaacacagaaaggccatttattgtatgattccattaatatggaatgtccagaacagacaggaagatgattagtggttgccagaggctgggtgaatgaagggaatggaagagactgctaacgggtatgaggtttcttttgggggtaatgaaaatgttctggacttagataatggtggtagttgcacaacattgtgaatacaccaaaaaccactgaattctatgattttgttttgttttgttttgacagggtcttgctctgtggcccaggctagagtgcacgatcatggctcactgcaatctcaaattctttggctcaagtgaatgatcctcccacctcagcctcccaagagtctgggactacaggtgtgcaccaccatgcctggctaattttttttttttttttttttttggtagagacagggttgccatgctatgttgcccatgctggtctcaaactcctgggctcaagcaatcctcccacctcagcctcccaaactgctgggattacaggcatgagctaccatgcctaccccaaattgtatgctttaaaatggtgagttttacgatatgtgaattatgtatcaacttttttaaatgtggaatgacatatgcccaaagatatacattggggaaaacatcaaagagtagggtagaaaggggccgtgaatgaccttctaaaggtgaaacttgagctgatatgtagagaactaagcctgtaaatctgccttatcccccactttctctgctcccaatccttcctaaactgagaaatcacttgtcacccaaagcaacacactcactacccaaattcaaattatttcaataaaaatatgttcttcccataagaaaatgactgagagctctccagagtcctactagtggatttctattcctaaaagagaaagtgggctaacccaagtgaattatatgctgagcatcccaaatccaaaaatctcaatcctgggctgggtgtagtggctcatgcatgaaatcctcagcatgttaggaggctgaggtgaaaagatcacttgagcctaggagtttgagaccagcctgggcaacatggtgaaacgctgtctctacaaacaatacaaaaattggctgggcatggtggcacgtgcctataattccagctactcaagaggctgaggcaggaggatcacctgagcccagaagttcaaggctgaagtgagctgtgattatgccactaaactctggcaacagagcgagaccctgtctcaaaaaacacacaaaaatccgaaatctgaaatgctccaaaatctaatactttttgatgtcaaaggaaatgctcactagagagcattttggaatatctgtatactacagatattccaaaatccaaaaaatccaaaatatgaacaattctggtctcatatttcaaataatggatactcaacctatatctgattaagaatttcaaggctggagctgggtgcagtggctcacgtctgtaatcccagcactttggcaggccaaggtgggcgcatcacttgaggtcaggagttcaagaccagcctggtcaatatggcaaaaccccatctctactaaaaatacaaaaattagctggggcctggtggtgtgcacctgtactcccaactacttgggaggctgaggcaggaggatcgcctgaacccaggaggcagaggttgcagtgagccgagatcacaccactgcattccagcctgggtgacacagcaagactccatcttaaaaagaaaaaaaaagccgggtgcggtggctcacacctgtaatcccagcactttgggaggccaaggcgggcggatcaagaggtcaggagatcgagagcatcctggctaacaaagtgaaacaccgtctctactaataatacaaaaaattagctgggcacggtggcaggtacttgtagtcccagctactcgggaggctgaggcaggagcatggcgtgaacccgggaggcggagcttgcagtgagccgagatagtgccactacactccggcctgggcaaaagagtgagactccgtctcaaaaaaaaaaaaaaatctataaataaatttgttgtaactttgtcttctgacaataataaaaggcttagaaagcacatttcacgagaggtagctgggggaaaagccactagtgtggaaaagaaaaaggtgggacaaaataactgtcattgaataggtgcaaagttgagattagagctacagggaataactgtagacagaaaaattaggaccactgaagagaaactgcagggaggcagatctacaatcattatccggaaaatctttctaaaatgacaaatctgcaaacctggaattggtagcaaccagctgtgaagtacttatcttgggaaatacctgcatagagaactggaggaatcacctattatgtgaaacatttgtctagattatctctaaatctcttctatgattctacgaggaggaagaagtccagaaaaagaattgtttttgctctcaatactgctgaaagtattttttttaaaaaagctaaataccaggaacttctttaattaaaaggaacaatcccatcaagaagacaaaggttgatttgttagtcaagataatgagactgctttccttaggatcaagtatagcactgggagtgagaataggtcatttggccaggaacagtggctcacacctataatcccagaactttgggaggctgaggtaggaggattgcttgaggccaggaattcaagaccggcctgagcaacatagcaagactctgtctcttaaaaaataaataaataggccgggtgcagtggctcaagcctgtaatcccagcactttgggaggctgaggcaggcggatcacgaggtcaggagatcgagaccatcctggctaacatggggaaactctgtctctactaaaaaaatacaaaaaattagccagttggccgggcgccctggctcacgcctgtaatccgagcactttgggaggccaaggtgggcagatcacgaagtcaggagatagagaccatcctggctaacacggtgaaaccccgtctctactaaaaatacaaaaaattagccaggcgtggtggcgggctcctgtattcccagctactaaagaggctgaggcaggagaatggcgtgaacccgggaggcagagctttcagtgagccgagatcatgccactgcactccagcccaggcgacagagcgagactccatctcaaaaaacagaaaaaacattagccgggagtggtggcaggcgcctgtagtcccagctactcaggaggctgaggcaggagaatggtgtgaaccccggaggcgcagcttgcagtgagccgagattgcgccactgaactccagcctgggaaacagcgagactccatctcaaaaaaaataaataaataaaataaataaataaataaataaataataaatcttcaattctagatacaatcactcacttcctgtttggccaagggtaaatgatttcatctctctacctgagctgaaaaacagtaatttaaaataccaatattataggagtataatttaaattagttaacaactgcaaaatgctttggaaatttactttatatgacaattaagactattttttacttcatatatatattagagttgaaaaaattagcatgtattattcattaaatcagccaaatttctcactttcagagaaagaagcaaggaagagaatgctagaatgaactctgtggtgctggatcagcatcagagatatcagtataaactcatgtttatatttatatacagacagatacggaagtaaacgaagatatgtgtgggtcagtatatatatatattacttcctaactatcccctgagagggcctagaagcagtgataccctagcagtaatgagtgcatcaagctcatttagaaaccagatagtggtttccaaatactcttctccaacagaaggaaccaggacaccttggagaaatggctgattttagggttggggcaggtaaagtacaagatgagactggggcatcttacagtgccaggaagtacaaaagtgctaaaagacaaagaaaggtagggaaaggtatttcaaaagaacataggtgccaatgttagaatggccaaagctggaacaacttgagcaacaaaatacagtactggattataagcaaagaaaaaaatattcatgggtccatgttgacataaatgatttaataaataaatgggggaggcataaatcttccttacaaaaggattccaaatcataaaagtagaaagaattagaaaaatagaaaaccaacagaataatataatcaacgctgccgcaggcaagattcactaatgaatgctaaaataagtagaggaaatttttaaggagaaatcagattctgtataacctcacagttatcttccccaaaatattaactaattactttaggaattttaacatgcccacaaattctttgatactcctcccttcaggggttggagcttaattcccttcccccagaatatggatatgacttggtgactcatttctaggttctatcaagtaaaattaaaaagcagaacaacagtcactttacagtgcagaacatcactttaatcaagttatcaaagttaacaaggcacaatggctcatgcctgctatcctagcattttcggaggatgaggccggtggactgcatgaggccaggagttcaagaccagcctgggcaacatggcaaaaccctgcctttactaaaaatacaaaaattaggtgtggtggcacgtgcctgtggtcccagctacttgggaggctaaggcacaaaaatcacttgaattgggtaggcagaggttgccgtgagccaagatcatgctactgcactccagcctgggcaacagagcaagactttgtctcaaaaaaaaaaaaaaaaaaaaaagttaatcagtaacgagtcatgttgatatcaggtattcccagatatgatgtgacaagaagggtaaaccatctctatggtatttttccccaaaatgcataacctcgggctaatcatgagaaagcaccagaaaacccaaaatgagaaccattctacaaatgcatgaccactcatctttaaaggtgtcaaggaaagatagggaaggagagactaagaaactgtcacctattggaagaaactaaagaattgtgacatctaaatgcaatgtggtatcctggattggatcctgtaacaggaaaaggacatcagtggaaaacacaggaaaatcagaggaaagtctgtagtttgctcaataatattccactaatgctaatttcttaattttgataagggtatcaggttatataaaatgttaacgctaagagaaatggaatgaatacagaatgtatatagaaagtctgtactacctttacaactcttctgtaaacctgaaattatttaaaaggagttttaaactattttccatataaaaagaagtgaggaaagttataaataaaaaaatttattttttgagacagtctcgctgtagcccaggctggagtgcaatggtgcagtctcggctcactgcaacctctgcctcccgggttcaagtgattctcctgcctcagcttcccgagtagctgggattacaggcgcccgccaccaggcccagctaatttttgtatttttagtagagacggggtttttaccatgttggccaggctggtctcgaactcctgacctcttgatctgcccacctcagcctcccaaagtgctgggattacaggcatgagccaccgcacccagcataaataaatttttaaacatatttaaatatatgcaaactaataaaatattagtttacagtaagattaactttttttttttgagatggagttccactcttgttgcccaggctggagtgcagtggcgtgatcttggctccctgcaacctgtgcctcccagattcaagtgattctcctgtctcagcctcgcgagtagctgggattacaggcgcttgccaccatgccagctaatttttgtattttagtagagacagggtttcaccatgttggccaggctggtctcgaactcctgacctcaagtgatccccctgcctcggcctcccaaagtgctgggattacaggcatgagccatcatgcccaagccaagaagattaacttttttaacctataaataatcacaatagctggtcgcagcgggagtgcctgtaatcccagctactcaggaggctgaggcaggagaattgcttgaacccgggaggtggaggttgtggtgagctgagatcgcgccactgtactccagcctgggaatacagcgagactcagtctcaaaaaaaaaaaaaaaagaataagaacaagaatcacaaaagttagccaggtgtgatggtgcacatacacagtctgaactactggggaggctgaggcaggaggatcacttgaggccagaagttcaaggctgcagtgagctatgatctcccccactgctgacagaacatgatctcatctctaaaaaaaaaaaaaaaaaaggaaaaagaatcacgaaagtaattgtgttgactttcaaccttaaaatgttaatgacatccaaaatagttcaccataaggtctgcatttaaagactggcctaggagctctaaaatggtagatgagtatgatgaatatgatcccctatatgtatcagtgtgctttattaccccttttttttttttttgcaggggtgagcaggtctggctctttcagcaaggctgaagtgcagtggcacaatcatatcactggagccttgaactcctgggctccagtgatcctcccaccccagcctccagagtagctgggactatagacacatgccaccacacctagctaagtttgttgttgttgtttttgttgttttgctgtacactaaaattatctggggaccgactaagttgtttttgttttttttttaatggagacagggtctcactatgttatccaggctggtatcaaacttctggcctcaagcaatcctccgcctcaggctcccaaagtgctggaattacaggcatgagccacccagccctacaatcccccttcttaaccttaattgttctcaacccactcactcctagcaataagtctacaataacctggttctaaaagtgctgtttagaaagacaaagtgaaatcactgatacttacttggtttccttttcaaattgactatatacatgaactgccaagatgccttccactgggtcaaaatgttcctctcagattttctcacatcttaaggaaatctaaaagctacatagcaactactcacgcttaatctttaaaaaaaaaaaaaaaaaaaagcaaagtgattccaaaaactgtcaagagcaaaagtttacagagccaaaggattgatcaccaaattcagaaacaagattaggaaagaacaagacactatgagattaggaagaacaagacactatgagattaggaagaatctactctctgactaaagctaagccgcctatatataagaaaatccaggtgcttccttcactgtcagcaaacaatggaaaatgactttttaataggtaatataaatgtatttgtaaatttgaaaattttaacaaagggatgctggaatgacaaatatttgaagagactacttaaaaaacaagtgagacagagtaggaaaatgtgttaagacatcctccagcactgtatgtgtttttacactggggaaagggagactcactagacttttgttccttgattaaaatacccgtaaggccaggcgtgatggctcatgcctgtaatcccaacactctgggaggccgaggtaggtggatcatctgaggtcaggagttcaagaccagcctggccaacatggtgaaaccccatctttactaaaaattcaaaaattagccaggcgcggtggctcacgcctgtaatcccaggactttgggaggccgaggcaggcggaacacgaggtcaggagatagagaccaccctaacacagtgaaaccctgtctctactaaaaatacaaaaaattagccaggcgtggtggcacgtgcctgtagttccagccactagggaggctgaggcaggagaatcacttgaacccaggaggcgaaggttgcagtgagctgagatcgtgccactgcactccagcctgggcaacagagtaagactccatctcaaaaaaatatatatatatgtgtgtgtatatgtatgtatgtgtgtatatatatgtatatgtgtatgtatatatgtatgtgtgtgcacgtatatacacacactcacacacacacacacacacaaattagccaggtgtggtggtgggtgcctataatcccagctatcaggaagctgaggcaggagaatcacttgaacctgggaggcagaggttgcagtgagccaagatcatgccactgcactccagcctggatgacacagcgagactccatcttaaaaaataaaatagaataaaataaaaataaatggccgggcatggtggcttgcacctgtaatcccagggcactttgggaggccaaagcaggcggatcacttgaggtcaggagtttgagaccagtctgtccaacgtggcgaaaccccgtctctactaaaaatacaaaaatcagccgagtgtggtggcacatgcctataatcccagctactccggaggctgtggcaggagaactgcttgaactccggaggtagagtctgcagtgagccgagatcctgccactgtccagcctgggcgacagagcaagaccctgtctcaaaaataaataaataaataaaatttaaatttaaaaaatacccactaagaatatctagtgcctttccaattccataatcaactacctttttattactgattaggcagcccagaacaatggaggtgtcctggtcagtggacaattaaatccaattgtgcacatggcacttaatacttccaacatgcattaactggtatctggtttatcagtctctggtgagtttgtttactttgcatgaataaattctcaagcacttgaatcatcccaatgtaaaccaaaattctgaagtttctgaactactatgtgggggttggagagaccttggtttggttggataccatttttgccacttaactatctgtgtgacctcttcttcccatcagtctcaatttcctcatctgttaacaaacatagctagtgcctgggagatggcaagtgctcaaaaagtgacagctttattattttgaagctaaatttgaaaggaagtgtgtaactgaggtgaaaacatttcatttgaaaagtagtagtacggatcagcaaactacgttaatttaaaagacacagcctgaagagagatgtcccaatctttggagttgagaaaagcaaagtttaaaagttgcaagtaaagtacacactgcacagtacagatgggagtctcctgcttagcaactttaatgttgtctaccaaacacccagcttgtaatagagcatgacaactgttcactctaaatccatgtgctcagcttggattcaggattgatttataaaaatagctgctggtggtgctctttgaatctctttgggctgatgactgggcagtgttaccccaaaggcctagagcagctgtattccctcaccacacccatttctctgtctacccagccaagctgacggcaccctgcccccgccccccatctctacagcatactattcaccctcctcctgggctgagtgagcaaattacaagcacaaatatcccctgatgcaatgccacaaccatccctgggaaagagcagaggcagttgccaaaagcacagcagcagggaaatgggcgggagacgcgcgcgcgcgcacacacacatacacacgcacgcgcacacacacgcacgcgcacacacacacacacacacacacacacacacactgcaagaaacactgcaatgctatgcaaccagggagagagaatcgagaggccctggggagcaatactgtaacaggaccagagaaggcaaaggagaaaagggggtttccagtagaaagctgggtaacactaaccttcgcgaggaacacgtatttcatccgagcttgggtcctaaagcacaaacctaaaggtaatcaatcactgcctcttccccaaagcagcaaatgcatttaatttacccgttcctggaagtgagcaaaaccctcacaactcctccacaggacaatttcaccaaagggatctaactcacaccggcggagaacttgttccatgtgctaaatcacaatctctgttctgggtaatgtttccaactgcctctcctagtccctgtaccctccccacccccaccctaatgtgaccctttcgcactcccactgccagacacacgctttagtccccacacagtgtcggggcctttgcaagggggaagagccccgcctagggcccggttctccagaccacccctcagccccacccataatccctgactggacatactaaggctcacctcagcctcacatcaactgacccccacaaagcctcagaaaacgacccctgagttctcctacacctccgaaccccacccagggccccagactgcggccgaccctcgctccgcggctcagccccatccagagcccaaggcatgtcgctcggccccaccgccccgaccctcaaaagctggacctctcagcccccctcactccaaagacccccctagatcgcgcctcaaagactccgaaggtcaaagccgccagccccccgcctggccccctccctcggacgcccccgcgtctcgcaggccggcggccaccgcccttccacgcctcgggcgggccccgtggggtacccagctgccgcagggcaaggctcgggcagccccgggacagtgaggaggccgcccctccaatcggaccccgcctgcggctgcacctacccgccgccgccgagacggagctggggcagaagggagccaggagagcgccgggaagagccgtgaggaggtaggagacgtcgggaggagccgggagccagcgagctagccggaggggcggggcgcagggaggcggccgcttcctcgtcgcctcttgagggccggcgcaagggagggacgccgccaccgcctacccggcgagcgccgccgctccggccaataagcgtggcgagggggagggcggagggctgtggcggaccaatgggtgctggccctgccgccacgacgtctctgcagagctgcccgagccgcgggcggttggggcgaggtgcgcctgggggctctagcctcccgcctgcggcctgcgaatgccgaagcggaccgcaggccgatcgactgccttcgctgttctatgatggccgtcgctctctctcagagtctgggcgcccggagcgaggagagtgcgagagtcggcgcacacgcggaccgggccaccagcgggtggggcctgtgggctctgtgatgtaacttgggaggggcgcggggcggggcctaggtcgcgggccatctgggctctggaaggaacccttagaggagcgggaggacgccacaggtcctcggcggggctccgctcccgtgagccgcatgtggctggtgagctctgaaacgtggctggcccaagttgagatgtgctgtaagtgtacaatacacaccaaatttccaagacttagtaccgaaaaaaaaaaaaaaactcatctataatttttaaatggttacaagtgggataattaattataacaaaattgatgacagttggggtatatttggttaactaagaaatattgaggccgggcgcggtggctcacgcctgtaatcccagcactctggaaggcacttgaggtccggagttggagaccaccctgaccaacatggtgaaacttcgtctctactaaaaatacaaaaattagccgggcgtggtggcaagtgcctgtaatcccagttacttcggaacgtgaggcaggagaattgcttgaacccgggaggcggaggttgcagtgagctgagatcgcaccactgcactccagcctgggcaacagagtgagaccctgtctcaaataaaaaaaataggtttccttttctgttgaaattaacattacttcattccaaagccccagattttgtagaatccttaacttactgttgtaggaaaacacacaggtgggagctttaaagttactttgatcattcttcctgctgcctggagtagccagcatattcctgtcccagacttcaggaatagaattggctttgagctcctttgtagttagatggctaggaaaactcaaaagtattggaatcttccatcccttctgtaaaccaagaagtatctgagacaggtctcaattgatttagaaatttattttgccaaggtgaaggacattcctgaaaggaaaaaacacagaatcacagaaacagtctgtggtctctgcctttctccaaagatgaatttgaggaattcagtatttaaaggggaaaagtgggctggagggaaaatagggagggaacaagagaaaaggagcaggtaggggaatagtcaattgtgtattatgtcaagtatgtctgcttaggaatgaaaggcagtttgtgcatgactcagctttcaacttaattttttccttttggaatagtgaattggggtccgaagtgtttttgttttttgttttttgtttttttgagatggagtcttgctctgtcgcccagagtggagtgcagtggaacaatctcagctcactgcaacctctgcctccccggttcaagcaattctcctgcctcagcttcccgagtagctgggactacaggcgcacgcttccacgcccagctaattttttttgtattttagtagagacgtgtcaccgtgttgcccaggctgttctcgaattcctgaactcaggcaatccgcccgcctcggcttcccaaagtgctaggatttacaggcgtgagctaccatgcctgcccctaagtgttttgttttttgtttgttttttttttttgagacggagtctccctttgtcgcccaggctggagtgcagtggcacgatctaagttcactgcaacctctgcctcccaggttcgagcagttctctgcctcagcctccgaagtagctgggattgcaggcgcctgccaccgtgcctggctaatttttgtttttttagtagagacagggtttcaccatcttggccaggctggtcttgaactcctgacttcgtgattcacccgcctcagcctcccaaagtgctgggattacagggatgagccaccgtgcctggctgaagggtccgaaatttctttaatatttatttttccccagggccaggcagtggctcacagctgtaatcccagcattttggaggccaaggtgggaggatcgcttaagcccagtgggagggtctcactctgttgcccagactggagtgcagtggtacggtcatggcttgctgcagcctctacctcccaggctcaagtgatcctcccacctcagcctcccaagtagctgggaccttaggcttctgccaccacactcggctaattttttaaattttttgtagagatgggttctcactgtgttgcccaggctggtctcgaactcattccctcaagttatcctcctacctctgcctcccaaagtgctgggattacaggcatgagccaccgcacccggaccccagccttctttaagttaagacagtcaccatgttatgtgtagagctagagacccaggagtgattctcagttattcccttccttttcccctcatacctaccagattttcctcctgcctcagaaacagctccactgacacatgctgttctggttcagtcctttttctttttcctgtatcctgccatagtttctttcaagccttccccttgctcctgcttcagtccaaatatcacaaccttctgtaccatccccttccattcataatatcctcctgcatcccttgtatgcctattacaacacttaccatatatgtgatagttatttgtataaatatggatctgcctggccaggcgaggtggctcatgcctgtaatcccagcactttgggaggccaaggtgggcagatcacgaggtcaggagatcaagaccatcctggctaacaaggtaaaaccccgtctctactaaaaactaatatatatatatatatatatctgccctaacagattgcatctcaaagtacaggttcattctatttccccacttgcagtggaaaagaacattccctccagttccagggtgcccaggatgaaaagcatagaaccacctattctgggcatactgcctatgggattgccctgctccacaagcagcagtaataaaaaagaaagaaaaacaagaaaagcatagaacctcaacatctcaaagttggaaaggatcttagcaagcactcagtctcatgtctaaggatgtattcttgagactttacaagttcacaataagccatctcaggattatatttgagttatcctttaaaagcatgctttatgtctattcatccaaattttgatgaaaatgtaggccaggacacaaacattggcagaatccaatagcttatcttagaggctttcctccagttttaacctaaaccccttcaatggcttttcattgcatcagaatcctaaacatgtatttcaagacctcgtgcaatgatgctgcctctgtcttgcctcatcatctgccttttttctcactatgcccagtatcatctgccttctctgtttcttgaactttctcttgtcaaggccctcctcatattgtttcctctgcctatcctaatgtatgattaatatgattttctaccaggcatagtggcacacgcctgtaatcccagcactttgggaggccaaggtgggaggattgcttgagttcagaagtttgagaccagcctgggcaacatagtgaaaccctgtctctacaaaaaatacaaaaaaaaaaaaaaaattagctgggatggtggtgggcacctatagtgccagctacgtgggaggctgtggtgggaggatcacctgagcctggggaggttgagactacagtgaaccatggtcataccactgcactccagcctgggtgatggagtgagaccccatctcaaaaaaaagaaaaaaaaagatgtgattttccacatcgaaaatttgaaagactaataaaagagttcatggccaggcatggtggctcatacctgtaatcccagcactttgggaggtcgaggtcaggggttcgagaccagcctgaccaacatggtaaaaccccatctctactaaaaatacaaaaattagccaggtgtggtggcttaagcctgtaatcccagctactcaggaggctgaggcaggaaaatcacttgaacctgggaggcggaggttgcagtgagccaacatcgtgccattacgctacaggctgggcgacaagattgaaactccgtctcaaaaataaaaagagttcagcaaggttactggatacaaagttaatatacaaaaaggcataacagcatatataccaataatcagtaagaaaatgagatagaaaagaaaaaccctacaaaaatgagataccacaacacacctactaaatagaatgggcaaaagccagaacactggccaggtgcggtggcttacgcctgtaatcccagcactttggggggccaaggcaggcggatcacgaggtcaggagatcgagaccatcttggctaacacagtgaaaccccgtctctactaaaattacaaaaaattagccgggcatggtggcgggcgcctgtagtcccagctactcaggaggctgaggcaggagaatagtgtgaacccaggaggcggagcttacagtgagccgagatcgcgccactgcactccagcctgggcgacagagcaagactccatctcacaaaaaaaagccagaacactgacaacaccaagtgctagtaagaatgtgaaacaatagaagctcgcatgcattgctgctgggaatgtgaaaggtacagaactttggaagacagttcagcagcttcttacaaaactaaacgtactctcatatgacccagcaattgccctccttggtatttactcagaggagccaaaaatttatgtctacacaggcagggcacggtggctcacgcttgtagtcccagcattttgggaggccgaggcaggtggatcacctgaggtcaggagttcaagagcagcctggccaacatggcaaaaccctgtctctgctaaaaataacaaaaattagctgggcatggtggcgggtacctgtaatcccagtggctcaggaggctgaggcaggagaatcgcttgaacccaggaggcagaggttgcagtgagccaagatcatgccattgtactccagcctgggcaacaagagcgaaactcagtctaaaaaaagaaagaaagaaaattatgtctacacaaaaacctgcacacaattttttttttttttttttgagacagagtctcgctctttttgtccaggctggagtgcagtggtgccatcttggcccactacagactccgcctcccaggttcaagcgattctcctgcctcagcctcccaagtggctgggattataggcatgcgcaaccacaccgggctgatttttatatttttagtagagacggggtttcaccatgttggccaggctggtcttgaactcctgacctcaggtgatccgcccccctcggcttcccaaactgctgggattacaggtgtgagccactgcacccagcctcacgaatgtttatagtagctttactcataattgccaaaacctagaagcaactgagatctcctttaataagtgaatggataaataaactgggattggaagaatgcaccaaaaaaaaaaaaaaatggctagccttgggtggtaagattacatagttatcatttactcctttatgcttttccaaattttatactataaatcatttatttctttttatagtcagaaaaagatcaatgaaatttttttttttttttttagagacaggttctcgctatgttgcccaggctggagtgcagtggctattcacaggtgcgaccccactactgatcagcacgggagttttgacctgctccatttctgacctgggctggttcacccctccttaggcaacctggtggacccctgctcccaggaattaaccatattgatgctgaacctagtgtggatggacacctaatccacgtagtgcactacatcccagaactcctggacttaagtgatcttcctgccacagcctcccaagtagctggtactacaggcgtgcgcaccaccccacctagcactttatttattttttattttttttatttttgagatggagtcttgttctgtcgccaggctggagtgcagtggtgcgatctcagctcactgcaacctctgcttcccgggtccaggtgattctcctgcctcagcctcccgagtagctgggactacaggcatgcgccaccaggcccagctaatttttgtatttttagtagagacagggtttcgccatgttgacaggatggtcttgatcttttgaccttgtgatctgcccatctcagcctcccaaagtgctgggattacaggcgtgagcaaccacgcctggccacactttgttttttttttgagacagggtctcactctgttgcccagacagtactgcagtggaacaattttttttttgagacagattttcgctcttcttgcccaggctggagtacgatggtgtgatctcagctcactgcaacctccacctccctggttcaagtgattctcttgccacagcctcccgagtagccgggattacaggcatgtaccaccacgcccggctaattttttatttttggtggagacagtgtttctccatgttggtcaggctggtctcaaactcctgacctcaggtgatccacttgcctcggcctcccgaagtgctgggattacaggcgcgagccaccacacctggcctgcagtggaacaatcttacctcacagcaacctcaacctcctggggtcaagcagttctcccacctcagcctgagagagtaggctgggactacaggcacatgccattgtgcctggctaatgttttactttatacttttggagagacggggtctccctgtgttatccaggctggtcttgaactcctggcctcaaatgattctcctgcttcagcctcccaaagtgctgggattacaagtgtgagtcaccatgcccagcatcaataaatacttttttaaaatttttattcttatttttattttatctcttacagaaaggaaataaatacattttaaggtaaggcaagcaacagcaacaacaaaaatcttcacagagcgaaacaataaaaactgatgtggtactgagtaataaaactaacaataggttgtaagactttctatagaaaaatattataaaactttacaacttttagaagaaaatatagggtcgggatgctgtggctcacacttgtaatcccaaaactttgggaggccgaggtgggtggatcgcttgacctcaggagttcgagaccagcttgggtgacatggtaaaacctcatctctacaaaaaatacaaaattagctgggcctggtagtgcacacctgtagtcccagctactcgggaggctgagagggaaggatcgcttgaacccatggaggcggaggttgcagtgagccaagattgtgccactgcactccagcctgggtgacagagtgagactctgtctcaaataaataaataaataaataaacctatttaaaaaaaagagagaaaagaaaatattgagcaatatcttgatgctctcagggtgggaatcttattgcaatttcttggtaccaaagcttgtcagataaacacaattttgcataccaattttatcataatttatgatgtttatgttaggattccatgggaagagggaagtacaattacatggattagaatttgaatagaatagagtcatagcattttaagaaccagaagggtctttcagaggttcttttggattattttagcccaatcctttttcaagtgtagtaattgagatatgttgaggacccacagaaaaatggcagaatccaggcttgaactcattttcttactctcatctgggtgcttgttgcacttaccccttctttcatctttaaattaatgtaggctggcactggacgcagtggctcatgcctataatctaagcactttgggaggccgaggcgggtggatcacctgaggtcaggagtttgagaccagcctggccaacatggtgaaaccccgtctctactaaaaacacaaaaattagctggatgtggtggtgtgggcctgcagtcccagctattctggaggctgaggcaggagaatcgcttcaacccaggaggctgcagtgagccaagatcgcgcaactgcactccagcctggcaacagagtgaaacttcatttaaaaaaaaaaatagggccaggtgccgtggctcacgcctgtaatcccagcactttgggaggccgaggtgggtggatcacctgaggtcaggagtttgagaccagcctggccaacatggtgaaaccccatctctactaaaaatagaaaaattagccggacatggtggcaggtgcctgtaatcccagctactcaggaggctgaggcaggagaatcgcttgaacctgggagacagcggttgcgatgagccaagatggtgccactgcactccatcctgggcagcaagagtgaaactccatctccaaaagaaaaaagaaatggggtctcgcccagcctggccaagatggtgaaaccccatctctactaaaaatacaaaaattagctgagcacagtggcaggtgcctgtaatcccagctactcaggaggctgaggcaggagaatcacttgaacccaggaggcggagtttgcattgacccaagatcacgccactgcactccagcctgggcggcagagcgagactccatctcataaaaacaaaaaacaaaaaaaaaacaaaagaaatggggtctcgctatgttgcccaagatggtctcaaactcctgggctcagagatcctcctacctcagcctcttgagtagctggtatacaggtgtgagccaccataccccacacctggctagctaccttaatctttgatttcctgtaaagtgatcaaaatgaacccctatctttttttttttttgagacgcagctcactgaaacctctgcctcccaggttcaagccattctcctgcctcagcctcccgagtagctgggattacaggcatgcaccaccacacccagctaattttgtatttttaggagagacgacgtttctccatgttggtcaggctggtctctaactcctgacctcagatgatctgcctgcctcagcctcccaaagtgctgggattacagacgtgagccaccacgcctggccaaaactcctatctcttaaagccatcgttggccaataaacccctattgatgtaagccaccattagtatctgtcatttgcagctaaatgcaatcccaactgatatatggagtaaaagtcctggactacgagttgagaaaccccattacagtcccagctctgccaggaacaagctatgtggccttgggcaagccatttcccatctctggacctcaggttcctcatctctaccaggggaagtagaacaagatggtgatggtctctttcacctcttactttctttggtctcattcatcgttcatgctgtatagtgtgtaatatggcacttctttcctctatgactacttctttcaaggttcacccagtgttcccttgttcctgtgacctcaggactaattacaagggcccgtctcctttgagtgaatgtaacacctttggggcattccctgaacacaaagtccctctagctagatccttattttctcttcctttggttaattttttttttctttttctgagagatggggtttcaccatgttgaccaggctggtctcaaactcctgacctcaggtgatccacctgcctcggcctcccaaagtgctgggattacaggcatgagccaccatgcctgggccctcttcctttagttaattttatatacctacacctaggcggagcacaaaggagggaaggggttgtttctactctaaaaatactggagtaacatgcccacctctgcccctaacccctaaacatgctatgtgatttccccttttggggcttcaaatgcatcatttatgaaataagagggtggcagactgtcaaagggcccttcaagccctggcattctaagactgaattatagcttctaattttcttctttcactgtgatagcactttgcttgttgtgaagcgctttgctctctggtgtgagaggttaggctttctatgactctgagataatctgagttagtattactatccacattttgaagttgaggaaacag

SEQ ID NO: 1140 - DNA, 26116 bp, Homo sapiens
gcagttactctccactcccttcttccaccagcccctggccaccacgaatctactttttgtttctatggatttgatttgcctattctgcctttttttttgaaacagggtctcactctgtaacccaggctggagtgctgtggcacaatcacagctcactgcagcctcaacctcccaggctcaggtgatcctcccacctcagcctccctagtagctgggactacaggtgtgtgccaaccatccctggctaatttgtgtattttttgtagagacaggttctcaccatgttgcccaggctggactcaaactcctgagttcaagtgatcctcccatcttggtctcccgaagttctgggatgacaagatgagctactgcacccagcctggacatttcatacaaatggaactatacagtgtatgctttttgtcactgatttctttcacttagcataatgtcttcaagattcatctatgttggccgggcacggcggctcatgcctgtaatcccagcactttgggaggccaaggcgggtagatcaccggaggtcaggagttccagaccagcctggccaacatggtgaaaccccgtctctactaaaaatacaaaaaactagccaggcatggtggcaggcacctgtaatcccagctacttgggaggctgaggcaggagaattgcttcaacccgggaggcagaattttgcagtgagccaagttcatgccagtgcactccagcctgggcaacagagggagactctgtctcagaaaaaaaaaagattcattcatgttgtggcatgtatcagtactttattcctttctatggccaaataatattccattatatggatataccacattatatttatccattcatcagttgatggacatttggttgcttctaccttttgactacaatgaaaagttgctatgaacatttgtgtacaagtttttgtgtaaacatgtgttgcagctctcttgagcatacacctaggagtgggcctgctgggtcatatagtaactatgttgaactttttgagaaactacagaactgttttccaatgcggcagcaccagtttacattcccaccagcggtgtacatgtgttccaatttctccacatccttgttaacccttgttagattcaggatttgtcaacattttctctcattctgtgggttgtcttttcactttcttgacagtgtcctttaacacagtttttaattttgatgagatccaatttagctcatctttctttggctgcttatgtttttggtgtcatttctaagaaaccaagatcatgggctgggtgcagtagctcacgcctgtaatcttagcactctgggaggccaaggcagcccaatcacctgaggtaaggagttcacctgtctggccaacatgggaaaatcccatctctattaaaaataatacaaaaattagcctggcatggtggtgggtgcctgtaatcccagctactcggaaggctgaggcaggagaattgcttgaacccaggaggcagaggttgcagtgagccgagactgcaccactgtactccagcctaagtgacagagtgagactccatcacaaaaaaaaaatcacaggccgggcacggtggctcacacctataatcccagcactttgggaggctgaggcgagtggatcacgaggtcaggagatcgagaccatcctggctaacatggtgaaaccccgtctctactaaaaatacaaaaaattagccaggcatggtggcgggcgcctgtagtcccagctactcgggaggctgaggcaggagaatggcgtgaacccaggaggcagagcttgcagtgagccgagatggcgccactgcactccagcctgggcaacagagagagactccatcttaaaaaaaaaaaaatcatggcaggaggccaaggggcagagcctggcagtgccagtgttggtggcagcagtaggcctggcatgggcaggattccagggagagcgcagagtctgtacacaccaggccacgcccacaagggctacccatcaggtaacttatgacacgtagttcccaaggcccagccagactgcagacaccatgagtgtagtccaatctccaagtaagattctcaaactaaaggaatgcctaggacagtattgcccctgcatatagagtatctcaggacactgaagcttaggctgggactgtgacagtatccacgatatgtgtgggggtgggggtgtctattgtgtatactttgcatatttataaaataaaaagttcagtggtccatcaggtgacaaatgacttcagaagaatgaacacaatgaagcatgggttggctgtccttcttttcacagagggctctgcagtggtgatggcacctctgaggcaggttacctggtatttgggagcttccccatagaaggtgtgccatagaaaatgcttgctttggccaggcatgatggctcatgcctatagtcccagcactttgggaggccgaggtaggcagctcacctgagctcagttgttcgagaccaacctgagtaatatggtgaaaccccctatctacaaaaaatataaaaattagccaggtgtggtggcatgcacctgtggttccagctacctggcaagatgaggtgggaggattgcttaagcctaggaggttgcagtaagccaagattgcaacactacatacagaaagaccatgtctcaaaaaaaaaaaaaaaaaaaaaagcctgctttccttgcactgggggagctcactagaatgaaccactactgcctggctcctatagcctgtttattcaccacactccataccctagagataactcacatttgctgctaatcttttttggttaacttgctgaaataattcttacaaatttttacaatttcaaatgacacgagttagtacaggaaaagtataaatcccacccacagagatactcattgtaaagtttggcgtgcagattcccagaatttattctatgaaccaaaaaaatatacacctgtggctgggcatggtggctcatgcctgtaatcccagcactttgtgaggctgaggcgagcagatcacttgagatcagaagtttgagaccagcctggccaacatagtgaaaccccatctctactaaaaatacaaaaaattagtcggtcgtggtgccgggcgtctgtaatcccagctacttgggaggctgaggcaccaaaatcgcttgaacctgggaggcaaagcttgcagtaagctgagattgcaccactgtactccagcctgggtgacaaaacgagactccatatccaaaatatataaatttgtttttttcgtttttttttttttttttttgaggcagagtttcgctcttgttgcccaggctggagtacaatggcacaaaatcagcccaccacaacctctgcctcccaggttcaagcgattctcctgcctcagcctcccaagtagctgggattacaggcatgtgccaccacgcccggctaattttttgtattttcagtagagatggggtttcaccatgttggccgggctggtctcaatctcttgacctcgcgatccacccaccttggcctcccaaagtgctgggattacaggcgtgagccaccgcgccaggctttcctttcctcccctcccctcctcttttctcctccctccctccctccctctctttatcttttgacagagtttcactcttgttgttcaggcgagagcgcagtggcacgatctcggctcactgcaaccttcacctccgggtttcaagtgattctcctgcctcagcctcccaagtatctgggattacaggcaccaccaccacgcccagctaattcttgtatttttagtagagacggggtttcaccatgttggtccaggctggtcccgagctcctgacctcaagtgatccacccaccttggccacccaaagtgctggaattacaggcgtgagccaccgtgcctggactagaatagctttctagaggtgggactgcagatactagggaatgtgaatttaaatttatgagagataccaaaggatttaaaaaaaaatttttttttgagacggagtctcactctgtcgtcccgacagactggagtacagtggtgtgatctcagctccactgcaacctccgcctcccaggttcaagtgattctcctgcctcagccccctgagtagctggaattataggcatgcaccaccatgcccagctaatttttgtatttttagtagagacggggtttcaccatgttggtcaggctggtgtcaaactcctgacctcaggtgatccaccttggccgcccaaagtgctgggattacaggcgtgagccaccgcaccggccctagcaaggattcttaacttgcaatatatggttaagtttcagaaattatacataaaatgtttgtccatgtgtgtgtgtgatttctagggagatccatagattttgtcagatatttaaaaagtttcaagtcactggggtacagggggccggcacttcactacagcagtggaccatgtgtagtatatttgcaggttttgagcaattttatcaaccaggtacttgtccagcaagggtcactgtctgtgcagctaccggaccacctgcaaggagagcagatgacagcattcccacgtatctcctgcccctagagtaaaggtgaagatccatacagaccacagtcatggtaccacctcctctttaggtctgattaatttgctagagtgtgccgggcacggtggctcatacctgtaatcccagcactttgggaggcggaggtgggcagattacctgaggtcaggaattcaagaccagcctggccaacatggcaaaacccggtctctactaaaaatacaaaaattagcagggcatggtggcaggcgcctataatcccagctactcgtaggctgaggcagcagaatcacttgaactcaggggtggaggctgcagtgagctgagatctcgccacttcactccagcctgggtggaagagcaaaactctgtctcaaaaaaaaaaaattttttttttccgctagagtggctcatagaacttagggaagcacttgctcatttttactggttattttaaaggatacaaacaaacagccagatgaagagatacatagggtgaggtctgggagggtcccaagtgtaggagcttctgttaccatggagttggggtgtgccaccctcctggcacgtggatgagttcttattcactttcctgtcagcctccacctgttcagctctccagaaactctctgaacccagtcctctcagcattctttgtcccagggtatggggtaggaccctctctggaatgagggtcttatgacccatgatcagaagggcagggcaagattagagtcctgccttggggcaggtgaaagagaagcaggaaaaagtcagagagattctgtttcctgaggcctgctcctgagtcctaacactctcaacattataacgaaacactgtataacaagggctatgggagttatgagccaggaaccatggataaaaacatatataaattcacacatatattaacatcacatctatcaacgaggttgagcatttttttcatatgtttattgcaatttgcattttctccttggtgagctacctattttatgttgtatatattttcccacagtaaaagagaaggaaatgatttacagctctacatagtatcctggagagacagtcatgaaaattgttaagaaaaaaaaaatccatgtttctctgaatagtaagatgtgtgcgtgtgtgtgttcacagaaaaaggaaagggaggatataaaccaaattgttaatattaacgacctcagggagtatgcagtatttattgtttggctataagaaggggcatgaatttagaggtcagaccaggctcaaggccctagctccactactgatttgatgtgtgacatggacgaataacatgccagtttcttcatctgtaaaacaggaagagaaatagagctgttgtgagtagtagatattacaacagtgcctgtcacaataaagtgtagctattgtcatcatattattatctccttcagtgtcttcttcactgtaccatatctattcttccattcaggacttctttattgggactgtaaaaagatttaagtatcaaaagagaaaaacatagaaataaaaacaaaatacaaaaagcctaataatgagggggttcacatagtacttgtttctgatcccactagaactagcttgcctctgaggccatccgagatatctaagctttggccctaaagaactgccacaaatttggagacgtggcctacatttctttcttcttggtctgtcttcacatagaaggtgctcttaagacacacagcctaggaacctccttctcaacacctccacaccttcacttgctctttgctatccctactgtcaccctcctcttttctcctgccacatcaacagcttcttgcactgcaaatgttttctggaactctccccatgactgacaggctaataaggagttattttatttgctgtttgagtcacaaataccatttttatccaatcccaactttgccttttttgtagggttactgctacattaatgttctctggcttgagaaatctgaagcctttaggcagtgattagatttttcctacgtgctttacaacacttcacattcaacaaattcattaacgataaacaggaaataaaccaacaatttctcctggtttagttcacccttaggacacgcatctatgaaatcagaaatcttattcctgtcagaacaggatggccatgtgcttccctgttaacaaagaagtcttaattttattaattacaatgcttacgactaaaacaaagcaggacctctttccattgatttcacatgatcgccagagtctctcatttctctgcttccttctgccatctttttttttgagacggagtcttgctccgtcgcccaggctggagtgcagtagtgcggtctcagctcactgcaagctccacctcccgggttcacatcattctcctgcctcagcctcccaagcagctgggattacaggcgcccgccaccacgcccagctaattttttgtatttttagtagagatgggatttcaccgtgttagccaggatggtctggatctcctgacctcgtgatccaccccgcctcggcctcccaaagtgctgggattacaggcgtgagccaccgtgccccgcccccttctgccatctttatattcgttcattttccgtttccttcccttcctttcttgtctctccctcttgaacatttctaagcaccttgtgtgtgccaggcattcagtaacaaagcttgagcaaaacagcccaccttctcattatcatggagcttacaagcctaactgggaattggagacattcatcaaataatcaccaaatctataatttgaaactgcacttagtgccatgaaataaaacacaggcccctgtgacaaatctgtgtagatgaaggcttcatccaggaagtggtagctgagctggagtgagaaggataaggagttagccaggcatctccccacatttagagcgccgagtgggcagagaccaggattgttatagcatttgctcctgggtctgactcacagatgtgctcataaatatttgtggaagggaggaagggacaatacgaataatataaaataaatgaaaatgtgtcctcctttgttttgatactatgaaattaataaaattaactgctactaactaaaaaatccaagtagaacacagaaaggagagtgtggcacaaggtaaggttgcagaagtagcagccaaatcacactggggccttgagtatgtagagattttagtccgtatcccgacagcaattgaaagccactgaaaagtaattcacagcaaatatagttaatttttttacagcttacattaaaacaaattatgtactagatactgtgctaaagactctacttgcactatttgaatccttgaaacaatcctatgatgtactattaatattccaattttacagaacgaggatactgatgcatagagaggtcgtgactccaaacccctactcttactgtattacacctacacactattcacaagtgagagaagtaggtaagcaactatgtacagctaaatctcatctccttggcaggcctagccccactgtggagttggtagcacaggggtatcaggatttaatgagccaatcattgactttacgctccttgttctgactccctaataaaataaccttctagttatattctggcttcccatatagatttttctgctgggagataatgcactgaccagcctacacacgcattttgttccagttgacaattttattacacattgtaagttaataaattggcattctcctttaaaaaataacaaaaaaatttaatagtcttatacagttactttcccatgaagggttagcttgaaaagtaaaaagcaacgaataaaaatatcatcacctattgtctcttttgtggtcgaaccttttcttgctgcctgctttgagcgaccgtggatgtggtcactgagtctggggaggagccctttatcttctttgtggatgcccccagcacagcccaagtgcttcctttgtttcccactgagcctttagcaaatcccacctttcctcctgcaccgacggagaggattgttcttgggaatgcaccttgttctactgccgccagcagtaggcagctggagactgttactaggggtctccttcacctccccagcgtaaagtacatcccatgctaggagcaggccgttccctgagaacctcattaaacccggcgttcttgtcacgcgctccgctcagggccaccaggccaccagcccgaccagacctgcaccgaggcccagccccagaacaggctgcagagacccccgcccccaaggcgggctccctccaaacgggactccatactccttgctggctcaagttttgtttcgctctttttccctgtaattcctttattgggcaaaactgggacaaacgcaggtggacattttaaagtgaaagcttcatgaaacagcccattccacgccgtcaagagatctgcttaagcacattcaagggaacgaatagcccccacccaccaaaaaagaaatgttcgttccatattctcctgaacagaggattgaaacatcgattcccccccccttcaaaggaacaggaaggccacggggcaaggacggacttgggagcggcctcctttctctctggagggaaaggctggagcgctgcctccacttttaagtccacgaaccacgaagggtgaggatccctcagaaactttagcgcaggggagcgggcaggagggcgattgtttaaatcgatggcagcaccttcattaatctgctttccggccatcttcagcagagccattcaccaggaaacgactagaaggtgggcctgcgcccctcagatatcccggggccggcaacgagccgggcagggacgccgaaggaaggccgtgaggagccctcgctggccggccaagatggccaccttcacatggccgaccgccaccggctccctgccacccggcatctagaggcgggacggccagaaagaccccagccgcagcacaaaacctccgcgattcccgccgcctccgctgggggacgcgacctccgggaaagctatcccggccaacggtcggaagggaggtgccatgtcaccgcacaggggagcgggtccagcaagccccagtcgctttttctcccacatcaaacaaggaagagcaatcccccacgtctcctcgcgtctgcatttttctcctagctctagcggctcaagatagctgaacggtctctggagggccggattgccacggcacctcccgcggccgcgcagtgtggttcagcccggactccgcggggcgagctgcccttcctcccccgacccccgcgcaagtggtgcattggcgcgcggcgccgaggggcggggcccgagccgggcgcgcgcgggcgctgctctataaataccgggccgcaccgcccgctgcttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccaggtgaggggacggcctgaagcgaagcgtggggcggggcagaaggcagcgccaaggtccggctggctgcggccggccggtggtggggcccgcgcgggtcgtcctcgtccgccgggtgatggaagagcggcgaccgcgcgctttcctcgtggcgccgccagggcctggcgcgtggccgccgctcctcttccccctcccctctccacccttcccttcccccctcccttttcattcggtcgcgcgcctaggcatgcggaaggttccagaaaacgtgaagggcgggggctgtggtcgctagtgagttctggccgggaagggagggcactgttaacccctcccggccctgccgtctgacaaacctggagtgggcgacccgccccgcgtgctcgcgtccggccctcgggagcgcgcgccccgcattgcagcggcgaccacgtgtttgccgcatgtggtatctgggcgagggggagccgtgagcctccccggctgtcctggccctcagtttgaggggtggggggcctatgccttgggacgtcgtctggctccactgcctcagtggttaggtcttgactacacactggagaatacgcacatgcccttcggcggatatggccttgcctccaaggtgacggcctctgactaaatatagctcatgtccaagaaggcagtccttatttggaccccttgtgaaaaggatgggaagcatgaattaggagctgccattgctttgggttcgcatttaaagtcttcggtgcagggttttacttgaggctttgtccgctcaaccgccattatggggatcaattggcacgtgaaggaggagtaaagctatatttccaggaactgaaaatctcagcctgagcatatcggctagtaaagatgattatttggctcttttggctgtttctgcccttaggatgaccgcagtagttatctatctggtggctttagggtctggtcagtttactgtgcccatgatgaaatcccacaagtaacttagtggtatgagaggacaaacccaggatcttgatgagtgctgaaggttagctgttacaccagttagtagtagaccgaagttcagagcctgcagtctggcttccacattatgtttggattctgttttaggcggttatagaaaattcagaaaaacgaacttgaattagggagatatttgttctccctcctaacaatagatgacaaagcagggagacatggattcggaatacgtttgagcatcttctacactgttgagcttttgtttcctgcgcaactcctaacagcaaaatcagataattgccattttagtcagaaaatgcttttcatttaattgtttaatcgaattatcttgttgctcattataattggtgttccttaagattagggaaactggcctacctgtggcctcagttctaccagactcccaggtgcagaggggtttggtacagttgtggaagtgaatatgatatagggcaaattctgttctttaaaggatataggactaacagttcacctttctggtgattagatttataatgcaaactttgaattttaggaggaaagtgcaaacacaatgaattaagatgtattaagcatgttttttaaaatctccaaagattttacagatagtaacagggagggagcttgcatacatacatacatactttgtttaaagttaaagaaactgagccaggaatttctcttttccagataagatttgtgaccaaatcagtgatgctgtccttgatgcccaccttcagcaggatcctgatgccaaagtagcttgtggtaggttcagaatgtgcttatcaactggtggaaagatagcataaaaattatttttatagaagtgatgtttgagttgaatgtctctttttattagaaactgttgctaaaactggaatgatccttcttgctggggaaattacatccagagctgctgttgactaccagaaagtggttcgtgaagctgttaaacacattggatatgatgattcttccaaaggtgtgttttaatgattttgctcatttttttctaggtaacagctgtgaggtttgaagaaactcctagaatgttcctgctaatcctaaactccagttgtatcttactatacactaagccctattctgttcattctctaaaaggtccgatggtttaggtatatttgatttcttcagcagtgtttagaattccagataattgctgtaaacagcaggtatttctaggacgtaaacaagatgttgtgttttttgcttataggttttgactacaagacttgtaacgtgctggtagccttggagcaacagtcaccagatattgctcaaggtgttcatcttgacagaaatgaagaagacattggtgctggagaccaggtatcttggtgtagaggctgttttaatctcttctaacattaaattctggagcttgatcacattggtgacttttctttctttagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagtaagtgatgatcataaagcttggttgtctcatttattacatcagcacagaagatccataattttgataatagctaactggaaaaaatagcatttgttttcctatattgtaacttcaggtagagaaacaaatacaaagttattgtttggtgtgatgttctgatgacctgtgttgccttcaaggttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcaggtaatgtcattttgttgcatttttctggatttttgatggttacttaaaattttggctactacatttttttcaggctttctgaaacctacatgtgaatcatcggaggatatttgctgaatgaattcagaataggcaacctaatccacttggaaagcactaggcgtaaagtaacttaaatcctgtaatttcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtatatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcaggtaaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaactgtgtctgttactcatttgttaaagtgctttggggccataggtacgtgcctataatcccaacactttgaaaggctgaggtaggaggatcactttaacatagaagttggaggctgtagcgaaccattatcaagccactgcactccagcctgggtgactgagactttggctcttaaaaaatgctatcatatgaataacctgagaatactatatgtgtatctttaaccttgaattgtaatccataattagccataattcaggaaaataacctcaatccctagacccagtgggtgggcattttttaaaagcctaagcaagatttagtcctcctagtccacttaagccaaaattcatgtgtccttattgcagcagccattcaatgccatttttaagttttcaactaaggttgagggcttcaaaccattgaaggcataaaaaccgctaaaagtattaacctggaagtggtaatgtctatctaaagtcctggcaatttaagcctattaatctgcatacatttttaaattatgagcttagttttaagggttgtatgatgttttcatctgagaagttctgaaacgtgatttctagtcaatatcttgcagagataaataatgcaaattagctgaaaatgctataaatttccaaaggcttaaatttcatttatggcaggttgtgtagaaaatccgcagaccacactgctcttgaacctaggagctacatgcatagagaatagccacttggattacatttctaccaacatctgaatggtggtccagcttgtcctgcaaatgtagagccaaggagtgcttgcttatgcctgtttgcatggagacttaaaaacttggaaatttggaggccaggcggagtggcctgtaatataggccactatatagtaatataggcgtgagcctataatcctagcactttgggaggccaaggcatgcagatcacgagaccatcctggctaacacagtgaaaccctgtctctactaaaaatataaaaaagttagccaggcacctgtagtcccagctactcaggaggccgaggcaggagaatggcgtgaacccgggaggtggagcttgcagtgagctgaaatcgtgccaccacactccggccagggtaacagagtgagacttaaaaaaaaagccgtggaaatctgggtatggtagcttacacctgtaatcccagcactttgggaggctaatgcgggtggatcacctgaggtcacggtttgataccagcctggcaaactgaaaccccgtctctaccaaaaatacaaaaaagctgggtgtggtggcaggtgcttgtaatcccagctactcaggaggctggagaatcacttgaacccaggaggcagaggttgcagtgagccgagatggcgccattgcactccagcctgggccagagcaaggttccttctcaaaaaacttggaaatctgttgggaagtagggggagggcaaggttaaaacctatgcaggtgtgtcaattagacttgttccaacttgagaacctgaattttgcatgtaattgaaatgttccagaacaagtctggcagtttcataagggagtttttagatgccaatacattgcagataaccatattggctacattaggggaatgagcatggataggtgcctccaagttggtagaatagcatgagaagttttcaaaagtaaccgctttaaggttatgttcagtatttgctaagtaaacaaagattccccaaccttgagggagcttgtggaccaaggggatagtgttgtcctgcccagcctaggggaaaagtatcctgaaggttaataaggtggtggaggaacattaggccacagggagcagagggaaagcataacagcaggggatgataagggtgattatagtttagaaagcatgaaagtatgacttaaggaaatgtctttaggttgaacattctgtatataacctgcctttctaaagtttcaaaggggatggatacccatcaggggcaaagatccaaatcctgagggtagaatgaggaggatgtatactaaagtcttttggctaaaaggacattgatagcccatttttagaatggctacagttgcaacccaactctaccccactgaacagcttttattaccagtatttacatgaccactttttctttacacctcaccctaccccaatatcttccttgggaaaattggtcagagaggtggtatactaacagtttggggaagggcagcatccttgcccatatttagaaaaatactttttcaagtgtcttctcccaagtaactcttgggacttttgttaccagtcaagtaggtacagtgagtttggcaaacaacatagtggcaaagtatcttctattgtgttactatgagagaagatctgcaaaaggattgaaaatcagcatccctcccacccattcttacaaagtaatcaggggaccctgtgccacagccattgcttgcccatataataccttgaatgaattagagattttccaccaaactccatttggcctcctcagtggtgggggagggtggcaatctgcttgacaactaacatgtcggccctgtcctggtctatccctaactagatgctaatacaaaggttgaaaatacagatataggtagtaatgaaaacagatttggctgggcacggtggctcacacctgtaatcccagccctttgggaggccaaggcaggtggatacttaaggtcatgagtttgagaccagcctggccaatgtgggaaaccatgtctctactaaaaatacaaaaattagttgggcgtggtggtgggcacctgtagtcccagctacatgggaggctgaagtggaagaatcgtttaaacccaggaggtggtggctgcagtaagccaagattgtgccactgaactccagcctgggtgatagagtgaaaccctgtctttaaaaaaaaatagattcaagaggtatccaggaggtaaaattgatgggacttggcaattttaagaaatgcaaggaaaaaggaagagtcaaggctgatgacctagagataacagcttggctaaggtacagagctgccattcaataataaagaataaggaagtctgagttggggatgaatgtaagttctgtttaggatgaactgagcttgatagccctgtgggatatccaggtggaacttagacctatacgtctagggcacaggaaagaaacctagcatcgttggaaatcctggagtagacacaatcatctgaagtatgtatactgaaaaagcagttgcttaggaaagaacccccggaacactgtccaaggaggagtgggggagagtatgggaagagaagcctgcaaagagatgcaatcatttacagaagttactgagactgccaatttactaccggtctctgctacaagtccatgagctcccaaagcagggatcctttttcataaccctgcattctcgcttcctagctcagtgccaaccctttgaattttcactgaactgaggagcttcctgagttacccttgtataccccaacctacaaaatgtctaagcattccctaatcccttactaaatttagttaattcttactttacctccccttctgctcaccaaaggctagaataataccaaatactaagcttatttttagagaaaatctagcaatcatctagatttccttatttaactttgatgctgctattctgactgctctcataactgctagtgaaacactgggtgtatatagataataggaacaaagaaggaaccaaaattgcaatgaagataaattactttgtgtgcatttacaacctgaccaccatccaattatacttttaattaagaaaacatgttttaagctgcattatttcagattatcagtgattctgaaaattacaagtggcagggtgcaggaccttaagtcaaatagacgttaagttcaaaccatcagtccattcgtcactagctgtatgtcttcgggcaaattattttacctctcagcctaatgtaataatgcaggtaacactgctcacgcggtgtgttgcacatagcaaacacttgggaacagttagctattcatcgtggtacattaaattgcttttccccaagagccactttatttatttattttgagacgaagtcttgctctgttgcccaggagtgcagtggctcgatctcggctcactgcaacctccacctcctgggcccaagcgattctcatgcctcagcctcctgggtagttggattacaggcacccaccaccacgtctggctaatttttgtatttttagtagagaaggggttttgccatgttggccaggctggtctcgaactcctggcctcaagtgatctgcccacctcagcctcccaaaatgctgggattacaggcgtgagccacggcacccagcccccaaaaagccactttaaaccttatcctaggaggacagtttcacattgcgtctaacctcttcctggcctcttaatcttgggttgttaaatcttatttgctttatttccttggttcctctaagttgtaatctcggagttaaaaacagctttagaaccccgcccccccaaaaaaaaaaaaaaaacttttgagaatttttttcaaataaatgtccattgcatagaatgggtctgtgactggctgcttctacatctgcacccaacatctggcccccttcagaactctgagtggacaggatcaggatttgactcaggaggattagaatgtgaagaatccgtgtttgagggattcagttctccaactgcctcaaagggtctcaagtttgcataagtcacctcctgggccagctgctccagggaaggacggcctaatatcagatttcgaagtgagatacaagtcatcaggaagctgaaaaacaggaaaaagccgaccaagttcaaactcctgtttcaccagaagaatttcagctaaagcccttagaaggcacctggtcctcactcctcccacacaggcatatatgggaatctccccccaagtgaccctccatctcccagctggaagggtacaccactctttatacagtctggtagaggattccaggatagggtaggaacagcccacagagaggctggagataagctgaggcagaacaagaaagcaggccatcagatataggccacttattcttccagtaaatcaagaagaatggcaggaaaagatacctagagctaaactgtcctttcctgtatgacagtctctagagttactctccccaggggaaagttaccaagcttgccaacatatgatggcaatgacaaatattgttgtgaacttacctgcggcgaaagacatagagctttcgcaacaagaagcggaagaatcgctcatggaaaggagtatttcgccggcgttcaatctcctggagcctttgttggcgtctaagaaaggtctgaaccagaggtgttggctcagggcccccttttacttccccttccaacagaggctgcagctctgggggtagaggccctgtttctgcccggaagacagaaaaaagaggaatcactgagatggatcactctctccccttagaactcctcttctgccagctagagacttcaagttcattcttgaatggctagaacatcattcataaccctgacttcttgaaaccagaggctatctcagcccaaatgttcatacactcaccacttccattctccaccttttcctttaattcttgcagatatgccaggtcttgctccagtgcaagctctgtagtgttgacatagacgtacatgtagcaagaagggctaggtgatgtcgtatacaccttatggtactcaccagcaggcaactgacaagggagaagaaatggataaatttcatcagcttttctctagccagcttatggcctccctactctatgactcttggcttctttctactcaattgtgttttggaatcgaaagtaacggacctctagaatcctggatgaggctcttcacagtcccaggggcccttgttttttgagctccactgcattactgctatggtaaaatattttcagtctataataagtgaatcttgctcatctaagctttctgccattgttttttaaattgttagagatggggtctcactctgttgctcaggctcactgtgaattcctggcttcccacctcagcctcctaagaagctgggattactggtgtgagctactgcactcagttctttctgctgttgttaatcccagcaaaatacctgcattttttctccctctcgaagagtctggttcttctgttctgccacaagctccacagtcacttccccctgcagcagctggatgctagtgttgcccaggtcttcactcacaaaattctccaagtgcagtcctgccagaccaacagagttcatcatcccaccccatggcagagtgaactcactcccagccagaacagagacatcacacctttaccaccatcatccccttaggtttcaaaaacattccctctcccctcccaccacatggaatgtccctggccaaggaagccagaaggaaagacagaaaagcctctcctcactttcctccataccagggaaatctgcaatgaagaccacctcagtgtggttgtctaggctgctcttgatttcctgtaacttggccctccagggagacaggtccatcaagagtggttgcacccaggatgtgcgctgaaagggtgaccaagcggcctgcacgatgtccacacgagggtcaaaaatccttaggaaagaaaaccatgttctaaggacatcacagccacccacccaccagaacttccagttctctccctttcatcatcattcctaaggacagggaatagaagaagaaatggcctgtgtcagcatgttattgccagtccagggcagagaaagaaggcagaagagatctggagcactgggtataatgggggttagtagctacctgagaaggtattatgtcaacagtgtctaaaagaacaagtcaactcacttttctcctggatgatggtgccccctgctggaagcaaccagctatgcccacaaccagatcaagggggacatgcactagaggaaggacagctttttaagcaagacaataccaggaagcaagggctgttcatcttggtaaaaagaactgtgcttcattttttcccactctctgctccccttgcccacctctgctggaagcggtcattgatggagacccaaatatcaaagtagatctggggctcagtgacattatacttgggaagcaggcggctcaggcaagtggcatattgcttcagcatgtctgcatgatccttccatcgccgactctgtgtaaatacctgccccaaacccccatattagtcccacctcatcattatcaacttccaagacatgtcatgcactgccaatggcacaacgagatccctgcctgctgcccattctggctagaaaaaaatggaacttgcctttgggaatgaatttttcattgttgggctagtggtgcttacttttcctgaatctaatctcagttcaaggaaatgaatgcattgccctatctcaacccacataaaagatagttcaatctggctcttgagaaaaggcaaagcagactcaaatttgttttgctttatggtgtgtgtaagacaaaaccagaccccaaagcacaagggggctctgaagaacagtaaattgtcagcatcagacatctcaccccagggttaaggtagcccagttcgccagtgcggccatcacggtaggtgatcttcacgtgctggtgggagcgggagtgcaccatcatgtcccaggaatagccatacagcccatttgtccagttgttatagccctgggaaggcagcacagaggggaatcagctcaatgcttctcacactgaccccatcccctaccaagaaggggctgcaaaaccagccccattctttcccaactattgtcatccgttcctttctaagtccagcctttgctgtacactccacagcccctacaaacctgggtgagaaaatgagaatagggcaggaatagctgctccaggaggtagagcagggtgaaggcagctcccagctgatggcgcagccctggcttctggccacttttgccccggctcctcttatacacacaggaaacactgggctgaggggctgccttgaggggcaacagttgttgcaaccttcgggggcagtaggacaccagcttccgaggccactcaggggagcagaagagagggctgctggccagcatgacgtaggagaacatacctaggaaagcagggagaaaatacatatttcaggagtttggctgggcctcttcaaccccgttcccttaggagacttctcccaggtgttccactgaaaaggaaagtagttcttcttttttttttgagacagtctttctctgtcgcccaggctggagtgcagtggcgtgatctcagctcactgcaacctctgcctcctgggttcaagcgattctcttgcctcagcctcccaagtagctggaattacaggcatgcgccaccatgctcagctaagtttttgtatttttagtagagacggggtttcaccatgttggtcaggccggtctcgaactcctgacctcaggtgatccacccacctcggcctcccaaagtgctaggattacaaacctgagccaccaagcccggccacaaagtagttcttaactgtaagatatttgttcttcctggagattccctactgtacaacatactaactgagcccagaagccccagtcctcttatccccatttatgcctacttcatagtgactgccctgggttcaatttagctcctgctcacaccaccctctcccactcccaaacaatgcctctggctagtcccttcctgcaaaactgtggttcctgtttcctcccaggctacaggtactgaccaatgctgaaaagctgggaattcatgcagtggaagtaggacacaaagaacagtccaatggatcttgagacatcaaaaaagagcaggaaaccagctgagaggtcaagcagcagcccaccccagtgcacgaccagcaggctagtcagctcctcagacaacagcagtctgcaaacacatggagaaagttcaagcaccagcccactggagaacacatcaaagcacattcacagcacgaatgtgccttggctactccagtggctgggtagatgcctaaggtacataatccacccatgaagacactcctctaggttgtttgttgttgttgttgttgttgttgttgttgaaacgaagtttcactctgtcgcctaggctggaaggcaatggcatgatcatggtgcactgtagcctcaaactcctgggctcaagcaatcctcctgtctcagcctccgaagtagctggaaccacaggcacgtgccaccacgcctagctgtttttttaaaaaatttttttgtagagacagtgtcttatattgctcaggctggtcttgaactcctgggctcaagcaatcctcccaccccagcatcccaaagtgccgggattacaggcatgagccaccatgcccagccccctctacattttcacacactttaggtgttcaatgttttctaacatatcctatgtaataagcaagggcagatctcctaggacaaaatttgactgagatgtgtgtgtgttgtggaagggacgttccccacggaggtcatgagtgagaggacactttaaaaggtgaatgcttggctaacatcataatgaagtcaaacttcaggaactggaaaataacagggaagaagaaagagaataaagtaaaacaagaggaaagaagaaatgggaagaagacaaatcagaaaggtgaccctttgttttgtggaagtgataataatggttttgtcagagcctgaacagtgagtgcccatcttctcagtacatcagctgcagggctctgatgggaggctagagtggcaaggcaaggacacaggcaccatccaaggcagctgctgagggcactggctcactcaccaagtcagccagttccggctctttcctttcctttttaaatttcttttcctttcttgcctatc

SEQ ID NO: 1141 - DNA, 29712 bp, Homo sapiens
tcccacccactctgggtcatcactgccttacaggtctgttccccagctacctagccaatggactatatgagctctgtgagggcaaggatggggctgttttggtcattgctgtgtccttggcatcacccatcacagggcagggcagagaggtgctcaggaaacagattagccaatcactcaggtttccatgccacagaggggagccaggtctcagcactttcacaccagtatggggcggagaggggtcctaggcaaagtgaccccaggacaaacaatggggtggaccccagggagaaacaggggtgggacacacaagtaatcctcacctccacggctcaaccactgccgcacaactccggtgacatcaaaagataaccactctggcgagtcgctgggtgccagcagccggttgctgaggtatcgccaggaattgttgctgtatttctagaggatgatgaaggcaggagagagacagtgggtagatggtgtcacgaccccacatacactaactgaatccttcaccccatctgcttccccaaacaggcttccagaaagttcccaggcactaccctctcagacagccacctgtgtggtcctgtggcacccatcctccccaacagtacccatgagaggaggggtggagaaaaagctcaggctgcggtcaagtcaccttcacacagctcagccgaaggtgttttcttgccttctcgaggcctgtttcctcattggtgaaatgctaagccccactcagcgtggacagcccacaatgctaaaattctgctgctaacattctgggccgggcgcagtggctcacgcctgtaatcccagcactttgggagcccaaggtgggtggatcacttgaggtcaggagttcaagaccagcctggccaacatagtgaaaccccatctctactaaaaatacaaaaattagccaggcatggtggcacacgcctgtagtcgccactatttgggaggctgaggcaggagaattgcttgagcccgggagacacagactgcagtgagccaagatcacgccactgcactccagcctgggcgacaggacgagacttcgtctcaaaataataataataaataaaataaaattctgctgcaaacattctggggtttactgagcatacggttctgcaaatttgacaccctgaattctcagtaacttagaagtcatttctaatgattccggctgggcacggtggctcacgcctgttatcccagcactttgggaggccaaggcgggtggatctcctgaggtcaggagttcaagaccagcctggccaacaaagtgaaacctcgtctctactaaaaatacaaaaattagccaggcgtggtggcacacgcctgtaatcccagctactcaggaggctgaggcaggagaatcacttgaacccaagacacagaggttgcagtgagccgagattgcaccactgcactctagccagggtgacagagtgagactctgtctcaaaaaaaaaaaaagtcattttgtgattcaaatgtttgataatatcccaagatttccacttctagagcctgagaagctttagaagactaatgttctataaacccaagagtctgccatgccgcacctagatgctgcaggtacccaacatctgtgtagaataattttctgggccaggcacagtcgctcacgcttgtaatcccagcactttgggaggccgaggagggtggatcaccagaggtcagaagttcgagaccagcctgaccaatatggagaaacaccgtctctactaaaaatacaaaattagctaggtgtggtggtgcatgcctgtaatcccagctgctcgggtggctgaggcaggagaatcgcttgaacccaggaagcaaaggttgtggtgagccaagatggtgccattgcactccagcctgggcaacaggagcaaaactccatcacacacacacacaaaaaaaagaagaattttctggggctggatagtccactccagggactgcagaataaagctgaattccccagactccaagaagccaagctaacataggacaaagttctctcactgtgaaagtctgaaatctaccatcctatgagttaacattccctctgatatggattctagctcatagaaactgctagagcctccagcccttccagatgccccagtcctcttggaagctccctatcttctagagcagtgctgtcctaaagaactttctggaaatgtgctttatctgcaacatccaaaatagtagctgctaaccacatgtgactatagagtactagaaatatggccagtgagaatgaggatttctttttcatttttatttttttgagacagagtctcgctctgttgcccaggctggagtgcagtggtatgatctccgctcactgcagtctccacctcctggggtcaagcgattctcccacctcagcctcccaagtagctgggattacaggtgcctgccaccacacctggctaatttttgtatttttagtagagatggagtttcgtcatgttggccaggctggtcttgaactcctgacctcaagtgatccacccaccctggcctcccaaagtgctgggattgcaggcatgagccaccacgcctggcctatatatatatatttttgagacggtctcgctccatcacccaggctggaatgcagtggtgcaatcacagttcactacagcctcgacctcctgggctcaatcaatcctcccacctcagactactgagtagctgggactagaggcacgcatcaccataacaggctaattttagtattttttgtagagacgaagtttcaacatgttgcccagactggtctcggactcctgggctcaagcaatctgcctgcctcggcttcccaaagttctgggattagaggtgtgagccactatgcctggccctaaatttttaatttaattttaaacaatttaaattttaatcaagctaaatgtgactagtggctgtcatattggacagaatgattctagagcccccaaccttttcagagattccaactttcaagaatcctgtgtccttaaagagtccaactcctaagattccagccttctaagtgtttaacatcctaggatgcaaagagtctgaacatttaaaagtgctctaggttccgggtgcagtggctcacacctgtaatcccagcactctgggaggctcaggtaggagaatcacttgagggcaggagtttgagacaagcctggccaacatgataaaactctgtctctactaaaaatacaaaaattagcccagcgtgttggcacatgcctgtaatcccagctactcgggtggctgaggcaggagaatcacttgaacccaggaggcggaggttgcagtgagccgagatcaccccattgtactccagcctgggcgacagagcaagactccatctcaaaaaaaaaaaaaaaaaaaaaagaggccaggcgcagtggctcacgcctgtaatctgagcactttgggagaccgaggcaggtggatcacgaggtcaggagatcgagaccatcctggccaacatggtaaaaccccatctctaccaaaaatacaaaaattagctgggcgtggtggcgcacacctgtaatcccagctacttgggaggctgaggcaggagaatcactggaacccaggaggcggagattgcagtgagctgaggtcataccactgcactccagcttggcaacagagtgagacactgtctcaaaaaaaaaaaaaaagcgttctaggattgtatggtttgtgttcttctatccttcagggaccatctaggtggaccttgtaaccagccgacccacagccacccccttggtcacagctcaccctctccagcccatgccctgaccttccttctggctcatgtcctcacctggtacagctccacgtgctgctccacttttaacttgagcctcagcagacgcagctctgcccgggagagcaacacgggttcaggtaccgcttctcggagctctgatgtgttgaagaacatatatatgctgtgtgtactctgcttgaacttgtcatagatttctagcagggagaaatgaagggaggcgatcaggggtttggcagaggtgaggggagctggtgctcccaactctaggagttttggagctgacagctctggggtggagtcagtctctgataccttttatttatttatttatttatttatttatttatttatttatttaaatgaatttttttttttttttgagacggagactcgctctgtcacccaggcttggagtgcagtggcgcaatctctgctcactgcaacctccgcctccagggttcaagcaattctcctgcctcagcctcccgagcagctgggactaaaggctcatgccaccatgcccagctaatttttgtatttttagtagagatggggtttcaccatgttggccaggatggtctcgatctcctgacctcgtgatccacccgcctcggcctcccaaagtgctgggattacaggtgtgagccaccacgcccagccctgactgtgatactttttagctgtgtgaccttgaggaagtggtttctccccctaggtttgtttcctcctctgtaaaataggtcctaaccacattcctctctcatgtagcatcatctctcaagtcgactaaggctggcaccaaggggaaccactctgtttgctctggccttccttgccccaaatgcaagagcccctaaaatgcagagtaaggatcaaaggcacaggctttggactcagatagtgcctctgctgcctcttggctgtgtgaccatgggcagttaacaccctctttctgaatgtcagtttcctgttattctttgaaaaacagcaataacattaagctccctgcattcccacacagactctcctaatttaagcgctgtgtaaccttgggcaagtgaattcctctctctgagccaggtgtaagacaagacagagtgactctagaacccattccagtattatagtgggaaattagatgacccaggtcaagccatgtggcaccaattctgcatacactggtcactcaatcatgtatacgtctaagagtgctggctgggcgcagtggctcacgcctgtaatcccagcactttgggaggccgaggtggattgattacttgaggtcgggagttcgagaccagcctggccaacatggtgaaaccccgtttctactaaaaatacaaaaattggccaggcatggtgccggacggctctaatcccagctacttgggaggttgaggcatgagaatcgcttgaacctgagaggcagaggttatagtgtgccgagattgcgccactgcactccagcctgggtgacagagtaagactctgtctcaaaaacaacaacaacaaaaaaccacaaaacagcgctatttaccagatgctatctaaagcactttacaaagatgaagacatttaaacctcacaaccttatactattattatacccgtttaatagatgagaaactgaggcaccgagattaagtaatttgccccaaggtcacatagctgcagactgggattcaaactcaagctgtctcattccagagactgtgctttttttttttcttcccccaagagacagggtctcactctgtcccccagacggaagtgcagtagcacaaccatggctcacggcaggctggaactcctgggctcaagggatcctcacgcctcagcctcccaatatgttgagatcacaggcatgagccaccacacccacccagctagagactgtgctcttaacccctaagtgattcttctacttatttttattattagttttccacccttaactcccttccccagctggttagggaaagtgaagttcattctgggtaggaatggctgtagtggggagaaaaggaattaaggtgttttcttttctttttttttttttttttttgagatggagtttctgtcgcccaggctggagtgcagtggcgcgatcttggctcatagcaacctctgcctcccaggttcaagcgattctcctgcctcagcctcccaagtagctgggattacaggcgccgcccgccaccccgcccagctaatttttgtatttttagtagagaccgggtttcaccatgttggccaggctggtctccaactcctgacctcaggtggtccacccaccttggcctcccaaagtgctgggattacaggcgtgagccaccgcgcccagccaaggtattttctagtttaggaaaagtttggggatggggatgagggaacaggccatgaactgctggatcaactggggcaactgcttccagcctcccatagtgggggtgtgaaaagagactggtgagaaaggcagaggaaacccctcccctacggcccccttcgatcctcctcctcctccccagtctccctccccacccagccccagtaagccctattcttggcccggaggttactcagcaaaccccaaaggaaaggcagagccttggctggggaagacagatagggaggaagacagagaggagggagaggaagggttggagggtgatgcagagagggagaggcggggagatgtcagagacggagacgaggcaacaggaccgtggaggagaaaaatagaaagggagagaaaatagtcggagagacaaaaaccaggagacccatgcgtggacagaaagactaacggagacgaaaagaaagaggcagatggggagacacgtgcgagacgagacacatgtgcatttgttggggagaagaggattggaggtgtcagtgttaaaggaacctctacaacgaaggtgaagccacggaagataaggtaaggctgagacttgggtgcggagtgcgcgtcattgggctggagctgtaaactggcgcagaaatgggcagggaacccgcaagcccacaccgcccaagagtcagtgaaacctgagggatcttccccaaggctctgaaccacgcgggacgcctgggtcctcgcatggatgccgacggggccggctgagtgggagccccgcccgtagctggggtgaggagggcgggaggcgccgcagccaggagggcggggaccagacctgccccgtctcgccccgggctccgcgagcgatccccgcctccgccgggggcatgggaaggaaagggaagggagggggatgaggccgccggacgctggggtttccccagccaccctgagaggaactgggactttggggtccagactgccagcgtttagcgcagcggggtcctcctgccccttggtggaagcgcaggctcctccccccgcgcgtggcacccacgtggggctttctcactcctcccagcttggttttctcacctcggtcttgtagagtcaccccccacccagcacttcccctgcggctggactccgctcagcccattcccctgcatcctgcggggaatgcagcgtggatggcgctgggtatctctcctcctccccgctcacaccacctttcccacgcctgtctcccctctcggtaaagcccttcccatgacccaggactctaggtcttctggaagctcgattcctccgctgggctccccactctgtccctcacgtccctgtgtgaaacaccgaggacacctctgcatcccgggcgccctcccgagtctccgctcctctcccgcttgcctcctccttccaataacctcccgtccctttctccccacatttatcacacgcacctctgtttctctttctacgactctcccccacccccgcatcccgcgtgttcctggcagcctctggaagtgggtccgctctcactttcctggcaccctctggggttgccttcatctagcttttctgtccttcttgaatctttccacctcaggacccccaagctctgggtcaactttctccagcgcctctcctttcccaaatgctggggtcttcgcttctcccacaccaggctcccttctctgcacctggcaccccacgacccccccccccattcaacgcgtcctggaagagggagccttctaccctccccctattgcttgtctccctctaggggactgcccccacgaccccgcatgtttctgtcgcactctagaagcggtccacttcgctatctcctcctctccaagaccagacacctgggtggtagggggctcagtgccatcctctttcggacacccccctcccaccatcacacgttccctttgccccggggtgtcctcttcctccagccagtttcttctgccagtcacttcctacccgtggccccggcactccggcgccccctgggggcccccctcccggctcccctgcccctccgagctcaccgttgtgggtttccaccattagcacgcgggtgacctccttggcgtagtagtcggcctcaggctcgggctccggttctgcactctccccggccacccggtcgcgggtgctgttgtacagggcgagcacggcctcgggcagcgggccgggcggcacctccccctggctcggggggctggcgagccgcagcttggacaggatctggccgcggatggcctcgatgcgcttccgcttcaccagctccatgtcgatagtcttgcaggtggatagtcccgcggccggccggccaggcgtcagcaccagtagccacagcagcggtagcagcagcggcagcagccgcagcccggagggcggcatgggggaggcggcgccccccggcactgccgagagcgcgaacagggctggtgtggtggggaggccccgcccctgcaggggctgggggtctcccggcaaaaggtaggagggcctcgagggaaagctgaggtcctcagggagaagggcgcagtggtggaggggaggcttggaccgggggtgtctcagtatcccacggaaataacctagatgggcgcgatctggtaccagaaggtgggtggtcttgaataggggatctgtggcaggtcggagagagatccgtctcctggaggagaaagggtctaggatgcgcgggggctcaggagacaggccggggatgaaggcggcgtgcagggggtgcgcccgaggtctggggaaaagtctttgcgggaggccgggtcggcgactcccgagggctggtccggaatgggggcgcctgagggacgccgtgtagggggcagggagggagcaagcgtccccggcggcaaagggaggcggtctggggtccccaagtcctgcctcctcgcggggcagcgtcgcgccaagaggtccccgcgcctccggctcccagcggcaacggaaaagtctcaaaagtttttttcctcttctcccgaccagctcgtccctcctcccgctcctcctccccctcctccccgcagtggcgggggcggcggcggctcgtctcagactctggggcctcaggctgctcctcggcgactccttcctccgctccgggccgaggccggccccgcgggcggctcagagccgggggggtgccccggacggggcgtcccccctgcccccggccggggccctcgctgtctggctgctccgcggagggaggtgggagggagatggcccagggcgcgaagggcggcggcggcggggaccggctgggtcggcagggggttttgaagccgcccccggccccacccaggaagcgcacggggcgggagcgggggcggcccccagggggagggcatgggggggctgggccaccgtcctcatctcgcgtgggcgggctccgaggggggtcccttcagccctgggggaaagggggcgggcaccccggctccgccccgcaaacagggtgctgcctcctggcggccaagcgccaccaaagcgggtgatccagatgcgctgtggctttgcgggcggtgtgggtcaccagagaaagaggaccaggcggagaaggcttaatccgggggatgagacacaggggagccgaccagaggagggggacccagaacggaaggagagtcaggctgggaaacaaggtaggagaagagggtctgtcaacatgggggcctccggagggtgtcagtgggaggagggggcaacaggacacctgaaggatggaagggtcaggaggcagacacctgtaagaattgctctcctttactgagcacctcccatgtggctaagcagcctcctgtcactcaacaccctgcgaccccatacatttactgtccccaatttacagatagggaaactgggcccagagggaccccgaggtcctagaaaggacagaagcggtgccatgccttagctggggtcagctctgacagtctctagagtctgtgctcttgaccactgtgccatcctcccccatcactgggtgtccggggtgtggatggtggtgacgttggaggcagagtccctcagcactccacgccgtagcggtcgaagttgcggagcagcaggccgatctccaggtgcacggtgccaccagcagctgtgtgcaggcgatagcggtcggccccactgtagatggtgtccccatgcagcagctgcggcccaccacccacgaaagcccgtgccaactgttctcgccaactgcccaggggccgccacgtggggcaggccagctggtgggtgcccgggctactgggcacatggcaaaatccatagcctgcaagctggcagcggccaaagctgtcctgggaccacacctggaaatggagccggggccagcctgcaggaaaggagagagaggggaaaggagggatgggtggggaccagactcctgctgattccccactccctgatactcactggagaccccaggcccagtcttttcctctctgggtttctgtcccagagtttccaacccagcctcctttctaggctcccaccgtcttatctatccccacacagcagccaaagtgatctttccaaatccatgttactcccctgctaaggatccttccatagctccccagtgccctcagtataaagtccaacctcttcaacattcaaggcccttctaatcagacctctgctgaatttcctctctgtgttatcctcctccatgaccccatgtcagggcagcccattgctcctccagtccccaggtaaccatcatgggccttgtcagggacacctcctgccttccctcatgtccctgccctgctctctttgggcccagggccttctttcttgcccctctctaatccaccttccacctggcatctggaagcatctttctctccttccatagctttgcccatgtcctcagaacacagttcagctcctcagtctggtagtcaaagcccttggagatccagccccatctcatctcatgctgatcccttctcctgtgctagactctgttctagctagctggggacacggcagacatgaacatggatggcagacaaaaattcctgcccccgtgaagctgatatcctagacaacgaatgtagtaaataagcaaattatagggtagatcagatggtggtaattgctgtgagggaaaacagagctgggtagggtgagggtggggataccgctttagcaagaaggggatcaaggaagcttcattaagaaggtgacatttgagcaaatgctaaaaggaaggaagggagtaggccatgtggccatctagaggaagagtgctcctagccagagggaacagcaagtgccaaggccctggggggggactgtctggtggggacagtatggctggagcccagacggagtgtgcctggtggggacagcatggctagagcagaatgaggtggggagacgggaaggaggtgccagcctggttgtggagagccttgtgatgcatgctaagactatggctttcaccctgagtgagatggggaccattggagggttctgagcagagcagagatgggacctgacttaggtgttcacagggtcccagctgcatgtggggtgcagaccaggggggttggggaaggggactccagagacaagattcttgtcatagtccatgtgagagaagaacttggacagatcaaggtgctgggcgagaaaagggtaagaagtgggatttaggatgtatttcaaaagtagaggcagtttaagatttcctgatggacaaaatgggggcttgagaaaagagaaagcaaggctggtgccaccactgggggactggaggccccaagagctgaaaggttagagctgcccacctcacccacacagcaccggaaagattttttttttccccagctccagcttaaaagacagaaagattatttaaaagtgaaatctcagccaggcgcggtggctcatgcctgtaatcccagcactttgggaggccgaggcaggtggatcacctgaggtcaggagttcgagaccagcctgaccaccttggtgaaacgccatctctattaaaaaaaaaaaaggcaaaaattagccagatgtggtggcacgtggctgtagtcccagctactcgtgaggctgaggcaggagaattgcttgaacctgggaggcagaggttgcagtgagctgagatcttgccactacactccagcctgggcaacagagtgaaactctgtctccaaaaaaaaaaaggtgaaatctcacttgtccattacctgctctggctcccaagtgccttcaggagatggcctcagctcctcagcctggcactcaaggccctgcatggcctgtccccttctgcctttcccctctgccgtcccgctctccctcaatccactagatgcccttggctcactttcccctttgagtcttccacgtagctccctctgcctagaaccttcttctatccctctgccttattagctccgctggcccttcacagcaaagttcagaagccccctcctccaggaagccctctctgacctccctgacagagtcagccacttcctctgggctcccacagcctctccaaatcacctatcttagtcctgcccactctgaggtgccactgtctggagagaggtgtgtccccccataggacggtgaaccctgtgaggacaaggctaagggacactgccttgatcctcaatgtctccctggcatcacccaacacaggctggacacagggcaggtaccaggtagacgttctttatattggtgaaatatatggcacatttacctaggcaatttctcagaatcaactcatctccaggaacccacattttctactagaaaggctttctgatgccgctcctcccccagtactgatttcccctttgagcagcagctctactttcaagccgaggagcccttcctggagaaacagcccttgcctctctcagaccctgcctcccggcttcctctttattggagactctcgttttgtctctttacttgaatgccacctcccctcccaccctgaccccccaccttcccacctcctgctccaccctggcctctgccctaatcatacaaacttgggatcgcctattgagcaggcctgggaaggccttagctcagcctctccagggccagacttggctgcaaaagggacctacgtggtatggggagcagggacaggtcttggtgttcccagccccagggacctcagaggctactggccccctcccctcagcctggacccgggtccaggtgtgatacccaccttgaagacctttggtggcgaagtgcaggtcgatggggtgggaccagtaagccatgtcccctatctgcggggtgtccacttgcgtttggccctcccgcacgcctgacaggagcttccatgccgcccctgcagtgagagccgggacatagaggggtgggaggcagccatcgggaaggggatgccgctgtggctataggactgtttctctgtggcatctactggtaggggttacgaagcatggactctggaaccaagtatctgggttcaaatcctggcactacctcttcctgcctctgcaaccttgggcaagttagctttctctgccttggtctccccatctataaaatgagctgagtaataatgcattcctcattgtcttcatttgttttctgttactcttaacataatatccaaaactggataatttataaagaaaaggaatttctatctcacagttataggagactgaccaaggtggaggagccccatctagtaagagccttcttgctggaactcttcagagagtcccaaggctagtgtgctaacatgccactcacgtctctctctctcattttataaagccaccacttcctctcccatgataacccactaatccattaacccattaatccatgaatgggtaatgagcatagtgagcacgggataagtcttcaatatcattttattacgattctcaccccatattttcaagcctagtccaaggattaagatggggccaagggtaccctccaggagcgcatcctgaaacacacataacaatttcgatcctactgaggggtgataatgatagctaaaatgcactgagtggtaggatacagtggctcacacctgtaatctcagcactttgggaggccaaggcaggtagatcccttgagtccaggagttcaagaccagcctgaccaacatggcaaaaccccatctctacaaataatataaaaattaaggctgagcgcagtggctcacacctctaatcccagcactttaggaggcttaggggggggtggatcatctaaggtcaggagttcaagaccagcctggccaacatggcaaaacctcgtctctactaaaaatacaaaaattagtctggagtggtggcaggtgcctgtaatcccaggtactcgggaggctgaggcacgagaatcgctggaaaagctgcagtgagccgagattgcaccactgcactccagctggtgtgacacagtgagactccatctcaaaaaatgaacaaacaagccaggcgcagtgactcacgcctgtaatctcagcactttgggaggctgaggcgggctgatcacctgaggtcaggagtttgagaccagcccggccaacatggcgaaatcccatctctactaaaaatacaaaaattaggatgggcgcagtggctcacatctgtaatcctagcactttgggaagccaaggcaggtggatcacttgaggtcaggggttcgagaccagcctggccaaaatggtaaaactctgtctctactaaaaacacacacacacacacccacaaaattagccacgtctgtaatcccagcactttgggagactaaggcaggcagatcacaaggtcaagagatcgagaccatcctggccaacattctgaaaccctatctctactaaaaaaatacaaaaattagctgggtgtggtggcgcacgcccatagtcccagctactcaggaggctgaggcaggagaatcacttgaacccaggaggcggaggttgcagtgagccaagatggtcccattgcactccagcctgggcaacaagagcgaaattccatctaaaaaaaaaaagaaaagaaaaaaagaaaatgcaccgagtactaactaaatcccagatgctatgctaagtactttaagcatccattcatttaatccaccctctaggactcttaatcccctcctcaccccccagtttacagaccctccaccatggcccacgtggcctggctcttgctcccctccctgagttcatctcccatcactctccccctccctcatcaccctctggcctcactgtcccacttctgactccccacctcagggcctttgcactggctgttccctctgcctagaaagctctgctcctgggtgtccccatccctagcttttgttttcatccttcagggcccagctcaagtgccacttccacagaggggttctccctgaccctcttcaccaaacactagtccctgccacatcatttcttttcatcctagcacttaccactgtctggaatcacggtgctcctttctttttttgggggggtggggggagacaagatctccctctgtcacccaggctggagtgcagtggcacaatcacagctcactacaaccttgacctcccaggatcaagcaatcctcccacctcaacctcccaagtagttgggacgacaggcacacagcactatgctttgctaattttttatttatttgtagagacgggggtctcactatgttgcccaggctggtctcaaactcctgggctcaagtgatcctcctgctccagtctcccaaagtgctggcattacaggggtgagtcaccacacccaactgcactcgtttatctgtttatttattttattttatttatttttttttgagacagacttttgctcttgttgcccaagctggagtgcaatggcaccatctcggctcactgcaacctccgcctcctgggttcaagcgattctcctgcctcagcctctcgagtagctgggattacaggcacacgccgccatgcccagctaattttttttgtatttttagtagaaatggggttttaccatgttagccaggctggtctcaaactcctgacctcaggtgatctgcccgcctcggactcccaaagtgctgggattacaggcatgagccaccgcgcctggcctgcttatttattttctgtctcccctactgtatggcccaggaaaacagggaccttgcacactgctggatccccaagaccacaaacccagctcttggtatacagaaggtgctcaataaatgtttcttggacaaataagtgatcctaggaggtgggagctaatataatccccatttaacaggtaaagaaacaggctctgagaaggtgagttcatgaacatttattcagcacctgctatgtgccaagcactgttttccatgctggtgacatagcagtgactatagcagaccaaggtcccatcatgggactggattcagactcagctctaactgcagagcccaagcctttcatccaactgcctcagtattcttggctggatcaacatccccagcaactccctgaaataataaaaatcaggttagtcattactcccttctgggctgagttgagggaagcaccaggccctgcgtcaggctccttaaaagcaagatttcccaacagccctatgaagaacaaatgaggaaactgaggctccaagaggggacagcctctgcccagggtcacagagaaggtgagtggtccaacctggaaaccaagtctgactccagagcctgcccctcatccatcagctggagggttccgatttcctgggaatttcaacttccacctcacttacctgtagaatcaaaaaggacccaggggccaggcgcagtggctcacacctgtaatcccagcactttggaaggcctacgcaggcggatcacttaaggccaggagttcgagaccagcctggccgacatggtgaaaccccatctctactaaaaatacaaaaattagctgggtatggtagcgggtgcctgtagtcccagccactcgggaggctgacataggagaatcgcttgaacccaggaggcagagattgcagtgagccgagatcgtgccactgcactctagcttggctacagagtgagactctgtctcaaaaaaaaaagggccaggcgcagtggctcacgcctgtaatcccagcactttggaaggcctacgcaggcggatcacttaaggccaggagttcaagaccagcctggccgacatggtgaaaccccatctctactaaaaatacaaaaattagctgggtatggtagcgggtgcctgtagtcccagccactcgggaggctgacataggagaatcgcttgaacccaggaggcagagattgcagtgagccgagatcgtgccactgcactctagcttggctacagagtgagactctgtctcaaaaaaaaaaaaaaaaaaaaaagggccaggcgcagtggctcacgcctgtaatcccagcactttgggaggccgagatgggcagatcacaaggtcaggagatcgagaccatcctggctaacacagtgaaaccccatctctactaaaaatacaaaaaaaaaaaaaatagccgggcatggtggcgagcgcctgtagtcccagctatgcaggaggctgaggcaggagaatggcatgaacctggaaggctgagctagattgcaccactgcactacagcctgggaaacagaacgagtctcaaaaaaaaaaaaaaaaaaaaaaaagggactaggactcaggcctgaagacatgataatgccaaatggccacatctgtttcatagacattcatctgtgccacgcaacaacataccccaggctttacaaacaagaccccatcaaagtcttgtataagccaggcaaacactgaatgagcacttcctattccagccctattcctattctaagtgctgttgatactcgtttagtactcatgacaacttcaacaggtaaatatttctatgactctcattgtacaaacaaggaagtcgaggtgaagagaagtgcccaagttcacataatcagcccaagggtgccttaacaagcaataactggttttgaacccaggcagtctgtgctcttaacctcaaacctgtgctgcttcttagctactattagcttcactttgaaacaaggaaactgaggctcaaagtggtcgagtccaaaggtctccaattaataggtgggggagttaatatttaaatgcagatctggcagcccatgaccctaaccattacactataccatgactctatagggcctcagttggggaagcatgaacaaaattactttcctgggacgtggcggctcacgtttttaatcctagcactttgagaggctgaagtgggtggcctgtttgagcgcaggagttcgagaccagcctgggcaacatagcgagaccctgtctctacaaaaaataaaaaaaattagccagatttggtggtgcgtgtctgtagtcccagcttctcaggaggctgaggcgggaggatcactagagcccgagagttcgaggctgcactgagctatgatcacaccaccttactccagcccgggcgcagagagagaccctgtctgtatcccacccctcacacacacaaagatgggagcttgagactcatgtggacagggtgtgggctgggcctggagtactgagaactgatggaaatgaggttaagagtctgcgttaaggggtggaggaaggagcatgtagcctctaggctaggggtcttggtgtggaaatgaaccaggcttgggggaatacctgtgtgaatgccccacttgcagaagaggctactttccgagaaaccgctggcccctatgatctgcccgatcacgtgcacctcagccatggccctgggaggggaaaaatataatcacaaccctgtgaggtaagtgtattatctccatttgacgggggggaaactgaggcccagcaagtaaagggtagtactaggattccaagctagcttcgtcacacccctgaggctgaggtcttgaccacagatcctaattgccaacccatgaaagcctggaaaaaatggggggacccttgtctggggaaccagcatttaactctgggaagtccaaaataaccttttcgggttcaggtcggcggaaagccccgcccgaaggggctatggctccgcccacgagcgcaaaagacccgccttccgcgtcacgccagccaccccgcttccctcccccagcaagctccataaggcgcatgcgttatgagttcaggtccgacttaaccccgcctctaagcgcagcgcatgcgtcattcctaccttagcgcacttaacggttaggagaggagaaagcggcaaccggggttgtagttcatgggcttgactgcttcttttctccgcgggcgccgaccaggcctggctcgcgcctctcccaggacccgcctggctgcgagatatgtaagccgcgatacttccgcgaccgcgctcgtcttggtttccgtggttgttgctggggcaacagcaggctcctcccctagctttgtactcgctctgcgcgctactaattggtgctagccgtctgcggggggcggggtgaagctgtgatggacattttcctcctccgctccattttgggaaaatagcgtctctccagctacggcaaagggttccgccattttgggcgtggctaggaagctgccatgttgagtgtggctgaggaagtttgagtgcagtttctcccagataccttctttaccaaaaaagcaaatccctaactgctccgtgctgcgcctaccccaccgaagagctctctgtggtccgggatcacaaatcagagattgaaccaggaccaagggggaattccttccaggacctcgtgtacatccccggccttgtaactggaaaacaaagcaaaaaaatcactcctcattcagagagtggagaagttggggagtgggttctgcttccgttttagagttcccctaggtttctcaaggacaaggaaggaaggaagttggataagtccaacttccttctcggagctactaccaagttcactgttactgcttgattctgagcaaggagcggttggggtagcgaagagaaatgaggaactaagattcccttatttgcagaaaatcctctttcctattgattgatttatcaatcaagaaatggagatgttgtccctggatgccatcctagatgccatcatttcccacatcaagccagtcatcaggtcccatcaaggctccttaaaagggtctcactctgtcacccaggctggagtacggtggctcgatcacagctcattgcagcctcttaactcctgggttcaagggatcctcctacctcagcctcccatgtagctggtatcacagacatgcaccaccacggctggctaattcttttttttttttttaagagatggagtcctgctatgttgctatgttgcccagtcttgtcttgacctcctgggctctagctatcctcccagttctccctcccaaactgccgggattacaggcgtgagccacccagccaggccaatagatacaaagtatttacaagctaccattggctaggcgcggtggctcataactgtaatcccagccctttggaaggctgaggcgggaagagctcttgaggccagaagttcgaatatagggagaccccattaataatgcatatatcaactagtgaagtattccattgaattgtttaatataaatgttatcctattgaaatgttgtaccctcgttataattttggttttttactttttgagatggcgtctccccctgtcatccaggctggagtgcagtggtgcgatcccagctcactgcaatctctgcctcccgggttcaagagattctcctgcctcagcctcccgagtagctgggactacaggcgtgcaccaccacacccagctaatttttgtatttttagtagagacgggttttcaccatattggccagaccggtctcaaactcctgacctcaggtggtccacccgcctcagcctcccaaagtgctgggattacaggcgttagccaccgtgaccggccgggtttttttttttttttttttttttgacagagtctccctctgtcgcccaggctggagtgcagtggcatgatctctgctcaccacaacctccgcctcccaggttcaagcaattcttctgtctcagcctccttagtagctgggattgcaggcacccaccactatatctagctaatgtttgtgcttttagtagagatggagttccaccatgttggtcaggctggtctcgaactcctggcctcatgtgatccttctgcctcagcctcccaaagtgctgggattacaggcatgagccacctcgcctgggcccagctactttttgtattttcttttttattttatttatttacttttttttttttttttttttgagacagaatcttgctctgttgcccaggctggagtgagcctctgcacctggcagaggtttcacttttaaatgatctttctgtcctttaagctggagctggggaaaatgtatttatttatttatttatttctggatgctgtgtgggtgaggtagacagctctaacctttcagctcttggggcccctggtcccctagtggtggcaccagccttgcattctcttttctcaagcccccattttgtccatcaggaaatcttactgcctctacttttgaaatacaccctaaatcccacttctcacctctttgtcgccctgcaccttgatctgtccaagttcatctatcacctggactatgacagggaccttgtctctggggtcccctttgccaacccctctagtttgcaccccacatgcagctggaaccctgtgaacacctaagtcaggtcccatctgctcagacccgtccagtggtccccatttcactcagggtaaaagccaaagtcttatcatgcatgacaaggctctccacaacctggctggcacctcctgcctcatttttgtatttttagtagagacggggtttcgccatgttggccaggcaggtctcaaactcctgacctcaggtgatctgcccaccttggcctcccaaagtgctgagattacaggcatgagccactgctcccggctgaggtcttcattctgaaggctcccatgtatacatgttaaataaaagaaaataaattatcgtcaactataaataatgagattcagaaaatatgattgaggccggattcggtggttcatgcccgtaatcccagcactttgggaggccaaggagagtggataccctgaggtcaggagttcgagaccagcctggccaacatatagcgaaaccctgtctctactaaaaaataccaaaactagatgggtgtggtggcacatgcctgtggtgtcagctatttgggaagctgaggcaggagcatcacttgaacctgggaggcagcagttgcagtgagccgagatcacgccaccgcacttcagcctgggcgacagagccagacttctactctcaaaaaagaaaaaaaagaaaagaaaggaaaatatgattaactatagagtttattccaggctacaggaccagtacatatgttacaacagtttcattagtacatcttgctatgctgcagggaagattgcgttaacattctgataggaggaggagtactctttctttctttctttctcctttcttttttcttgagataagatcttgctctggggctgggcgcggtggctcacgcctgtaatcccagcactttgggaggttgaggcgggcaaatcacgaggtcaggggttcaagaccagcctggccaacatgatgaaacctcgtgtctactaaaaatacaaaaattagctgggcatggcggcgggcgcctgtaatcccaagtactcgggaggctgaggcaggagaatcacttgaacctgggaggcggaggttgcagtgatctgagatcgtgccattgcactccatcctgggggacaagagtgagacaaagtctcaaaaacaaaacaaaacaacaacaaacagatcttgctctgttacccaggctggagtgcagtggcacaatcacagctcactgcagcctcgaacgcccaggctcaagcctcctgcctaagcctccccagtagctgggactacaggcgtgtgccaccatgcccagctaatttttcaataattttttctgtagagacatggtctcactctgttgcccaggcttgtctcaaactcctgggctcaagtgatccacctctgcctcccaaagtgctggggttacagatgtgaggccacaacacccggcctaggagtaatgttctgaggtgatcttatctctggcactgcttggtcattcttaatcatttacaggaaaaagcagaagttgtaactgcatgctacgtgactcaggctacatagcaacattcctctcaaggcttggaataatttaaagttccaacagctttaagtttgaattatctaaccacattatcgaaagttggccaggcctggtggttcatggctgtctgtaatcccagcacattgagaggccacagcaacaggatcacttgaggccaggagttctggaccagactaggcaacgtagtgagaccctcatttctacgaaaacgtttaaaaaaaaaatagcagggcatggtgacacatgtctgcagtcccatctacttaggaggctgaggcaggaggatcccttgagcccaggagtttgaggctgcagtgagctgtgatcatgccaaggtacttcagcctgggtgacagagtgaaaacctgtcaccttttttttggggggggtggttattgggtttttttgagacagagtctcgttctgtgggccagggctcacagcaacttctgcctcccaggctcaagcaattctcctgcctcagcctcccaagtagctgggattacaggcatgtgccaccacacccgggtaatttttgtatttttagtagagacggggtttcaccatgttggccaggctggtcttgaactcctgacctcaagtgatccacctgactcagcctcccaaagtgctgggattacaggtgtgagccactgtgcccggcctgaagctgttttaaaatatatccacaaatgcttgggcagccccctttcagtaagtggagcctaattctccttcccttcagtatggctagtttttgtaatttgcttctaaccaatagaatatggggctgggcacagtggctcacacctgtaatcccagcactttgtgaggccaaggcgggcagattgcttgaatccaggagtttgagagcagcctggacaacatgatgaaaccccatcactacaaaaaatacaaaaaattagctgggtgtggtggcatgcccctgtagtcccagctactctggtggcggaggtgggaggatcgcttaggttgagagttggaggctacagtgagctgtgattgtgccactgcactccagcctgggcaactgagtgagaccctgtctcaaaaacaaaatgcttttaagccaagtatggcacacagccggcggtcccggctacttcatttttgttgttgttgttgttttgagacagagtttcactcttgttgcccaggctggagtgcaatggtgtgatctctcctcaccacaacctctgcctcctgggttcaagtgattctcctgcctcagcctcccaagtagctgggattgaaggcacctgccgccacgcccagctaattagtagagatggggttttgccatgtatggccgcgcctggccatcccggctactttggaggctgaagccggaggatgccttgagtgcaggaagtccaggctgcagtgagctatgatggcaccctgcactccagcctgggcaacaaagtaagactgcacctctaaaaaaaaaaaaaaaaggcccggtgcagtggctcatgcctggattcccagcactttgggaggccgaggcaggcagatcacttgaggtcaggagttcgagacaagcctggccaacatggtgaaaccccatccctcctaaaactacaaaaaaaatcagctgaacgtggtggcgagcgcctgtagtcccagctactcgggaggctgaggcacgagaatcacttgaacccaggaggtggaggttgcagtgagccgagattgcaccattgcactccagcctgggtgacagagcgagactctgtctcaaaataaataaataaaaataaataaataagccttttaattgtggtaaaatacacatttaccatcttaactgtttaaaactgtattgttcaatagtgttaagtacatttacattgtgcaaccaatctccacaaccattttcatgttgcaaaactaaaatttttgcaaagtaaacacatttttgaaacaaaacaactcccctattcccccctcttctgcagctcctggtaatcaccatcctattttctttcaatgtatttattttactttatttatttatttattttttgagatggagtttcactcttgctgcccatgctggagtgcaatggcatgatctcagctcaacgcaacctctgcctcccaggttcaagtgattctcccacctcagcctcccgagtaactggtattacaggcatgcaccaccatgcctggctaattttgtatttttagtagagacggggtttctccatgttggtcagactggtctcgaactcctgacctcaggtgatctgcctgcttcggcctctcaaagtgctaggattataggcgtgagccactgtgccccacctatttatttatttttattttatttatttatttatttatttatttatttgagacagagtcttgctctgttgcccaggctggagtgcagtggcaccgtgtcagctcactgcaacctccgccttccgggtttaaccgattctcctgcttcagcctcctgagcagctgggactacaggcgtgtgccaccttgtccagctaatttttgtatttttagtagagacggggtttcaccatattggccacgctggtctcgaactcctgaccttgtgatccacccgcctcggcctcccaaagtgctgggattacaagcgtgagccaccgtgcctggccacctatttatttttttgagaggaagtctcattgtgttgcctaggctgtggtgtagcaacgtgatctctgttcactgtaacctctgcctcctggcttcaagggattctcctgcctcagcctcccaagtagctgggattacaggcatgtgtcaccacgcctggctaatttttgtatttttagtagagacagggtttcaccatgttggccaggatgtactcgaactcctgacctcaggtgatcagcccgcctcggcctcctaaagtgctgggattacaggcgtgagctaccgtgtctggcctgttttttattttttttgagacagggtctcgctctgtcacccaggctggagtgttctggtgagatctcagctcaccacaacctctgcctcccaggttcaagcaattattgtgcctcagcctcccgagtagctgggattacaggcatgcaccatcatgcccggctgacttttgtatttttagtagagacggagttttgccatgttggccaggctgatttcgaactcctgacctcaggtgatctgcccgccttggcctcccaaagtactgggattacaggtgtgaaccaccatgcctggcccactatcctctccttccttccttccttccttccttccttccttccttccttccttccttccttccttctttccttccttccttctttccttcctccctccctccctcctttctctctctctctttctctctctctttctttctttctgttgctctgtctccaggctggagtgcagtggcacaatcttggctcactgcaacctccacctcctgggttccagtgattctcctgcctcagcctcccgagtagctgggactacaggcgcacaccaccaagtccagctagtttttgtatttttagtagagatggggtttcaccatgttggccaggatgatctcgatctcttgacctcgtgatcggcctgcctcagcctcccaaagtgctgagatcacacgtatgagccactgcacccggccactatcttattttctgtctctgtgaatgtgactactctaagtacgtcatgtaagtggaatcctacagtatttgtcctcttatgacaggattatttcacttagcatagtgtcctcaagggtcatccaggtcatagcatgcaacaggatttttttccttcctgacccccctttttttgacttggagtcttgctctgtcactcagactatagtgcagtggctatcacagccactcctggactcaagtgatcctcccacctcagcctcccaagtagctaggactacaggtgtgtgccaccgtgctcggctaatttttttttaagttttggagagagagggtggtctcagtggctcccgcctgtaatcacagcactttgggaggctgaggcagtagggggcgggggtggggatcacttgagggtaggagttcgagaccagcctgggcaacagggtgaaaacctgtgtctactaaaaatataaaaattagctgggcatggttgtgcgtgcctgtaatcccagctactcggaggctgaggtaggagaatcacttgaacctgggaggcagaatttgcagtgagctgacattgcgccactgcactccagtctgggcaacagagtgagacttcctttaaaaaaaaaaagttttgggagagatgggggtcttactgtgttgcccaggctggcctggaactcctgggctcaggcaatcctcctgcttcagcctctgggattacaggcatgggattacagtgctgggattacaggcatgagccactgtacctggccagcactttattttattgttatttattattattactttgttttttcataacattgatgttttgaaggttataggcgacctcctttgtagagtgtccctcattttggctttgtctcatgtttcttattattagatttaagttatgcattttggcaggaaaaccaaagaaatggtatgtgtctccctctttgcttcagaccagaggcaactaaggtcaatttgtcctgttaatggtgatattaacttgtatcatctggttaacgtgatgtttgccaattttctccattaatttttttttgttataataagtaatctaggggaagctactttgagactaaataaatatcctgttctttatcaaatcagattttcacccaataacttaatagtttcagtctctgttgacaatccttgctggaatctcgtgatcttttgtttttgtttttgtttttgtttttgagactgggtttcactttgttgcccaggctggactgcagtggcacaatcatggctcactgcaacctccacctcctgggctaaaccaatcctcctatctcagtttcccgagtagcttggaccacagacatgcatcaccacacccagctgattttgtttattttttgtagagacaaaatttcactttgttgccctggctggtcttgaacttttgggtttaagtaatcctcccaccttggcctcccaaagtgctgggattacaggcttgagccaccgtacccagctggaatctcatgtttaatattccagacctgtcacaaacactaagaggtgtagcctcttagactgtacaaggctaacggcagccagagagctctcactggaagtgaattaatctctaggatggcctagagggatgaggggacccacagagctcaatgatttggtgaaaaactgaggctggaggctgatgggaatttatgcccccatcccacacatatgtaataaagacccactttgtgccaggcactgttttaggccgtgaggcacagtagtgaaaaaacgagatcaaatctcagcccttgttgtgccgacactgatgtgggaggattcaaactacaaacaagaaaaatacatggtatgtttaaggccgggtgcagtggctcacgcctataatcccagcactttgggaggccaaggcgggcagatcacttgaggtcaggagtttgagaccagcctgggcaacatggtgaaactccgtctctactaaaagtacaaaaattagctgggcatggtggcaggttcctataatcccagctacttgggaggctgaggtgggagaatggcttgaacccaggagatggaggttgcagtgacctgagatcgtgccactgcactccagccttgctgactggggttttgctatgtcgcccaggctggtttcgaactcctaggctcaagcagtcctccctcctcggcctcccaaagggctgggattacaggcgtgggccaccgcacctggcctacagtatgcttcatagaaatatgaaaagaatgagagcaaggttgagatagaaagtaacagggcatccctcctgagtaaaacaatcctgccccctcacgctctcgtctaccctcccgtgggtctccctgcttctgtcgtctgccagaaactggct

SEQ ID NO: 1142 - DNA, 49546 bp, Homo sapiens
tggcctctaacagcttgcatattgggcgtggcagctgtgtgtcagtcgggagcaatgttcatccctgggggccctcaggccatctgctggtttgctgggagggcagcttcagggcccaagacagccatgccccagccagggctcacattgccacttccacattcagtgcccacagctggtctcccacttggcccagggtctaacagagccaactgcccctcgtctcaaaggacggggcaataccagcaatatagggagacatgtttgttacaaacattcaaaccaaacagaaacacaccaagagcatttagcccttttcctaattcctctccccatctcaatccattggtaactttggagtacatctccaaacagacaacactctgcaatttaaatctgtatagttacagaaacatatacattgtttgcttttatgaacaacagtcaaactcctggtatatcatcaaatccaggactaccattgtcaaaatcactttatgctctgctaagaaagcaaaaatactgccatttattcctgtaagatcccaccaattttgtgataatcctgatgttagggaggttaatatgtgaaagtactgtgtcttagaagtgactaaatctgccacatatgggcagttttgcagatggccctctttggtcaacattctgcctggacatgtcagcacgtacacagcttcctacttctgtttaatggctgcttggcattccacagtataaacataacaaagtctggagagtcacctccacctccccagtgacagacattaacttctttccacatgctgcaattctataattcaactgtataatgaatactcctgcatgtgtgtatgtttgctaacgtgcaaactagttctatgggagaattccctagaagtgaagtttctaggtcaaagggcacattttaaatttaagtagaaaccaccaaattgtcacctccaaaggaccttcccgggcaccaactcaccaatagggcatgatggcgctgtctccctagaagtcactcacccgggacgttgcacacctgagaggcaaaaaaaaaaaaaaaaaaaaaaaatcagacttcatgttaatttgcatgtcccagagttctattgggctgagcatgttttcacaagtgggttgtgtttcatcagtgaagcatcattcatagtttcatccattttcctcattgcaccaactgagttttcctcgttggtttattgtcaatctttttttattattattattttgtttgtttattgtcaatcttttgaaaacacgggtactaaccctttgtctttcctattataactatgccccttctgttcctttatcagagtgtctctgaagcctgtttaatgcactttccaggaagcagcacatgtgatgcctcgacacctgtcacccagcacattgtggcaacatactagtctcatctcaaataagactctgggcttcttccaggaatcagacgaagtttcaagaaacacttcacaggatcaggttcccctccagaattctaggctaaaggagcccgtctgtgccttagaaaccaagacctgtttccctcttgcatatggaccagcagcctttgctataagcactcagcggccccagcggaggctggaccgaggtgtgagcttcacatttggctctgctctggatgctgaggttacatgacagtgccctccttctgaaagtaacacacccccactctgtccatggtaatattatcagccagcaattttgtttccaaataaactgaaaagccccatggatgaaagtgatgtcatcctgatggtgcctgcattgccacctacaggagtgtctgccaatgaccgtgcacctggaggtttgtgtcactgagcggccagcatgtggctgaggtattaggctgccgctcctttcccaaccactgaatcctgtccaaggttgcctagggcatcccgccctcactgataaccctttcctgagcaaaacctccctcaaggatgcaaacagatgccattcagaacagaggccaacaaacgcaacaccagttctttggggcccttgtgtggtgagcactaatgcttgtgattaaagaggatatctgaatgagcatggaaaatcccagtgctttctcagtaatcactattaagatgaaagcataatgagcacattataacaactagcccagaacaactatgatagtaacaatcaacatattcacttcgtttctcttttcttattttcaaaatatgtatttcaggtttataaagtgagccatatacacagatagttctcgttccatgagcacctatgtgctgggccctttatatgggtattatctgcacaatatcccctcaagggctgagaaacagaagcttccggaggatatgaaactagaccaaagttaggttggaggtagcagaagagacagaattccaacccagaacacccctatgctgctgtggcccctctaaattcagccactctgcataccttgccctttgagctgttattaaacaacagtgtggcacgttaaaaatacttgagaaggccaggcacggtggctcacgcctgtaatcccagaactttggaaggcagagctgggcaagtcaggagttcgagaccagactgggaaacacggcaaaaccttgtctctactaaaaatacaaaaattaactgggcatggttgcaagagcttctaatcccagctactctggagactgaggcatgagaattgcttgaacctgggaggcagaggttgcagtgagtggagaccgcaccactgcactccagcctgagaggcagagtgagactgtttccaagagaaaaatcaccgcgtaattgatttaaatgtgcaggtgggtttaatacaactccaaagatgcagaattcctagtttaatataactttcctcagcatgagaatcatgttgatcctcctcctctccagacaccaagtgagctgatactctggagacagagcatgatcgcttggtgtgatggagccacggagttttgtagtgcaagaaaaagggctgcaggtgattgttccagttaaagggaccccagtcccaccccactgtcaggagtctgttttgtgtggttcttgctagaagaggtcagtaataccctctcagtgctgtggtcacttgtcttaggaaagcttacacatgtagccagtatgcattcaaaacgaatcagcacaaaactgccacgtacccatccacctgttaaggaaaaggctcagcactggggaagctctgaggacacataaatatgttggaggacacccactccctgcccccaaggaggtcagcactgcccatgggatatacacatcctctacgtttctattctgttgatagccaatatcttgcattttgtaattataaacagaaccttgatttttaatagttttaccacctatatttgcatctctaaacagcagtttatttttgcctatttttgagcattttataaatgaagttaactttatgtattaaggctcaggttttgaacgtacaaactgtaccacactgattcaaatagacatagttcatgttgtgtttactaatatttcaagtaaaataatgtaattacaggtataatgtttcttcaaatcatgcagctctcagtagagtctatttatagcaaagatgcttcacatttgaaaccaacagtgactggcaaatagaatccaccagaaacctgggcactcaaaatgtaacaggcatgcaatccattgcaagcctggttagggaggggctgtatcgcctagcattactccctaaaaagtggcctcaaaacctcaatgataggcaacaggggcccactttgggcatcttcgcagccgttgtcataaaaagtttacattcagaaactggtctcaccacttcactgctctcgccgcaagcacagagcaccattatctccagcaattcccaagaccctcactcgccctgcaccttacatttctttggctctgtatggcagtcacagctctaaagcttctagttgcagaagttactccagtgggaatactccaagtatgcctcgtcctcgcttgccttggcttctgcataaggttagtaagaagcaaagcatggccaggactccagggaaatgaatggacgaagaccaagaaagccagatggcataaccagatagcaaaaccaagacatcatgggccactttgatgctcaagccaccacccactgtcattaaccgggacagggagggggtggtgtgttttatgaatggacttggtgccttccataattccctcatcctcagaatcatgaaccgagacacatactttgggttctcctttctgggatgagagacgtgcagatctgtgtggtccaagtttgaatactagggccatcctgcctctttagaattctgggacgacctctcttgccagatgctgttcctctgccctaatggaatgtggcgtcacagtgcagggctgaggtcagatccactcttcttagtggacacgaccttcagttttatagagcaagagggtctcatcttagaatatgtctttaagtgactgatttttaatcatttacttatttgtttgtttatttatttattgagatggagtctcgctcagtcgccaggctggagtgcaatggcacgatctcggctcactgcaacctccgcctcccgggttcaagcgattctcctgcctcagcctcctgagtagccgggactacaggcaccagccaccacacccagctaattttcgtatttttagtagagacagggtttcaccatgttggccaggatggtctcgatctcttgacctcatgatccacctgcctcggcctcccaaagtgctgggattacaggcgtgagccaccatgcccggcctaaatgaatgattttaaaccatatcccttttcaagtcacagcagtgcaacgccttaaaatccaaggcccgtttccctcttgctttgattggtgggcacaacccttagttcttaggaacccaggggaacagaggttgggaagagaactgccgtgagaaacccaaattgtttaggtggcatctggggtcagctagacattgacgaggcagctctgtgatgctggctgggcttattcacattcacgtctggggattggctggtagttgggtaaccccaactagcctgggctggggggccggggtagctcagcggtcttccatatggctgtcgtcttccaacaggctcgtgtgggtgaaggcaggcacagacggtgcacacacatggcccattgcttccccgaccaacctggaatccaaaggaagaggcaggcgagcaaagcgggctgtacagaggagggggcagaggtgcttctgagaggggtatcggacggtgctcagggagcctcaggggccacctagcgttgtgttacctccaaagcagtgctttctcggagtaacagagggcgggcccagagccaaatagctggattctgaaacacaaagagctaccacgagactagtttttattacactaaaaattcttcattaagtttttatcattgccaacctaaatctatataaacatataatatattttatgtatatattatttttacttaaatatgtatgtatatatttataacattttatatacatatttgtgtataaattttcatagataatatttatatatttatatagaacttaggttgccaatgatgaaaacctagtgaataatatttagtatatttatatattttatatagttatgaatatataatatacttaagttatatacattacattaaatatatttaatttatattatacacaatatattagattatatctatagttatcatatttatatataaatacatacgcttatatataaatataggtaacttttcccctaagttgctcctatagttgtttttggctctaggggacatggaagcaagcaggcagatgaggggcccaggaataagtgactcacttcagcacaagctgcatctcccgagccagggtggaaatttaggaatttgctgatacacagtcatgcccctcctccctcccaacatcaaaattgacagtgctgcctggcctgacccgcctccccttgctcatatcagcctggcctggatctgagacccctgcccaagaggggccttggatataattgcacttctccttttccagaccccacacaagaaataagaaaagcctggagtcgtgtccagtcctgactgctcctttcccagagttctaggcctctcgaaggctgaggccacgctgggataagaggaagacggcaccgcttggagaccttctgagaatgggggccaggctacacaatccacccgagttttcttcttttgtcctcacaaccctacgaggcaagaaattgccatcttcactctcccagctagggaaactgaggctcagaaaggccaagcaatgggcccaagtcatgcagcgagcaagggacagggctgggattggaagccaggcctctcagcttccaacgtcctggggctgggagccggtgggggttccagggcccgggaagaccccaaagcccaaagtgaaatgcaccctctgctcatgacccgttatattgcaagggctgctaatttcaatgtgatatgtcctaggaggcatatatgttaaatcactcatttctctagatcagggatatgcaaaccaaggtcctcagtcaaaatgggcccacagcctggtttttgttgttgttgttgttttcttgcttgttttgttttgttttgttttgcttaagatggaatctcactctgtcacccaggctggagtacagtgggctggatctcagctgactgcaccctccgcctccctggttcaagcaattctcctgcctcagtcttctgagtagctgggatttcaggggcccaccaccacacctggctaatttttgtatttttagtagaaactgggtttcgccatgttgaccaggctggtctcgaactcctggcctcaagtgatccacccgcctcagcctcccaaagtgctgggattacaggcgtgagccaccgtgcccagccccacagcctgtttttattagccattttttggacatgcctgtttgcttgcgtgttgcctacagccgcttctgttctttaacagcagaggtgagtcagcataacagacagtatggcccacgaagccgccatatttactgcctggtccttgacagaaaaagtttgctaattgctgacctggattaaaatccacagaaccttttctatgcagggatgtgcttccctatgtcctggccatgcctggtcccagcaccacctgttttagccagacctgtgtctgggccaagctcagcaaagttctgcgatctgatgtcatttaaagacactgttgactgggcatggtggctcacgcctgtaatctcaacactttgggaggccaaggtggctggatcacctgaggtctggagtttgagaccagcctggccaacatggtgaaaccctgtctctcctaaaaaaaaaattacaaatattagccaggtatgtgtggtgcatgcctgtaatcccagctcctcagaggctgaggcaggagaatctcttgaaccttgaaggcagaggttgcagtgagccaagattgtgccactacactccaacctgtgcaacagagtgagaccgtctcaaaaaaaaaaaaataaaagacagtgttaatatggtatcagattgtggctgccacatcacacatattcttttctcctgcagaggccatattcagtttggataaccctgaaatttggttactcgactcttagttaaataatgtttctttgcattgttggtggtttgggtagttttcaatacgtgggctcgatgaagacatagacatattattcaggatttttatttttcttttttgagacagggtcttgctctgttgaccaagctggagtgcagtgatacaatcatagctcactgcagccttgaactcctgagctcaagcagtcctcccacatcagcctcccaagtagctgggactacaggtatgtgccacaatgcccgctaattttttcttttcttttttcttttttttttttttttgtagagatggggtctcgctatgttgcccaggctgatcttgaactcctggcctcaagcgatcctccagccttggcctcccaatgtgctgggattacaggtgtgagccactgcccctggttattcaggcctgttacgttccagattcttccttcacttccatagagaaatccctagtgataaagaatttatgagccaagggaaatatcttggagttttaggcatctaataaatatattcatcttctgatgatgatgataattagcatgtattgatgcttaccaagctctgggtaaaatgctaagtgttttacacatattgtctcatttaatcttctcaacaatgctatgtgctcaggtactgaacagcctcattttacagatgggaaactagcaaagttgaaagactgtccacgttcacacagcagcaaattagacaagctggaatttgcacctgtgcatttgactccgaagtctgaactctctctaggaatttacactctgcaagggtgtggaacacataccagacatcacataaactttacaaatgataaaggagcacctgccctaaccccaagcagacagacaacaagggccaggatggattttagaacactctgacctgtgagagaggcggacaggcctgcaccagctgtatttctgtagtgacatacacaggtgtatcacgcagggagcctgtccagtcacggagccctgggactgtaccatcaacacagtttttgtttgtttgttcttcaggtgacatcgagagctccccctgggaggtggggttggggatgctccttaggaacctcactggaaagatgagtcaagcaggtatccaagtccaattacccggctcagggcttgacatcacagatgtgggacttgcctgagatggggctgatgagcaggaagctgattggggcccttgcagggcaacacacaacaaaccaatcaaacctccttcctgaaatcactgtgcgcgctgtgggggtggcagcgggggagggggggcgtggcttcctgccaatacatcatgggtattatttgttccctcatgaagagcaatagcaatgaaatccacatttccaaattatggagtgctgtgtgcctacgtggcactcaatgccagtaataccaggatgggggtttggtgactgtgtcctggagatgccttgggggtctgggagcacctggacagcacagaaatcagtttctccagctgtaaccagagtgccaggagattcctgcagttcatctagaggacttttccaggaaacccagcaaacagtaggatctcagccacacgaaatcatttagttaagtagctacagtttactttatggagtcgccgtttgccatgttaattcttgatgacagcccaggatgtgggctgcagactgaacccacttccttcaccagactgaccaccgagcacggctctccctccctcctcagcctctcaagatggtagatgcacccacctgcaaacttttctctccgacagaaaggcctcttcttcaggactaactgacctaccgcaggctactgcccctggaacttgccagcaaattcactcccgggatccatgtcaaatcagggttgccagaggaaagtcagggcatgtattttcatctgctgacttggggcagccctgggtcaaatccccatccctcaactcagcacctctgttgcaacaaagcaggcacagctgcggttgcaggtagttctcgagatacagcaggccattcctgcaggactaaaagcagctgcgatgacttattggccaagagagaaaatgaccatccagccaagtccttgtagaaatgaaaatggaacgtaatgaaccagtctctcttacactggcctgtctgccccacccacacttagtttctttccccactctccctataataaaaataccatgggttttaagaccatttcatcacatactttattggacatctcctgtggctggtcactgggatagagtaaccaggaaatgcagtcggccctcatgaatgaacaaaacttacaaccccaggaggggagccagaaactcaattagtggcttagtttccacaacactacgtgctacaaagaggtacagaacaattccaggcaaactaagaacctgccccagcctggaggacaggcatgggggtgagggaacccacaggcaagaagcctcccttaagctgagctcaggactggatgaaatgatcttggtggggcaggagggaaagttccaggcagggaaaacagcagggagtgtgtggtggttggaggtgcctgcctaagggaggcaggagatggtaggtacagagttagtgtaagaaagcccaagagaggctgggggaccagatcccacaggccctgggaggcgaaaaagtaaaaacagcttgtatttaatgggaatgtcctattacatggaaattcacttggaaactgaagctcagagaagttaccataccatggtggaaatgggtgggtatttgttctcaaatccagtcagcctaggggaatgggcagtatttgtcagatctctccctcccccagtaccaaggagggttgtgtagaagtggtgttcatctattaaacacgggggtagcccttaaatgaacatttttaacccatcatcaacagccctgtaaaatgaaaaccacccttagcgtgctcttgaaatactgtacttaccagggtgagaaaaggtgctgacatacttcagcaagatttctggttagagctgaactctaaaggatttttctactaaacagaatattccactccacaggcatatggctggatgaaatttttctatgtgaggttcataattactactaagtctaaagtgttagaacaacttgatcatagcaacattcctactgaaagttttgaggttggcctacgtagaaggaagcatttatgcctcacaccttccaaagtgcctctgctaagagccactcttccttgaacaccctcccctgttctgccctggtgcaatccctgtaccctttgcagccctgtgaagccctcagatgtcccctccctgcccctttctattccctccctcaagcagaatgtcattctcccttacgatcatggatgacgctgtgagaaccctatcatggcagccaatatagtacaagtcagtaccgctgatttctgcattcattcagcaagtatttatgatgtcacctggctccccgccagacactggggaaacaaacgtggagacagggcactgcccgcacagggcacattttgggggacagctaccctgtctggtgcaccatcctcacctgcacctggcaaggtgggtgaatggggaggaatccagacaggtgacctgggggatggcgggctattctctgatttggggaacacagagaggacagggggcaaagtggaaagtaaatgaagatgaacgagttatatctacaagtctgaagctggagaaagatgtctgggcttcaaaggagatttcggaggcagcggctcacaaggaagcgatcctgaaatcgtggctgaaggtgctgagtgctcagtctctccaaggatgatgatgctttacagagtactggtgtcacttcctgtactgggtggcatcgggctgccagatagagtcagaaagaaaacaggcgggagcagagccagtaaacttccgaagctttcaatgacaggaaagctggagattaggagccagtttgaggtcgtgatggcccacagcctgggaccctgagattccgcgggtggagaatgtctcaggtgagagcaaccctagttagaaaagtattcccaagagaccaaggcaagccacgagtcactccttacagaaagtcactcttggtccctaaagatgtgctcacgagtcattctccaaagcacaaaactttattttcagaaaggaaaggacatcaaaaataggactgtcctgtgcagatgtccaatagccttaatttggggaccaaatgcccccggccattggaaagacagatcttgtaagctccattcatccgtgcgctcatccattcattcgtgtttaccgagtgcctgctcagtgttgggacagacgaggatagttgttcctgccaccgtgccctggaggacataggcaaacaaacgacgacacagtgtggcaagtgtcacagttaaggctgctgtagggtggctgtgggtggtgacagacctcaaggcttcattctgcaaagctgagggcaaaccttggcccagactccttcacaaagcccccggtgttcaactattctcagtccaggagcccagcagtgctcccagtggagtttatgaagccgattcagacccagcaaatccaaagttttcttcccttaagcagactgacagccttacttacagaattcacttgtaatttatgacaaaaactgcactagaacttatcacaaaactaactttattatatttttcccagttcgatttttctgtcaaatatcttcactgtccctatgacttctggttcttattttcttgacacacacattgtcctcagcctgtgtgggaagaaaaaaaatagaactcttaagtaatttaaacacccatttttagaatcgacctcctctgcaaaaccccaaaggcttactaggtattatgcaggtccttagttgcagaaaattaattttgaggttggaaataagttttaaaatatattccattaacattgtttttcttgacttgaactgcttttattatgcagtttttttacacttaaataatgtgatcttttcatacagaagttcctaatgcatttttaagctaattcataataaaatttcttcatcgatgcacacattttcacaaactaaaaaatgtcactcagaaaaagtgaatccaaccaggattaagtcttttgggtctcctaaaccaaggaacccctgtagacagaagcatgcccaacttgcatgcaggagacctgccttggcctttactcttgcagtagttctcaccccttggctaagggagaggaaccatggtgaaaagcatggctacaagcttcttactggaaaaaatctatcttatatatgcattttctaggactaccgacacccaccgaagagctcggcaaagaggagcatgtgtgtgttgggcgtctcctgggtgcttgtgtgtgagaagaggctggaacgcccccggcagaacacaccaggcctggctcagccttgggcctggttgctctgtgtttaggaatcatcctagttaaaagattcgctttcacccttctttggtttcattctgaggaagcagcaccttccagactgtgaattcggtaagcgcctggagcctgcgttttattgtaagactcgacgggtgaacgtgctgacccacgtcagctgttgcgtccctggtgtgcctgtggtttctaggaccttgtctggcactgtcgggtgtcttctgcttccagcctgccccagaagtacagtctctgacttaggacacctgtgtgggcatcagtgcccttcttgagcctctcctcttccctctctggaacagtctatgggcatctccccactaggacttcctgcccaccatccagacacacaagccctccccctccactggctgcctggctatgcagcaggtactggggacacctgggaatctttccttttcttggcagttgaagcttcctagtttgtgccgaagagggtctgtctggacagctgtacttgccagaattctgtatctgaagaggttattgctacatgagtttcgtttgctgaactcagaatatggtagttttaggtccaaattttgtgtgtgctaagaattaaatttatattatatttttgtgaattgctcacaaaaagggagcaattcaacctatttttattttagctaaaccaagtattccccagaagaacactaatggaatctaatcattcttatggatttgtccacatgcttgtaattatgagtggctcaacttgatgtgatttcagtagcacttaaagttcattagcttagatagtctctggctggaggagggttggagggcagacgcatcccccactgaccaggaactctcacatagtgagcatgtgtctcagggacatcccaacttctgttccttctgcctttccaaagaatgccttggaaatttttctgtttcaatagttttttttggaaaaagaattttcctgtttcaagaggtgattttgaactacagaaaggctgaagacatctacctacaattgtatcatgaggtacatcataagcagtcagaaattagccactagacaaattccttttctttctgaagaaagtcttcataacgtgaatttgctatttgaagtgaaattcccaaagtagacacaacaaaatataactaaaatgaccaaatttatgtcttagcataatgctccttccattaatgtaactgggagctggcagagtgctgttgaagataatgctttttgtttgcctttgcaaccttgggcaaaaaatacatcaaaacattctgtgtcttttaaaacagggaaacagtaaatggcttaccttctttggattttctgcacacctcttgacactccgcgttactctctgcacagatttgctctccaaagtgcttgctgcaggctggctttttgtctttcttgatctcaggcacatggagtctgaatttcctgcttctcctttccctttctgattctgcatgagaaccttcgcactcttctgccctccgctctcctctgccaccttaggctgggagctctcattctgtctagcagacctcaagcaccttttgttctcagtgactttgtctctaggtatgggtttccgggctccatcatctggattctgaatgtccatctctggggaggtcttcatgggcttcttttcatttctgtttatttctattctttctgctaatacaaagacctcagttatttgctgttctgcctcagtcttattttggcgtctggagcgcagggatattccctaaagaaatgagaagacatccacaaaattccaataattagtaaaacaaacttcaaaattcaacagggagcacaatcaacagtaacctaaaaggagaaatcatttgaaaatcacacactgatgaattgtctaagagacttgtcatctaggatagtcaaggtaatgccttggtactttgctcctatggagaaatgactgtctctgctgacaaattataaataaggaattcaggataaatttcaataacaatgcctaataagatatatatcaaatctaatttttacagtttacattatagaaagaaggtccgttattcattcatttacagggagtaaatgaattcctattcctttaaccatcactgctaaggcagaacaggaaattgccatttctggagtttccccaaacttctctgcatgcagtgggagcctctctatctaacagtccagacagtttccccttctcaagaatacacattccttattgatattgttctgatagttaaaatagtgacatagataggatttttaacccagtcctggtcttggtgacagtatccagaacatagaactgaaccacccacctatcctctgatcaattttttaaacatttgaagatgaacattactcatttggcttttgagaaactcttctaagtttgcattaatcatgtttgactagttcttttcccatattagtctattccctctataggtcccaagaagattctttaccatggcctgcagttattcagtgttaaaggaaaccctctggggaaaggataaccacttataacgtcaggttacatgcaaagtataacacagaaattcacaactatccaagacgatattgagtgatgctgtaatacttcctctcaccttattttcagggaccgagtcttgtaatttgtgttcctctttgttggttttcatgtcgttgctgttcagctcttccgcaggttcaattctttttgcagaagtcctcaaacttctcttcatgatgaccacgggttcggatgatttgcctcttgccctgggagcaaccctctgcttcttgctggctggcagctcctccacaatttcctctggtgctggcatgcagcgcagcctcttggttcccgtgacgcttccatctttgccacctcccctcttgaagggcagtgggggcagggaagtgttgcttttgctttgtgattttacagggtctctggtgcttaccacgtctcccacgggttctactttaggggcccgaagaactcttctggatatttttagaggttttccactgtcaggtgtttgctttggagcgcttgtaaagctatcagcagcaccatttgccagttcctcagtgtggcctggtgtttgagagagctcttggaagctggccagatcttccaggggttgggccttttccttaggtgctcttggctgtctcctgctgccaattacatcttctgcgtccagcttccgctttgcaggttgcttaaatgctttcgtgcctttgccctcacctaccggctctttgtcggtgtgcgtggtctcccctgaggtttgtgtgagcttgccaactgctaacagctcctccttcacttctactttctgggcacgtgtcctgggccgtctctttgagcttgttgcggtgtcttctagttctggtgatgatttgcagggtattttagtggttttgtcatcagtcattgattcttcagtgtgacctgctgctgggtctttgaagccagctaggtcttctatggcttgggcactttccctgggtgctcttggccgtctcctgctgccagttacacttgctgctggagccggtgtctgttttgcagattccttcaatgctttgatgcctttatcttcacctgctggttctttgtctgcatccgtggtttcccctgatgtttgtgtgaacttgactgctgaaggctcttcttttacttgtaccttctgcacacgtgtcctgagatgcctctttgtgcttgctgtggtgtctaccacttctagtgggggagattcgcagggtattttagtggctttgccagcagtcagtgattcctgagtgtgacctgatgtttcagagagctctgtgaagccggccaggtcttccaggggttgggccttttccttaggtgctcttggccttctcctgctgggttcctcttctactgggtttggtttcttctttgcacgttgcttcaatactttgatgccctcatcaccgcttgctggttctttgtgtgtgtgtgtgctttgccctgatgtttgcgtgagcctctcaactgctgagagctcctcttttacttctttcctgggacgtgtcttggggcatctctttgtgctcgtggcagtgtctgttagttctggtgggggagatttgcagggaatttttgtgtttttgtcaatagtcattgactcttcagtgtgacctggtgctgagaagagctctttgaagtcaaccaggtcttctagagcacgggccttttccttacgagttctcagctgcctcctgctaccagttacacttgctgctgggtccaggatctgctttggagactccttaaacgctttgatgctcttactatctcctgttggctctgtgtgtgtttgcgtagtctcccctgatgtccgtgtgagcttgctgactgctaggggctcttctttcatgtccactttcaccaggggtatcttgagcctttgcttggagcttcttgaggttttgaatgactctggctgtggagatttacaggatacttctgtgattttgtcatcagtcattgattcctcagtgtgacctggtgtctggaagagttctttgaagccaaccaggtcctctagagcctcagccttttccttaggagtctgtggctgtctcttgctgccaggtaaatttcctagcaggtccagtttctgcactggagtttccacaaatgtgttgatatttttctcatcacttactgctggttttggtgtgtccatggctttgcctgctgatggtgttcgtttcctgagtgctaaaaattcttcctctacgtctgctttcctgaggtttctcttgggccgttgctttgtgcttgctggggtgtccactgggtctggttgtggagatttgcaggctattttggtagttttctcatcagtcgtgggcttgtcagtgcctggtgtctggaagagctctttgaagccagccaggtcttctagagcctgggccttttccttaggagtttgtggccatcttttgctgccaggtaaatttcctggcaggtccaatttctgcactggagttcccataaatgctttcatgtctttctcatcacctcctgctggtttgggtgtgtccatagctttccctactgatggtgttcgtttcctgagtgctaaggattcttcctctacgtctgctttcctgagacttctcttggactgtggcttgaagattgttggggtacccactgggtctggttgtggagatctgcaggctattttggtagttttctcatgagtcgtgggcttgtcagtgcatattggtgtctggaagagctctttcaagccagccaagtcttctaggggttgggcttttcccttaggagttcttggctgcctcttgctaccagttacacttgctgctgggtccagtttctgttttgcagtttccctgaacacgttgatgcctttatcctcatctcctggtactttgtctgtgtgtgtggtctgtgtgagctgcttcagggctgagagctcttccactatatcccttttccccaaaggtgttttgggccgcctccttgtgcttgttggagtgtccattgattctggtggtggagatttgcaggctattttggtagttttgtcatcagttgttgattcctcagtgtggtctggtgtctggaagagctctttgaagccggccaggtcttctagtgattgggcctcttccttaggtgttcttggccacctctccatcccagttccatagtttgctgggtccagcatctgctttgcagattccttaaacgctttgatgctctttccatctcctgctgtctctctgtgtgtctgtgtggtcttccctgacgtctgtgtgagcttgccgactggtaggacctcttctttcacacctactttccccaaggatatcttgagtcgttgcttggagcttgttggggttttgactgggtctggttgtggagatttgcaggatacttctgtgattttgtcatcggtcattgattcctcagtgtgacctggtgtctggaagagctctttgaagccagccagatcttctagagccttggccttttctttaggagtttgtggccgtctcttgctgccaggtaaatttcctagcaggtccagtttctccactggagtccccacaaatgtgttgatgtctttctcttcacctactgctgctttaggcgtgtgcatggctttgcctgctgatggtgttagtttcctgaatgctaaaaattcttcctctacgtctgctttcttgaggcttctcttgggccgttgctttgtgtttgttggggtgtccgctgggtctgattgcggagatttgcagagtatttttttggtagttttctcatcagtcgtggggttatcagtgcatggtgtctggaaaagctctctgaagccagtcagttcttctagagcctgggccttttccttacgagtttgtagccgtctattgctgccaggtaaatttcctggctggtccagtttctgcactggagttcccaaaaacgtgttgatgtctttctcttcacctactgctggtttgggtgtgtgcatggctttgcctgctgatggcgtttgtttcctaaatgctaaaaattcttcttcagtgtctgctttcctgagacttctcttgggctgtggcttggagcttgttggggtgtccactaggtctggctgtgaagctctgtaggatactttggtagttttttcgttagtcattgattccttagtgtgacttggtgtctggaagagctcgatgaagccggccaggtcttcagggacttcagactttcccttaggagttctcagctgcctcttgctgccagttagacttgctgctgagtctaagatctgctttggagactccataaatgctttcatgctcttaccatctcctgttggctctgtgtgtgtgtgtgtagtctctcctgatgtctgtgtgagcttgccaactgctaggagctcttctttcacgcccactttccccagggatgtcttgagccgtcgcttggagcttgctgggtttttgtctgggtctggttgtgaagatttgcaggctactttggcagttttatcgttagtcattgattcctcagtgtgacctcgtgtctggaagagctctttaaagccagccaggtcttctagagcctgggccttttccttaggagtttgtagccgtctcttgctgccagttaagttctctgtcaggtccagtttctgcactggagttcccataaatgcgtagatgtttttctcaccacttactgctggtttgggtgtgtgcatggctttgcctgctgatggtgttcgtttcctgagtgcgaagaattcttcttctacgtccactttcctgagacttctcttggactgtggcttggagcttgttggtgtgtccactgggtctggttgtgatctgcaggctattttggtagttttctcgtgagtcgtgggcttgtcagtgcatactggtgtctggaagagctctttcaagccagccaggtcttctaggggttgggccttttccttagtttttgggtgcctcttgctaccagttacacttgctgctgggtccagtttctgttttgcagtttccctaaacgcgttgatgcttttatcctcacctcctggtactttatctgtgtgtgtggtttcccctgatgtctgtgtgagcttcttcagggctgagagctccttctgtacgtcccttttctccaaaggtgtcttgggctgccttcttgtgcttgttggggtgtctgctgattctggtggagaagattcgcagggcattttagtagttttgccagcagccactgcttcttcagtatgaccaggggtctggaagagctctttaaagccagtcaggtcttccagagcctgggcctcttccttaggagtttgtggccgtctcttgctgccggttaagttctctgtcaggtccagtttctgcactggagttcccacaaatatgatgatgtctttctcttcacctactgatggtttaggcgtgtgcatggctttgcctgctgatggcattagattcctgcacgctaagagttctccctctacatctgctttcctgatacttctcttgggtcgttgctttgtgcttgttggggtgtccactgggtctgactgtggagagtcgcagggtattttagtggttttaccagcagccactaattcctcggtgtgaccaggagtctggaagagctctttaaagccagccaggtcttctagagcctgggccttttccttaggagtctgtagctgtcttttgctgccaggtaaagttcctgccaggtccagtttctgcactggagttcccataaatgctttaatgtctttctcatcacctcctgctggtttgggcgtaagcatggctttccctgctgatggtgttagtttcctgagtgctaagaattcttcctctacatctgctttcctgagacttctcttaggccattgctttgtgcttgttggagtgtccactgattctggtggtggagatttgcaggctattttggtagttttctcatcagtcattgattcctcagagggacctggtgtctggaagagctctttgaagccagccaggtcttctagtgactgggcctcttccttaggcgttcttggccacttcttcattccagttacacgggctgctgggtccaggatctgctttggagactccttaaacgttctgatgctcttgccatctcctgctggctctctgtgcgtgtgcgtggtctcccctgacgtccgtgtgaacttgccgactgctaggagctcttctttcacacctactttccccagggatgccttcaactgttgttttgtgtgtgttggggtgtttattggttctggttgtaatgactggcagggcattttagtgattttgcctttctcactctttggtgccttggcatgatcttgggtttggaggagattctggccacgtgccgtgtctttcatgagttctgtatcaggcaagctcttgaggtctgtcaggtcagacattggtgcacatttctgcccccaagttcttgatctcttcattgctttcatcttttcatcgttttcttttaattcaatattttccttatatgtctcaaaaggtctttctatttccttcatctctccttctctcctttgttgtagtagtgttgccttctgacctctttttaggatgcactcaacaatttctgtatttgtttcttcactcttactttccacaggtagcttctgtatattcctgaactctgtagaccttcctgacctgtttgcagtggatactgtttttgaaggctctgtctcagtatctgaagtttttgtctccagagaagtcattttgtaggtgttcctgggcgtttttgctacgtttccattttctctaatacactgccgtcttaagggagggcttgcagagcatttatcagatggctgttttgctgcattctgtgcactgaagaacacatttcctcctgaaataaaaacatacacaataaaaacattctattagtgtctcatgtcaatcgagtattacagcctcataaaatatggtaaaaaactaaatatttagcttcgtattcactgaacgacatgaggctacttatgtgtctataaatctgtcttataagagccatgcacaattaagaataatgttatttggtgctatagtggggtcatcattaagcaaagttagatgctgaaatgatcatagaaggtaaaaatactgcttcagaaggttcctccaaaggttgccatgccctgtgtcattgacgtaaatataggcattttttccttcaaacattagaaacaaacagctgtttcttgccttaaatcgccaataaaataacatggattatccttatgtggttagggtccatattacacaggaaatatttacctaccgcaaacatcttcagggtagcaagctgttccctctgtgacaggaatacagtgaccagtgccaaatgagagattagacagattctcatctcccatctcacacttaccccgggcctgctcccacctaaaaggttagcaggaataattgcacagtatacaaactgttatctttctgttttgtaattggcagtaattttgaatatgagtaatttatatgtaaatatggtgagacaccattgtatttttttgctatgtcaccctggttacttacaataaagaagccaaaagtgtacacaggtcatttacacacattaacggagtctttctttctatataagtcaatgaatgccaatgttagttcaactgctgattgaaatctccctttcaattagaacagagaagacggaaatggtattttgtgccaggaacatttgttttagagaagtaatatcatactgcttgtaaaaaaataatactgtatgttcctatcccaaaacatcacagtgttaggaaacaaggaaaccaaccaaaactctctgaggtggggagcagaggttcttctcctgaatcagttccttgaaactgttttccaagcaaattctctgaatttgaaatagcgatgtgacatgtgcttgtcaactgcggttgctccttcactggggtcttgaacatttcagctattcctgttaaatgaaaatatttgaaaagtgattgacatattgctaacatgcagacaaccatcccagccctcacatgtaacgtgcaaatggtgggaaataacagtagattcctcccttgaaatcctggtacataggcctcataaaaagagtgattccattaataatgtactcattttgtaaaaaagagagcacagagaagatatgttatgctcttcgctttgcttttcttggaaaggaaacaaatgaagttagctgacctctgggtcctcctaacaagaccccacacgtgagctctggagcacggaggctggtgacgggctcctgagacccataggcctccctgctaggatctagaggccaaatgccttcatgcttctcaaagtcttgggtgctcagttctagattttaagtacaaataacacgtacccacattttagaaaatgacaaagagctgcccatttttagtactgtcaagtaataatatatatttttgaaaatctaatatcattatcattctgtttggaatgataggaggcctcagcctcccaaagtgttgggattacaggcgtgagccactgcgccggccatccccactttaaattacacaagtcaggccacaatttactgagagtgggaattgaatggaaatatttcttcaacaatcgtttatgggaatcttctcatagggctttctttcaagaaagttaagctacctagaaagtcaatcctgaagaagcaaaatgttgctcaacaacaactggcccacacctgggataaactattattgtacctgcagattaacaagttaactctcttcactgtaaagcaccttccagctttctatgtatacgctgctctccagggtaaagacatgcatttgacatttccacacctatttcatgcaggacatgtgatcccaaaaattagcagagacttgtctttgcaagccaaaacagctttatcttccctgaacactaagaccccagaagggtgattgagtcgtttattttataatctctttcacagcagataaacaaagttagcaaaacaaacattaacacagtaaaaaacagtagagtcaaaagatttataagatctaagactacgtttttacctgaaagatcttccttaaagtccattttttggttggaaatgaagttgttgagcactctgtagggtcgagcaggcacatgtactttttcagtatgagctttccctattattatggtacaaggagagtttgcgtggcctgtactaaattgactgtgaacttcgcccacaggcttctgtagaaaacaggaaggaggtaaacaggacattaaagcataaatccacactgaatgcaagcttcgatgacaccggtatgtgtaaagcagccattcagtgaggcccctacctttggagtagcaggtcttctttgccttttgttcattgacctttgaggaccatgttttatgactttagtttgtgtttgttttgcaccaagttttactacatctgcccatgattttgcaactgtcaaagggaaaagacgaaacttttcaaaaattagcattcatgaaaaaattcaccttaatatatgtattctaatgtcagactaaccaatcagatttgcttccgaagcaccacttcttcttttggaacatatcatctgtaaaatatcatgttgacttcggctgatagacactctctttgaaggcaggttgccactctttctccctcctctcttaggaacctctgtctgagatttgctgctggaagcaggggctgttttgcaggacctacggcgttgatcactggcaactggagttttcctaggactaggagctggagggcttataaccaagctttgtgccttcacttccacatggatttctgaacctgactcttgttttcctgatggttgaggctgttcctgacaagacaaaattgtttacaagaagccttaacaaggatctaacatctctggaatgactgataaaaacctattcagttaagaatttcagctgtttaaatcttgaagcatcaaatgcttaagccactgtctttgaagactatggtagaggtgagactgtctcagtcatttaaggaaaaggaaagagaagcaagccaagtctgaagtgaggtcatttcaggtaaaaaggtggaaggaacatcctgatcagtgaaagacaagcagggtctgatctcagtcccagtaaataccagctgtgagcacccagcccccggcagtccacatggagggaggactgcttgcccctgggagccagtgtaaaatggaaagggagccagacatcactttccactcctgctgggaagagaaggaaagaaagaccgcccaggccctattacaaaggttatgagctatagggccatgacttcccagaggtgtgaaacccaggaaggacaacacagcaaaggaacaggcaagcaaatattctaaagagctgaaggtgtaaaaggaagatgtgccattgattttccttcacaccaggtaaatgccttaactatagccttgtaactctaaaagaaaataaaacaatccttatgggtcgacgtggtaatgtatccagaatctttgtaattggctattctgacggtgcctgcaggtgattacgcagtgctgtaagcgtgggtgtctgggaacttctgcacgaaaaggacaacatcaaggactcccccgactcggtcgcatcagcaccacggtcagggacccaggggctcctttgctggtgcccacatcaatgagctttcattcgtctttttaaaaacttgtttctttaataaataaataaaggtcttcatcataattctacttgtgtcagtatttggaaaggaataggtacccggtgtgtgagccactgggcgtgaatgggatgctgcttgttcaactcaccttgatgattttcttcaggacaggtggagtgtgcattaccagagactttcttttggttggggcttctccccttttgagaggcgtattaggaggcaagttttcatcaaatagttcaggtcttaggtgcccaccaaaggacacacgccttcttttcaaaggtattccctcactctcatctaaagtaacggatacaaatgtggaaagagcaatgaaaaaacataccaagactagtgatttatttcacgttagcattaaagacaaaccaagtgaaaagtcatcgaaacacagtacctacagcacgcctctattcttgcaatcctggtgaagctaagctactaagagttcctaaaggattgcgggagtggccactaagacgtcaagttgccactggacagtacagaggctttctttaaaacattgaaacattatgtgtggacatagaaaggaggagtctgcagcagcagatttcaccttagagtagggggacgacagccagagaactctctaaagacatgcacttgggtctcagcctgagccacccagtgaccagaatgcatgagctgtaaaaactcctccaggtggttctgagtcaattcacaggagcccagtcccggccacacattttcctgagccaccagttaatgtaaatcccttgcctaagtgatgcttccccactaggaagcttggtggaatactgagactgatgttacaaaccttattttatcgacagcctcatgccccaccgctataggccacctgcagaaacacagcctggagtacgaatactgcgtctgtggcccagacaacttttcttctaatagccagtccctaggagtgtaggaagctcccgaggagctaccacacctgctataaaggtcctacctctgccacttcctgactggccttgggttgtgcgtttcctcatgtgtgacatagctctaaaaagacaacctagccacgggcactgctattgcaccaaggatcaagtgttcatgtggcatatggactcatgggtacagtccagtgtttacagcaaattgtttgtaggacactctgaaaacagagtatcaacacctgagaactaccgctatgtttaatgattaccagtgatttattccacatgaccaaactcatatgatacagttgattgtagttcagaattaaactccatgtgaaaagcaattatgattattctcttttctattttgtgatagatggaggagaatcaaatatttttggggccaccctatctccttcaataacccctgcttcatgattgcctgacaacttccatctcttctgtcattccttgttacaattacctaggccttcagtattcatctattagcgaaaacagcgtgcgtgtctgtcttatccctgtgccttatgtgcttacattctcttccacaaagctaatcactactgaaagaatgaaggtctcacagctacatagaaggtgttcatcttttagaaaaataaatttacaattaaataaacttactaatggaatcaccaaagttgttgatatcaactgaactaagaccaggtaacccagagcacatctgtccagctgtagtgcccaatttctcaggcttgctgagggaatccttttggatcttcctctcaacttgagtgagccacagagttaaaaatggctcattgtgaatttcagtttccgtaggcagaacttccacatctgtaggaatacttcctctggttttggaagagagattttctggcttagtggcagagtcagctgcatcttcaactttagctggtgttcgatttctagttgaaagcttcctgggagtaagagttttatcaccagccttgaagccttcacttttacccagattcacagattctcttctaccagtagtatacaggtctttgttcttatgtttttgtggagaattttgttgctgtgaatattgtacaggggtcttcattttagccggctcatagagaggaaagctggcgcccacagccttgctgggagtctgaacagactccacgtctcttcccttccccttgttctggtcaagctcttgttcaggtgaagcaggctctgccacagcgtggccgctcccaccagattttggtcttgacttacgcgagaccaacagttgggtctccccctgtaaaccatcagcactttctttctctgttgcgtaatcagtttgtaatccagattttctacaatactgtaggacattttctttttgtgattttacatccaactctttcttcactgactcataaagcttccaaaagggagattcattttttttgctattgtcaagacattgtgtagtgggaacagacttcaattctccataacggctcactaatttaacgctggaaatttctttaaaatccccagaaatgggatcagctgcatttctgccattacgtccagcatgttctgaggaatgaacattagttgttccctgagcaacactgtcttttgagtcatctgcggtactgtcttctttgacattcttgatatgtacctgaggatttcctgaaacttttccttcagtgatttttgaataggccttggaatcttgagctttctcatcttggcaatgaattatgaaataagaaacagaagttcagcattttctcaatgattaacatttgtggaattcaatattttaattgtttcaggttgtcttataagctagcttttacttggcctacaaattatttaatgcctaaaacttgcaagtcttatgatactagtattatgatacaaatatataaatcatatcagctccaataaccagtatgaaatagcacatgctatctaactactgagaactgagttgacagctgaacaggcaattttctcatatctagagtctctcctaagcatagcataccatcagtcaccaagggaaagttaggcatctgtctgtcgttgacatgttaaatgacacctcctccatttctgacaggctagacatttagcacttgcattcttgttgccccttctttgccaatatgcttcgcaaagacctgatctttcaggattctggaacaaaacccaaccactactcaccagggtcagaagagaagctagatcttgagacacgacgtgctggctcctgtaagttgggaaaataagaacagttatttgcaggtctttctaaatgatgacagtcacaacagtgaaaatattatttattgttttctggctgggcatgatggctcatgcctgtaatcccagcactttgggaggccaaggtgggcggatcacttgaggtcaggagtttgagaacagcctggccaacatgatgtaacctcatctctactgcaaatacaaacattagctggatgtggtggcaggtgcctgtagtcccagctactcaggtggccgaggcaggagaattgctggaacccgggaggcagaggttgcagtgagcagagattgcaccactgcactctagcctgggcaataaagcgagactctgtctcaaaaaataaaaataaaaacaataaaaaattgttttctttaccaaaccactcgtatatgacttttaaagactgtttgagaaatgagctcaagtcagttgggagctagtggtcaggataaaagtacttattagctgactcattaaaaaatagtgagtgattaataggaaacaaattcgaggcttaaaattactaaaatcaaacctcggtgtgtttttataacttcctttaaagatatttcccaacatcctattgcggaagaaccaaagtcaatattaaacatcacctatactgaagatctgtaaccccccacgagctcagaactactgactgcgtcatcagttttctcataaatgggccataggacctgtcgatgaactgaggctccacttggcatgtgcgccctcttggctggtggatacttagggtggatctgagagcctagattcaccctaggtaaattcatggtacaggcacacatggtatattcacagattctgcaacctcacagcctgggagcaggcgcagcgcccccacctggctccccagagacagcgccctaactttccttcatatggaattatttccggaagggtggaagaactaaagaataacatatatatataacttttataaaagtctgatgccccaaaggaagaaaagcttatcatctggattattaagaaaatatctaaaaaatattaacaaaggcaaagaatctaacttccttaatcaattttaggtttcttgatacgtaacaccttgcttctaaaactatctatgtgagggatggttttttatttccaatctgaagtggaacaagaatcttatgactaaacaatataaatgaaccactaataaaattatgaatatgtaaagtatataatctcacttttgttgtacgattacattcaatagccacaaaattgctgtcgaattgctgtcatatttactacatactccatttcagtactcactatatcacagaccagtaacagaacaaacagttcctagactgctgagtggcacatatctaacccacagttcaactggctttttggtttatttactcccatagactagcaagttgcctggtggctacagtgtgggatgcctcagaaactggcttccagcacgggaactgatgaccatcagattcaacattaaggctgctcctctagggaagaaggcagtacttaaatggcagaaatggactgggcatggtggctcaagcctgtaatcccagcactttgggaggcccaggtgggtggatcacgaggttaggagttcaagaccagcctggtcaatatggtgaaaccctgtctctactaaaaatacaaaaattagccaggcatggtggtgtgcacctgtagtcccagctactcgggaggctgaggcaggagaattgcttgaacccaggaggcggaggttgcagtgagccaagatcgcaccactgcactccagcctgggtgacggagtgagactccgtctcagaaaaaaaaaaaaaaaaaaaggcagaaatgttgaaattcaagagtacctactgctaatttcaggtgcacctaagataactctcctaagccaagatattccaaggagctcatctgaaactagctttaggagcactctaaaatgtaggaaaaatatgaattctcagggctcatcctaagcctaaatcccactaaatttccaagcacatgccgacaactgtgttttaataagctgtacaactaaaatacctcttccacactgatatactcaaactatctaaattgcgaagcacgtgtcgacaattatgttttcataagctgtacaattggaatacctgttccacactgatacactcaaactataggattctctcacaagacaaagcacaggatcccttttcctgtttcatgggtcgtctatctatcaaaatagagaagcatctttggcactcatgattttcataatgtgattatttcagacacataaagacggatgagtacaatgactgggcgacaaaatgagccaccagataatgcaattcccaaatgttagctctacgtgttggggttatcctaatcatgggtttgcaaaaagctcgcaacatgctctaatagactttttggctaaaagtgtaagaccaacttagtgctctgattttgaacaataaagaggaaatatcattttagattattttaatacgtctaagttcaactcgtttttatactttagttacattttcctactataacagtaaccaccctctttgtaactgatttcaagtaagaaatcattaaagcatacataaatgatttcatatcatcgaaacgaatcagcccaaacttggatattttctatcacctgttcacgtatttttcttggaaattcagttgacttccttccattctgaagactttcattttcatacctgcagtttatagaacgacaaagatcctgattaaaaatttataccctggggcggaagtctccatatccacttaatgtccaaggatcaacgaacaaactttgggtttagttcaagacatcaccttatacaaagaaataaatttagagttagaaaagtgcttttacactaaaaactaggattagttgcatcgagtttgttttgaaataccactgtcagaggctggggacccagattaacttctgatcactgacgaacagcccaggtatgatttgacaatattaccaagcaccttctatgacataagctaatgcacatgagagcaaagtcaagtttcttctagtttaagtccatggaaatcatcggatggcttggaaggccagccaggaagcctgtaggtaactgaatctttctcacgttgtgaagttacatacttcagggtaaataaaaagctacacttacactacagggtaactacaaacctatattttagaacactatgatcacttcagtttcccacacattcagtctgtatctgaacaagacaggtacatcttaagaagatcacctttagcaagatacataattgtcctggcaaacctcagtgatcaagtcatagaagcaatcctttattttgcataatgaaaacttttggcctcagtgaaatgacctgatttgaatttataggcaacctaagtaagatctgaagcagtcacacatctgatattatttctcatggtagagagtttggaatcaagtctctctttctaagattcactttcaaatctttgttggatgtctttaatcatctgaatttatctcaatttggataatatcttgttttgaaaaatagttcagccctccaataaacatcaaaagcttcctacctataggccgggcgcagtggctcatgcctgtaatctcagcattttgggaggctgaagcaggtggatcacttgagaccaagagttcaagaccagcctggccatcatggtgaaacgccgtctctactaaaaattgcaaaaattagccgggtgttgtggcgcgtgcctgtaatcccagctacttggtaggctgaggcatgagaatcacttgaacccgggaggcggaggttgcagtgagccaagatcacaccactgcactccagcctgggtgacagagcaagactctgtctcaaaaacaaacaaacaaacaaacaaaaagaaaaagaaaaaaagaaaaacttcctacatagaagtctgtattcaataaaaatactctttaaaaatgaaggcaaacttcccagaagcacagtaaaagaaatgactagggaatttaagtggtgcattaaaaaacagctaatacaaatgaagacaataacagagattcatttagcagaatggatttttaaatgacccaactaatacgttgtctacaagagacgcaattttgattcaaagacacaatcttttaaaataaaagcatgggaaaagatataccatgcaaacagcaagcagaggggaactggagtactgtactaacatgagacaaaatcatctcagacaaaagttattcatagagaaaaaggacattttatataaggatcaatccagcaagaagatattccagttaaacacaagaggtcacctgacaacaggttccaagagacaacttaaaccataacaattatgaaaagttaaaattaagggggtggaaaagttatactacacaagcactcatcaaaaggaaattagtttaaccatactcatcatccaaaggaaacattaagcagaaaagaaagcactactaaaaacagaggacatctctaaatgacagagttccatgcaccaagacatcattctaagtttgtacaccatagtacagcctcaaaatatacaaagcaaaaactgatagagataaaaacaaatcaatcaatcaatcctcagtaggtgatttgaacatatctcttagaataatagtaggggaaaatttactaagattatagatttgaatctaacgggagtgtgtgtatctgtatatgtgtatatatattacatattatatatgtatatattatatattatataatataaatatattgtatatatattgtatatgtattatatataccatatagtatatactgtatacagtatatactatatggtatatataatatatattattatattatatattactatataacatatagtatatactatataatattatatattatattataattatatatgattatatataatatattataattatatattatataagtgatatatataataattatatattacatatatatgagacactgtagaatacagttttcaattacacaaggcagattagtaagataattagccatatctgctcataaagcaaaccttgacacatttcaaagactagacattagtcaaatgtccatcaagaatgaatgaattctgtatagttatgtatattattgtatatattaaacatttttttttcagtgaaatacttatgccatgagaaggaacaaactacagagatgtccaacatgctatgaatctcacacacagaaaagcacaagccaggcacaaatgtatacattcttgtatcactgttaaggacttttataagaacagacaaaactatcgtgttcagagatccatgcttaggtagtgaaactcgagacgtttatgatatcctaaaagccaaaacggtggtttacttgctgagggaatgaagtagtgattagacaacagcatttttaaaaagcttctggaaatgttctatatgagctgaggatgtattagtctgctagggccaccataataaagtcccacagactgaatgccttgaaaaacagacatgcccttctcagtgctggaggctggaagtccaagagcaaggtgtcagctggattggatttctctgtgcctctctccttgacttgaagatggctgccttcttgctgcctcttctcatgggctttcctctgtgcacgtgttccctaatctccacttataatgacaccaatcatcagattagggcccatactaatagctcaaaaagccttcattgcctttttaaatgccctctttccaaatacagttacatcctaaggtacgaggggttaggaattcaaaatatgaatttcgggagagcacaaatcagtccataataggtggtgatcaaaagggtgttcacatgataaattgacctgtccatcttgttttgtacctttttctctgtgtatattttgctttaaaataaaaaagaatagaaaaatctcatgcagtttcaaaacacttggaagaaaataacaaactcctttaggacaaggtcaacctccctctgcataattatttgcacccaaatccttgaattccatcacattttgtcccaattagtcatcttcctagatccatatccttttaaattaagattagtgttgagaatgaaaacctgaaatactttgacatccatgaacattaaagaagaatgacagttgactttgacactagtttatggttaatcagaagatgacatttactgttagaccaatcagcttttacctacctgaaggaacgatcaataatagttattacatctccatgttttagccgtacaggctcatcaataacagacccatttacttgtgttggatttgtggaactgaaattatgtaatattgcctgcaagtgaaaagaaggggaaatatgtaactaatgaacagattaaaagtgaactaaaaagctttaaaagtagatcttcaaaaaacccactcacctcctgctcatggatttcaattttgcaatgttgttttgacacaacaggaagctggatacggatgtcacattcaataccccttcatgcaaaagaagaaggtttttttggttgctgcaactttttaaaagattacctcaatttcccaaaataaaacacaatttgactagaatgtttgatctgtaaatatgacataaaggagtaacaaacaaaatgggcaatgtaaacgatcttgcattttgcaaagaacttttggaagtattaaacatgtaactattagatctttaaaacagagagtatgtaaaaacaagggaaaacactagaacacaaatcgaattaccttttatatgaaaagctatacttaaaagacacaaaggaatacttacatcaattttggataatgactatttttaatactctgtgctttttcaaaaacgtttgtttgtaatgttaaatatgtttagaggtttaatcatccccaaatgtgcttatttgatgctagcacttctgtgcatcagtttcttcatatacaataaagaaattacattagaacctacatcatgtgatgttcaattaaatggttgtacatgtcactaatttgcctagcacatagtaaatgctcattatgggtaagcttttcattgttgttttaaaactacactgaatttactgacagattcaagtctctaaacaataaaaatactaatttgcaagcgacacaaaaaaaaaatctaaattcaacttgtttttccacagaaagctaacaccatggcaaagtagcagaagagacaattcctaaacctatacaaactaataatcagaagagtttgttagtaggttcttggagtcttcagtgttcctgttctagcctgtgatcttaaaaatttgaataaactatgcaatggcctgtctgttctccatctgaacctttggagtctaagaatctctcttcctacccaggtcatgtgaccaaacacttaggaattatttctaaattataaaatcttgcatgaagatatattcaaggagtactgtataaaaaagcaaaaggactgccactggagatgaaatgtttatatttttccttttcaagagaaaggtatctatggaaagtgaaaagcttccttaaccccaataaaataatttgattttaaggtaacaggacatcagagcaaaggaaagactatcccttacaactgagaatttgtttggcaggaggacgactatagatgggtgtttctgagctttggcactgttgacatcttgggccagatgcttctgtattgtgggggctgccctgagcctggtaggatgcccaccctgacctctcctccgcgatgacagcgcatgcccctgtcctatattgtgacatggaaattcaaatgaatcctggaaggttagatgaccctcctgtgagaaccactgttctcaagagattgcaaatccatggctccagcccatgtttctactgacccttgccagaatgctaggtattgatcacaccccctatgccagacaccatccctggccctacacacgtgattagtaacaagacagtctttgcctttggggagctcagcctagtgggagacaaacccacaactcacccctgaagctgtggggttggaaatacaagttttcatgcaaggcttcctcagaggtgacatttcacctgatgcctgaatgatggaaatcacacaagcttgaggaaggggagaactttcccattgtaaacttccaagtgtgtaagaagtaccaaggtgaacaaaggcttggaatgccttaggcgggaggaacaaggtaggggatggggttgggaggacagggtgaggccgggatggggttgggaggacagggtgaggcctgaatcccgtgtggtctgggaaatgaccacacgggaaatgaccccccttctcaggcctctagtgggacacatgtcagaggctgatggggcactgtcagcaactatacctgttatacagggacagggttattaccaccaccaaacaggacagcaatataagaggaaacgttctcgaattccaggcaggaagactttctgtcccattttcctattgccacaaggagccaagagacaagtgtatggcttccttccttcattctctgtgtccccagtggccagggatgcccactgtggaggcacccgggggcgcacagtgtcttcagacgcctgcctgcagccagtgacatatgaagatcatctacatctttctttaccgcaacattagcaaatcgatttttttaattggcttgatttttaaaaccacttaaacatacaaactagcatcaaatttatacttacaaaacaaaaaaacacaactatgtcaacttagtaacgaatgggagaagcaccaaggaaaagtgacggcaggacccaatcctagagcgcgtttctggactttattctgtgactaaggtattttcctctttctcagctaaaacgtccgcgcgcgcccgcggggctcaccttccaaacaagcaggtgctgaggctcaggggaaagtggggaccgtcgaccccgctccttttgatagtaaccaggcgtctcgtgggccacattttctaaacagtaagttgagtataatccgtaggggaaggccaggtataatccgtaggggaaggccagaagcaaatttacaactcttccactgcaaaagaggtgcgagttactctgatagcaaaggagctaagaagggccccgtgcccaattcacctatccccggccacagaagcgcacaccgcagctagctagcggggaccccaggacgatccgaccgcagcccccggcgccccaaagtccggcagctggggtgttgtcgccagcgcctgcgcctcctgggagcttccaccgagacgccctcgccagagcccaggaggagtcgggcccaggccgcgcgtctgtcccctgcccgtccccgcagagctcggggggtccccgcggctcagccctcgaccccggacagctcccaggagtcccggccgcagctcacctgggacgatccggcccgcaaggccacttgtcgaaccaccgctcgtcaagtcgcacccaaagtccgccgcaggaggagccggcgccgcgctcacctccgcccggtaagctgcgcccgccacgctccgcacacaccgggccgcagcccgcggggtcgcgttcgctgcaccccggcctgcagtccccgctgctcccgccgccgcctctgacggggacccggtggccctacaggctacgtccccgggcgcccggctctagcggctcccaccgagtcgagtcctcccgcccgcccgcccgcccgcagcgtcagccctccacttccttcttccagcccggcgcgcccgcccaattcaaacgaaaacgaagattcaaattctggcgctaagcgctgcgattgaacgggaaagcgcggcatgggaccaataggaagggagcgcagggcgtgggcggggagggggcggggaaaccgggctcgcggggcggggctggcgtgtccgcgggcgagccactcacgcatccggaggaaaatacctgggtgcatccccggcgagggcggctggcggagggcagaggtggaacacgctcccaccgagataacccgtcctgctatccttttcttaaaggaccaaacatctgggacactataacattactcattgccagaagatttaaaactgctaaaaattaaaaacaggcgggacgcggtggctcacgccggtaatccccgcactttgggaagctgaagcaggaagatcccttgagcccgggagttcagaaccagcctgggccacctggagagaacccatctctacaaaaaattcgccaggcgtggtggcgcccctgtagttctagctactgggacagctgaggtgggaggatcgcttgagccggggcggtcgaggctgcagtgagctgagatcgcgccactgcactccagcctgggcgacagagcaaagccctgtctcaaaaaaaaaaaaaaaaaaaaaaaaaaaatcgaaaccttcctcttcagtgcatacatcttaccaaacacaaaaacaaccaattatataaagtagtttggtgtgtcttttcctgctatacgtgtattctctttttcaaaagcacagaaaaaaaggtcataacatacacaacacgattctatactttgtgctctctgcttttaaatatcctgaggctatctccactgaacacattctcgcttttactctctgatggctgcagagcactgggcttcgggaaaccataatttacttaatcattactattgccacatacttaggtttacaatgttttgttattagaaaacattcttcaattgaaatggcttgtgcatgccaagatgggtgaatcctaaaataattctacacaggattctatcggggtctgcttcagttgcgctggtggccatgtgggctcagtaggccacctggggtgaagtgaatggagcctaaacacgcttttggtgacaacggcctctctgccccatctcacctcctccagctccccagcaacccttggagcttggctcccttgatcagggaggcctcgatgcaggggacccctgaggacttcctattcctttcagagagtccataaggtcaaaaccatttatctaatgaccctctgtgttacttgcccttctcattctcatgctcccaagagtgtggggtgtggttctgcaaatgcagaagcagtgaggagactcccactgtctccgtttcaaccaggtattacagagatttgcaaaaatgtgaactaaagcgctgttttcattttgttgttttttttccataaaaataagttattggtgttagcatgaaataggtgcatcactatcttaaaatgaatcaataaatgaatatttttaaattccttagccttaacttaaaatatataaatatagctagatataacccatccacattaacaaaaattcctggtggttctcaataattcttaagagtgtaaagggaccacaagattgaaaagactgagccctctgctctagagcaactacaaagatatcagctgctgatggaaatagagaaactgggaaagcaacataaaagcacaggacagcaactctaaattgtatgggccaagtctgacgtagaaaaattcagtgcggggatactattatataaacgttttagggggcatgagtttccatgttttcccccattaaacgatcaaacaaagcccaccactgcataaccccataaaacacaacttttctcatcctaattactgcttgtttccagagacagttcttccaccctcatggatgcagcctaattagaactagaaggtgctaggccaggcgcaggggctcatgcttgtaatcccagcactttgggaggccaaggtgggtggatcatgaggtcaggaattcaagaccagactgaccaatatggtgaaaccccatctctactaaaaatacaaaaattagtcgggtgtagtggcacacgcctgtagtcccagctactcggaaggctgaggcaggagaatcacttgaacccgggaggcagtggttgcagtaagccaaggtcacgccactgcgcttcagcctgggcaacagagcgagactccatcaaaaaaaaaaaatagaaaagagagagagacagaaagaaagaacgaaggaaagaaagaaagaaaaagaaagaaagaaagagagagagaagaaaaagagaggagaaaaagaaagaaagagagaagaaaaaggaagaaagaaagaaaaacattttgagttacttctttgaaacattttgagttacttcttttctgttgttgctgttgttgtttttcttttttgagatgaagtctcactctgtcccccgggctggagtgcagtggtgcaatctctgcttactgcaacctccgcctcccaggttcaagcgattctcctgcctcagcctcccaagtagctgggattacaggtgtctgctgctaagcccagctattttttttttttgtatttttagtggagatggggtttcacttttttttttttgagactgagtctcactctgtcacccaggctggagtgcagtggcacagtcttggctcactgcaacctctggctcctgagttcaagcaattctcctgcctcggccccctgagtagctaggactacaggtgtgagccaccacgcacagtttatatatatatatatattatgtgtgtgtgtatatatatgtatgtgtgtgtgtgtgtgtgtgtatatatatagtatactgtcgctatatatatgtatatatgtatatatatgtgtgtatatatatagtatactgtctctatatatagtatatagtatgtgtgtatatatatagtatactgtatatatagtaattatatatagtatatatactatatataacaattatatatagagtatatatactatatataattagtatatatattactatatatatatatatatatatagtaattttagtagaatcaggttttcacatgttggccagctggtctcgaacgcctgacctcaagcaatccgtccgcctcggcctcccaaagtgctgggtttacaggcgtgaaccaccgtgcccagacttcttcctggcttttaatctggtctcttgtggggaggttgcccacacttttcttcccaactttcttctctgttacgtaagtcagggacaatgtatagttccttccagacttccgtattctactttcattgatcttggacctacaagtcggttttgtagctccatttttggagttttatttttttcatgatcttctttccattttcatctcctttaaatagtttctactaatataggaaaactacggatgtattgttctttattggttatgtttcttgttcttggacacaaaggcattccctagggaaatcagaagacatctacaaaattccaataatgattgaaacaaatctcaaaattcaactaaaagtaaactcaaaaagaaatgcatttaaaaatattaggctgattaattttttaagatgtcagtaatctaagatatccaatatgatgctttgccaatctatgaacaagaaaagtctgattataacagcttacattatagcaaaatgccccattacacaggcatcaaatgaatttcttatcacttagtcatctctgctaaaacaaaacaaaactcttcatgactggactttcgtcatacttctctccacacactagtaacctctctaacaactccaacaattatgttgactgcagaatacacattccctgtatgtactgctctgattgttttcctatttgtacccaatgctcctgatgatagtgtctagagcaacataagactaagctgcccatcttttcactgaataatttttcacacatttgaagatgaacacaactcattcacttcctgaaatattctcgttaaaatttttattagcagtttttgctgttattgttgttgtttgttgttgttgagatggagtctcgctctgttgcctaggctggagtgcaatgggcatgatctcggctcactgcaacctccacctcctgggttcaagcaattctcctgcctcaccctcccgagtcactgggactataggcatatgccaccacgcccagctaatttttgtattttgggtagagatggggtttcatcctattgatcaggctggtctcaaaatcctgaccttaggtgatcggcctgcctcagcctcccaaagtgctgggattacagacatgagccaccgcacccggccttattagcaattttgactagttcttcctttttttttttttttttttttgagacggagtctcgctctgtcgcccaggctggagtgcagtggcgggatctcggctcactgcaagctccgcctcccgggttcccgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctagttcttccttttcccacacttagtctgttcctctatcatgcctgaaggattcttcactattacctgcagttattgcctgtgttgaatgcagacatctttgagagaaggtctaagaataaattcaggtggcatatacattttacaatcatggagatcatgtaatcattatgggatggctgccgccaccttatttgctgtggcccagtgtcctttagttttcatgttccttctgttttttaaaggttcaatatttattgcagtgaattgcatatttcttcttcctcttaacacatgggcttttttcagtgttcaggtgcaacatgttgctttcatttcagtgttaaattgctctctggtgtccatgaagtattgcagtgtctttattttattggtcttcaggactcttccaaatatttttaaaggttttcctctctcaaaaccacttgtcttatcctcagcatcatcttgtatttgtgtgaccttcttgaagccagccagatgttctcaaggttgagccctttcctcaggggctggtgggtgactctggctgccagttacattttatcctgagtcgggaacatctgttgtaaatgatatactgccaatgggaaagaaaaaataccatctactagttcctatcccaaaacatcatagtgttaggaataaaggcaaccaattcaaactctttagagttattggcagaggtttctttcctaaattagtttcttcagacttttttcaagcaaaatttctgaatctgaaagagtgacaaaacatttgttcatcatttgtggtttcttcttcactggagtgttgagcctttcagttagctgtgttaaatgaagatatttgaaaaggaattaacgtattgcctataaatgcaaaggaccatcccaatccctacatataaaaaccaaacgattgggaataaacatcagatcactgcctagatttctgctgggctggtcctgaaataaggtgattccatgaatatcgtactcaatttttttagagttcattgagaagatacacaatatatcttctcatctttccctttcctgtttgaaaataaatcaaatgaaagcagttgacctcagtcatctaccaaccaatccccaggtggagctctggcgggaggataggacttggccatcggtgctttcacgtcctgcctcctctccaggttctagaatcctagtgcccttgggctctcttctaaacatctcgggtcctaaagttctggatttaatataaaaagaaaatgctcctgcattttataaaatcacagagggctgttcatatttagtgttgtcaagtaaacatgtattagaaaaacagctagtatcatcatgtttctattttaacaccaaaaaaatagtattgacataatgtcaggaaaaaaaaagaacaccaaataaagaactgtaagtggaacatttaagtttctgaaacatcgatattaatccatgttcttattttttcatcgtgacagggatggatgaaacactttctacagctggagtccatctacaagatgtttctgggaatccctgtttgtgaaggtcccactcaatcctaccaatctatccatctcactttttttttttttttgagatggaatctcgctctgtcccccagtctggagtgcaggggcacaatcttggctcactgcaacctccgcctcctgggttcaagagattctcctgcctcagcctcccaagtagatgggattacaggcgtgaaccaccatgcccagctaatttttgtatttttagtagagatggggtttcaccatgttggctaggctggtcttgaactcctgacctcgtgatccgcctgcctcggcctcctaaagtgctgaaattacatgtgtgagcccccgcacccagcctccatctcacttttaatatttcttctaccacagcctttcaggccttatttaaataccccagatagtcttcagcagatattggtgtatttgtatcaaaagttacttatattagggtttagcattgtttgaattcctaggaaagtgtcttcaaaaaagaaatgcttgaaataattcagcgttccatgtgctgagtatttaaatgtccatttattttacctgaaaaatactttgatattatggtagtaataataatcacagtaatgtataaagttacacatatatgaatgcctcagtagatgtgcataacaggtcgtatgtactcaaaatattttgctggatgagacattctgtgaaaaactttgctacctcctctttctttctttctttcttttctttctttctttccttctttctttctctctctctctctctctctttccttctttctttctttctttctttctttctttctttctttctttctttctttctttctttctttcttctttctttttagctaaatgtgtttatctttatgtggctgtttggtaagtagcttccatgggctacaatgagaagcacagcaactcttccattttaacatcagccatgaaatcaaacaagattccttttcagcagtttaatctcaaagcttcccaaagcttctcaataactaactaactaactaactaactaaataaataaataaataaaaaagtctcccaaagcatcgcagtacaaacaaccgctcgatttatacaacccaggaagatcaaaccctgggtgcctggcatggttctaatccagtacaaccatcaccacgtcaattcccacttttactgagatggagattcaagtggcaacatttcctcgactattaatggtttaagaaaagcatcttacagtgtgttgtttccagaaacagctatgccccctggaaggaaagtacgtcttaacaacacaaaatagtggtcaaaaccaattacttaacactgggacaatctattattataaagtcagtaagacaggcaggtataatagcaacagctttcctcaccataaggcagctgcccggtttctacatatcttctgctttccagagtaaagatgtgcatttgacatttccatacctattatatgcaggacacgcgatcccgagaaactgtcagagcgtttttcttgtaccccagaccagccttctgttccttggatattaaaaccccaggaagttgcctggcttatttataccactatccctctcacagcagacagacagatgtagcacacagcaacacagtcacaaatagtaaaaataacaaatagtaaaaataacaaagggttatgatttgtgagacaaaggctatgttttcaaatgaacgatattcattgtaaaaattttgttgaaaacaaagtactcgtaccttctaaatagaaataataaataaataaaactaatatagatttgaatctaattgacatatatagattgaagactgcaaccaacagttgtagaacacacattcttttcaaacacataatacacagattagtaaacattgcagccatatctgatcacaaagcaaatgccaacacatttcaacaactagaagctattgaaatgtccatccagaacgataaaattgtgtataattatgtgtattatttatttttcttcctttcttttttttcagagacaaggtcttgctctgttgccaaggttggagtgcattggcacaatcatagaccactgcaacctcaaactcccgggctcaagtgatcctcccacctcagcctctgagtggctgggaccacaaatacacaccatcatgactggctaatttttaaattttttgaagagatggagtctcactgtgttgcccaggctggtcttgagccctgggcctcaagtgatcctcctatccttggccttccaaagtgttgggatgacaggcatatgccactgcaccaggcaggtatattatttcaatcaaatagttaatgtaaacaaatgacaactacaatcaatattttatgattctcataaggactagagacatcggacataattacatactttattatttaatttttgtgaagtttagtaatgtcagacaaaatatagtgttcaaagatgcatgtttaaaaataaaactcaggctgggcacagtggctcacatctgtaatcccagcagtttgggaggctgaggcaggaggatcacttgaggtcaggagtttgagaccagcctggccaacatggtgaaaccccgtctctactaaaaatacaaaaattagccagctgtggtggcgggcatctgtagtcccagctactgggaaggctgatgttctgtgcaggaaatgcatgaggggagaagaaatggcacacacacaatactttaaagggtaaacaagctttaccccatgtaaatggcaatgcagatataataaggaaatgacataataagcaaatgatataataagaaaatcaatataataaggatattgttacaataagcaaattgcaatgggaagagaagggaaaaagatacttacactcaccagactatggaggattcaccaccaaactgggaagcaacatcttgggatccagagtcgaccacttgtccatgcagacaaggaggggtctcatgaagcttctgcgtggtctgagaccctagctctttttgtaacgagttgtttggcatgaggtccagttacgagggcccttcgtgacggggctcaaggaacacaaaaaggtcaacttgtttttgcaattatctattgtttttcaataactaacgtataggaatagattgaaatagggatttctttgaaacagtgctggatgaacgccttaaggggctcacacaacctgttccgagacttggtgaccattgtttctgtccacaaccaaatgagttcacatttaatatttaactattcctccacaaggctgaggcaggagaactgcttgaacccaggaggaagaagtttcagtgagccaagatcgtgccactgcactccagcctgggtgacagagtgagactcaaataataataataataatttaaaaatatttaaggtctggcatggtggctcacgcctgtaatcccaacactttgggaggccaaggtgggtgtatcacgaggt

SEQ ID NO: 1143 - DNA, 51347 bp, Homo sapiens
atacaggtggagagtgagcctggggacaaatacatgtcctgtctggctgcaatctgtggatgtggggtaagaggaagaaagagtagcctctctttgtacagctcagttgaggctaccaaattctttcatatccttgaattcagttggcctttaagacaggccatgttataattttaatttttaagcagatggagagaaacactaggcttacatcaaataatatgcccaaggtcaacaaggaagcaagggaaataacccaggtctactacaggatccatactcgggcagggcactgtggctcacgcctgtaatcccagcactgtgggaagctgaggcaggagaatcacctgagcccaggaatttgagaccagcctggccaacaaagtgagaccccatctctacaaagtaaaaaaattaggcgtggtggtgcatgcctgtagtcccagctactcaggaggctgaggcaggaggattgcttgagcccaggagtttgaggctgcagtgagctgtgatcacaccactgcactccagcctgggctacagagtgagatcctgtctcaaaaaagaaaaaaaaaaaatccatgctcctcccagcaagccactctggctgtggcgtggccttgctcttactctcaagttttatgtagcccagttggaagccaagactgatacgtggaaggacaactgaggacacacagcgggactcaggaaagctgaatgcatcaggaagcaggggacttgccaatggatcttgaggggcagtgagacttgactgtagcttcagggatgggcatttagacaggtgaaacagcacgagggagtgctacatggaaagcgagaaccagccgaggtacggaggtggaagtaactgattctgactgggcacggtggctcatgcctgtaatcccagcactttgggaggccgaggtgggtggatcatcttgaggtcaggagttcaagaccagcctgaccaatatggtgaaaccttgtctctactaaaaatacaaaaattagccaggcgtggtggtacgcgcctgtagtcccagctactcaggagactgaggtgggagaatcacttgaacccaggaggaagaggttgcaatgagccaagattgtgccactgcactccagcctgggcgacagaacaagactccatcaaaagaaaaaaaaatagaagtaaataaggagacaggaggccaggcacagcgactcatgcctataatcgcagcctgtgggaggctgaggcaggaggatcacttgaggccaggagtttgagaccagcctgggcaaagtagcaaaactccatttgtataaaaaaaattagccaggtgtggtggtgcacacctctagtcccagctactcaggaggctaaggcaggaggaggatcgcttgagtccaggagttcaaggctgtgggtaagctatgatcatgccactgcactccagccaggcaacagacctgtctcaaaaaaaagaaaattgagaggccaaggcaggcaggtcacttgaggcaggagttcaagaccagcctggccaacatgatgaaactctgtctctactaaaaatacaaaaagttagccagtcatggtggtgcacatccgtaatcccagctactcaggaggctgaggcaggagaatcacttgaacccgggaggtggaggttgcagtgagctgacattgcatcactgcactccagcctgggtgacagagcgaggctctgtctccaacaaaagaaaaaaaagcaaaaagaaaagaaaaagagacaggaatccctaagcttgcctccctcatgggttgatcacacctttcaagagcaaagcaagatgagtcccaggtaccactggagattgaagacttttagggatgtgaggggagggaggctatggagagaaatgaggctggagggaaagcagggttggatcacaaagcacctcgaacacctgccctgaagcctggccttgtcagaggcaaacagtagccaaagaaacaactgaagcacacgagctccaacttgtattgtctggagtcctccctacctctggcctctctacattaggtgaaatggtaactttccaccttgtttaagtagtggttctcaaagtgaggtccctggaccagcagcactaggaatgcaaattctgtttttgagacagcgtctcaccctgtggcccaggctggaatgcagtggtgcaatcatagctcactgcagccttaaactcctgggctcaagtgatcttcctgcctcagcctcctgagtggctgagactacaggccaccgtacccagccaggaatgcagattcttagactccatcccagacctgttacttggtcagaaactctggaggtggggcccagcaagctgtacttttttttttttttttttttttttgagacagtcttgctctgtcgcccatgatggagtatattggtgtaatctcagctcactccaacctccacctcctgggttcaagcgattctcctgcctcagcctcccaagtagctgggactacaggcacacaccaccacacccagctaatttttgtatttttagtagacagggtttcgccaagttggccaggctggtcttgaacccttgacctcaggtgatccatctgcctcggcctcccaaagtgttgggattacaggtgtgagccacttgcctggccctctagctgatccttaacaagctctctagttaatcctgatgcatggtacagtttaagaagcactgatttaaactaatttgaacccctacatgtaatttgcagctcaaagcctctattacagtggttcttgaccatggctccatattggaatcactttgaagatgctgatgtctaaacatcatactggctgggcatggtggctcacatctgtaatcccagcactttgggaggcagaggtgggaggatggcttgaggccagatgttcgagaccagcctggacaatataacaagacaaaaaaaagtctgtagagtctctacgaaaaatttaaaaattagccaggcctggtggtgcatgcttgtgatcccagcgtttggcaggggctgaagtgagaggatcacttgagcccagaaggttgaggctgcagtgagctgcgtttgcaccactgcactctggtctgggtgacaggatgaaaccctgtctcaaaaaaaaaaaaaaaaaaaaaagtaaagccaccacgtttattttattttatttgtttttgagacagagtctcatctgtcgcccaggctggagtacagtggcgtgatctcggctcactgcaacctccgcctcccagattcaagcaattcttttgcctcagcctactgagtagctgggattacaggtgcccaccacgccaggctaatttttttttttttttttagatggagtctcgctctgtcgcccaggctcaagtgcagtggcgcaatctcagctcactgcaagcctgcaagctccgcctcccgggttcacaccattctcctgcctcagcctcgcgaatagctggaactacgggcgcctgccaccaagcctagctaattttttgtatttttagtagagacagggtttcaccatgttttccaggctggtctcgaactcctgacctcaggtgatccaccagccttggcctcccaaagtgctgggattacaggcgtgagccaccatgcctggcccacattattaataattaatgcatgtttaagtttgagaagctgttcactgtaagggatacaggaggctaatgcacatgtatggaagaggcgatgtcctattggaccagggcggtggctatgaaggtagatgttcaattggccaggcttccgtcctcagtgacagctagcgcagggcagcggggtgtgtggaggagctgaagatgatggtttccagcttgcacaagtgtccgggtggtggtgcctgtgccagggctggggcacacttggaggaccaggtttgagtgggaagattatggaagtggtgagttctgtattgggatccgtcagtgttaagggagctgcggagcgctcagagggagaagttagggtgatggtcggacatgtagttgtgtagctctggggagacagcgaggcagatacagagtcggggtcctctgcagagaggctgaaggggatgagatggcctggggcttgccagagagcaagaagggaatggctaaggaagggacaggcctagaaagaggctcacacagcaggacctgggagggcattggcagggaggaggaaaggagagcttggcaagaattctgttttgttttttgtatttttgagacagggtctctctctgtcgcccaggctggagtgcagtggcgcaatcatagctcactgcagcctcgaactcctgggctcagcctcccgagtagctgggggtacaggcccatgtcataacacccagctaatttttttgtagagatggggtctcactatgttgcccaggctggtctctaactcctggcctcaagcaatcctcccgccttggcctcccaaagtgctgggattacaggcatgagccaccgagcctggccgagaattctggactcccagggaaagagtggtttaagacggaggcccaagggccgcagaaaaaccagaatagcactatgaagcaggcactggatttcgcaaggagcgggtcagtcagaggtgagctcagtgacagcagagtcagcgcaggggtgaagctggggtgtgagggtggaggaggagcccaaacgtggggagccaagaggggagagggaagagaggagggagagtgagcacgtgtagatgactctttcaagggaagaagccatctggaagggacacggggtcaaggggatgtttgatggggaacttctggccgcgtgggagtgaaaacagcagcgtatacactgcctggaccctcccttgcggtgagccacggccagcctgtctgcagcagcaaagagcatgcgtgaaaggctgggcgcacctgccaccgtcacagcagagaagcggccaacggcagacgaaggcagttgggtgggcactgctgggctgcttaccagcccagcaagctgagtcaagggaccgaaactgtctgtgtctcagtttctcacccgtaaaatggggatgctgataattattacaactcattctcattcttacatagtgttatatatttataatatatattatatataatgtatataattatataatatatataaaatatatataatgccctgtagcttccatgcctcggttccagctctgccttcttctaactctgaataataactatatattatatatattataatatataattatatattatattatatattatattatatattatatataatttatatgatatatattataaattatatatattatctattatatataattatatttatatgtatttaatacgtatatataattatattgtatatttataatatataattatatattacatattatatattatacatatatactatattataattatgtatttatatcgtaatatataattatattaattataatatataataaattatattatatatttataatatatttatacattataaacaaatatgtactttatttgttaaagtatatattatatataatttatagataaattagatataaattaaatataatatatttaacttatatattatatataatctatatattataaacaatatattttatatatttatatatttatatttattatatatttatattataaatgtatttatattataaatacatttataatataaatataaaatacatttataatataaatacatttataatataaatataaaatacatttataatataaatataaaatacatttatattataaatataaaatacatttatattataaatataaaatacatttatattataaatataaaatacatttatattataaatataaaatacatttatattataaatataaaatacatttatattataaatataaaatacatttatatttattaatataaaaataaaatatatttatatttaatataaaaataaaatatatttatatttaatataaaaataaaatatatttatatttaatataaaaataaaatatatttatatttattataaaaataaaatatatttatatttattaatataaaaataaaatatatttatatttattaatataaaaataaaatatatttatgtttattgatataaatataaatatatttatatagttttattgatataaatataaaatatatttatatagttttattgatataaatataaaatatatttatatagttttattaatataaatataaaatatatttatatagttttattaatataaatataaaaatatatttatatggttttataaatataaaaatatatttttataaaatgtaatatatttatatattataaatataaaactatatagttataaaatgtaatatatttatatattataaatataaaactatatatttataatatataaagattatatataatatataaagtatattgtatataaagatttatataatatataaagtatattgtatataaatattatatataatatataaagtatattgtatataaagattgtataggttatacaaattgtaatatataaattaatgtaatattatatattatatataaagattatatagatatggctgggcgcagtggctcacgcctgtaatcccaacactttgggaggccaaggcagacggatcacgaggtcaggagatcgagaccatcctggctaacacggtgaaactccgtctgtactaaaaatacaaaaaattagccaggcgtggtcgtgggcaactgtagtcccagctactggaaggctaatgcagaagaatggtgtgaacccgggaggcggagcttgcagtgaggtgagatcccgccactgcactcgagcctgggtgacagagcgagacgccgtctcaaaaaaaaaaaaaaagattatatagatatatagattaacatataattatttaatctttattctctatataaaaatttatatataatctatatctttatatgtagaatatatattaactcatacatattttatataaactataaatataatataatatataaaaatatattaaatataatgtataaatataatctttgtatattattaaacataatatacaaacataatatatatataatatataattattatccccattttacagatttataaatatatgtataaatctgtaaatctctatatgtgtatatttacccttttaggttctcacagcaagcctacgaggtaggtgttgtgaggattaagtgagttaatatacataaagtggccaggtgtggtggttcatgcctgtaatctcagcactttgggaggccaaggcaggaggatcccttgagcttgggagctgaagaccagcctggggaacttagtgagaacttgtctctactaaaaataaaaataacaacaacaacaaaaatctaaagtgcttataggagtgcttggcacatagtccatactagatctgcgggcagcgattctccttcttcttatgcacgaacgagagaaactgaaaacctatggaagatactttaggctgtttaaatcctgcaaatgggccaggcacggtggctgccacctgtaatcccagcacttcaggaagcctaaggccaaggtgggaggatcacttgcggtagggagtgtgagaccagcctgggcaacatagcaagaccctgtctctatgaaaaataaacatgaatacatcagtcctgcaaatgtctccagaaggtctgaaacgtgagaggattccaacatgccaggctggaatgtcagctccacaaagagagagatactgtagtgaacagcatctgcagagccaagaccacagcctagtccatagcaggcactcagtaaatattggggcctctgaggccttctaccccagccccatctgaaggatcagtttttttattttttgtttttatgtttttttgagatgaagtctcactctgtcacccaggctggagtggagtagcgcaatctctgctcactgcaacctccacctcctgggttcaagggattctcctgcctcagcctcccgagtagctgggttacaggcacctgccaccatgcccggctaattttttttgtatttttagtagagacgggatttcaccaagttggccaggctggtccggaactcctgacctcaggtgatctacccgcctcggcctcccaaagtgttgggtggcgtgagcaaccgcacaggccgctgtcagttttttctaagacatcccaactaagtggccatccactctctgcatgcatacctctcatagcggggaggtcactaccctccatacctgccccgccaagggagcacattctccttctgggtggttccagtggatgccctgtcggttccactccttggtcccagctctgccttcttccaactctgaaggtagcgagcctctccaaactgtctcctggccatggagggaggagctccaggaagcaaatctatcacctctcacctggatgactgcaactgtcctctaactggtctccctgcatccacctagtctcaactcagcacccaggggattcctgtaaaaaagttacatctggccagacgccatggctcatgcctgtaatcctggcactttgggaggccaaggcgggagcattgcttgaacccaaaagttcaagaccagcctgagtagctgggattacaggcgtgtgtcagcacatgtggctaatttttgtatttttagtaaagaccgggttttgccatattagccaggctggtctcgaactcctgaccttgtgatccgcctgcctcggcctcccaaagtgctgggattacaggcgtgagccaccacacccggctgctgactctattcttataagaaaaatttttttgtctgggcgcggcagcctcacacctgtaatcccagcactttgggaggctgaggagggcagatcacaaggtcgggagttcaagaccagcctgaccaacatggtgaaaccccgtctctactaaaaatacaaaaattagctgggcatggtggtgcgcacctgtaatccctgctactcaggaggctgaggcaggagaatcgcttgaacccgggaggcgaaggttgcagtgagccgagattgcgccactgcactccagcctgggcaacagagcgagactctgtctcaaaaaaaaaaaaatttttttttttaaagttacatctggcagggcgcggtggctcacgcctgtaatcccagcactttgggaggctgaggtgggtggatcacaatcgtggtcaggagatcgagaccatcctggctaacacggtgaaaccccgtctctactaaaaatacaaaaaaaaaaaaaatcagctggacgtggtggcgggtgcctgtagtcccagctacttgggaggctgaagcaggagaatggcatgaacccaggaggcagagcttgcagtgagccgagatcgggccactgcactccagcctgggtgacagtgcgagactccgtctcaaaaaaaaaaagttacatccgattttcttttatttatttttctcttttttattactgagatgaggtctatgatcctcccgccttggcctcccaaagtgctgggattactggtgtgagccactgtgcccagccttttttgttgttgttatttgagacagggtctcactctgttgcccactctacagtgcagtggtgctatcatagctcactgcagcctcgaactcctgggctcaagcgatcctcctgcctcagcctcctgagtagctgggactacaggcgctcgccaccactacatctgatcttgtcccacctccactcaaagccctccagctgcttccagctcagagtaaatgcccaggccctctgcaaagccacttcccactgccaacaggctctctctccatcccagtgtgagacactgaccagcacaccaacaaaccagcagacagtttttgcttttattggtcaagaattctttacaaaacccacacacacacatccacacacacacacacacatgatgcctgccctgctgtggtcactctggccctggtgtctcctgggatcaggccctcctggcctctcccaggggaaaccatcctgcagcccctctgggtcagcagtgaaggagcagagagagggaacctccttttctgcttctctgctcaggaacagaggtctgtgccccacctgtcggggagcaagtggaggtgacagagaaacagcatcctcctctttccaccgttgagcccccggagttgccagcctaggcccccaatgtcacagctgccaaggcctgggggtcatctgctgattgaaccttccccatccccattttgcagattgaaacacagcggtccaaagacagcggacgagtcacccaaggtcacggtgctggagcacagtggcagagcagggacggggactctgctcttcttgacctccaggaggtggcaagtgtgaaacctggaccctgctccaccccccagggaagggcagagccagggcctggggcaggaagggagtgcccagagatgatccctggagcccgtgcccagggaaagcagcccccagggcagctgagtgagcagcagggtctggccaggactataaaggtttgccaagggtgccctctgtgactgcccgtgtggcttgctcagggatgcggcccgggtcggtcaggatactggtagatgtgcccagctggcgtagggagttcaggacagctgggtgggagacagagagagagagacagacacttcctggggtcagggccctacccttggatgtggaaccaaagggatagggggaggtattagttggcaagactgtcaccccctcctagaacctctgtctacaggcgtctggtggccagaggaccatctgggggatgcggggtggccacaaccctaggctgtgttgatggcaagctggatgtgggatctaagcagggtggaatgctccctccacccccgaggctgggtccctctagcaggcagggagatggctcacgtacttggccggagagcgggcagagagcagtactggtccagccaggccagtgaggtctggcggagggtgtgcacacttgccgtggacaccatcccgttgaaggactcaaacagaggccggatgaggatgctgaactgggcccaggtcaaggagctgcctgtggtccagctggtccccccacaccacgtggagccctgatgcccagttcaaaccaggggaagaaagggcctggacactgtctaacgttgaaccccaatgactcatgttgcagcccctacttcttctttttttttttttgagacggagtctcgctctgtcacccaggctgaagtgcagtggcacgatctcagctcactgcaacttctgcctcccaggttcaagcaattctcctgcctcagcctcctgagtagctgggattacaggtgtgcgccaccacacctggctaatttttgtatttttagtagagacggggtttcgctatgttggtcaggctggtctcgaactcctgacctcgtgatccacccacctcagcctcctaaagtgctggaattacaggcgtgagccactgtgctcggactttttttttttttttttttgacagagtctcactctgctgcccaggctggaatgcagtggcacaatcttggctcactgcaacctccacctcccaggttcaagctgttctcctgcctcagcctcccgagtagttgggattacaggcacatgccaccacgcttggctaatttttgtatttttagtagagatggggttttgccatgttggccagtctggtcttgaactcctggcctcaagtgatccacctgcctcggcctcccaaagtgctgggatgacaggcgtgagccaccgcacctggcttgcagtccctacttctgtcctgccaagaccttcccagctctctgcctctcagtcccctcctccttgcccctccacggcccttactgtgtgctgaaccatcccccatccctgagctccctgcctgggctcagtcaagaacttgacccctgagccagatcagggagtggattccaagtcttctgtagtcctcactccagagttcagattctcccaaactgccctcggggcttcctgaggtcagggccaaggctccccttacccaaggactcctccctcagtttccctctctgctcccagccccccatccctgggcaattttgctggccaagatggccagggcatggaagcagggggcagagccagagcctgtcacctgggagcagctctgagcctgcccggcctggagagctaggcctccatcccaggcccagcctggtctcaccctgccacagcccctgcagccccccagccatgggcttgagggaggataccacccagaacttccagttgtgcagcgtacgggttcggacgtagtcatcaaacatgtctcgcatctggtcaaaacgctggtgtgtgatgggtacccctgtggcgggcagctgctgctggcacaggctgggggcagggcaggggtcaggggctgggggtaaggcggcatggccccctggtcccagcacccgcctggaccctgcctacttaatggcggcattgagctcctcaatctcatcccgcagctgctgggcctcctcctgcaagcccgcacgctcctgctgtagcataaggatgtactcagctgtcttctgcagcgtggtagctttgctcacctgcagacgccaccaggggggctcaggcaggtgctagaggctgtaccctgggacccactgaggcactgggatgggaggaggcaagagtgtctggagcactcccctgcaattgagttttgggtggggggggtccagaaaggggccctgtggttttgggggtgccagcctgggcccggggctcaccttgaggctgggctgggcactgagtgtgctcacgagcccatgaagggtgtcaaaccccagcttgatgttgaagcgccgcttctgctccgcggagatgtgtgtgatacgccggttctcggtctcggggagcagagagttgggtgagcctaggaaggagcccaggagggcctgggggtagcaaaccgatcttggggtgggggatggtgcccaccttgttgctgtctggacggccccggctgaggatgggttgcgggggagagacacggacgctcagagtcccagggcctggcatggagctgaggtcccctgacagccgccgttcactgcctgtggtagggacagacagacccacagaaagaccgacccaggggaaagggtccccattgcccccttcctctcatctggccccagacccagtccccttcttcttcctcctcttcccctcatcccctagattcccccaatccctgcaacccctctctttaccgctgggcgctgggggtgagagccgctccgctttggggacaagcaggggcctggaaggggccaatgtggccgggcctggaggtggccggggcggtgtaggggccggggtcgggggaaggaatgtgcaggggaattcagggactgtctcctgctggggtggagaagggcggagagtcgggttgaaggccgtgggcacagccccaccgcccagtgcccgagatcttaccggggaccctggggaccggaggagggtgctggatacaagtggtggctccagggcttgctccggcttagctgtgcacgggcagaaccgtgaggctactggggctggcccacccccggcatctatcaagaccccatcctgcccctcccaagagtccacaccccttttaggtacaggccccacatccctcattccttgccactctgtcccttgaactggacctgccccttcaccttcatcttctgctcccaaaaccccctgtcctccccaccccctggcctccctccccaggctttcctctccccgttgctggccctcacctgctgtgagcagctgtgtgaggcaggggttgttgctccccgcagtggtggggggactggcagtggcaggggctaaggtaggggggctggctttctgtcccctaggggatggggcggggggcttgcctctgggcatggagaagcaaggcccaaaggcaggctccgaataccccaagggtagaagctctatggggaagggggtgggggctgggctggggacagactgtggggtgggtgggaaggctgcaggagcaggcagcggagacactcctggggcaggagggacggtggggaagggaaacctgggagagaagagaggctcttcctgcagcaaagcagtgggtggtgccatgggagggaagggaggtggggggcagggctccaggcctggcaccttggcagggggagggtaatgcagcagaggtgggggtacaggagggggtgggagccggggcttggggtcttcaggaaggaggaaatcagaactcaggaaggcgctggagtccaaggggccagggcagctgttccgagcctggttggggggacagacagacactcagagagcaggggagagagctgcccctggcagccatctgggcctcccctgccctgccttgccctggccaaactctagactggggccctggggagagataggagaaatgagccctgccttccaacacacacaggtgtgcgaacatatacatgcagcagggaaattacaatgagaggagggagtcgagtacatttatgcaaaaagcaggaacagcggagcatcaatcttcctgcccgtccatttgtctcccaaataacttattcatccatccatccactaacttgtccaccaatccatccaccaaccaactcacccatccattcatcatccatccatccactaacttgtccactgatccatccaccaaccaacctaccattccttcatcatccatccactaacttcaccaatccatccactaaccaacccacccatccattcatcaattgtccatctactacttcatccaccaatctctccatccatccgtcttccatccattcacctacctatttatcaatctatgaaccagctcatctaccactctctccaccagcctaccagatattaacatattaactaatccatccaaccatctatacttccatcattcatccaccaacccatccataatccttccatccatccaccatctatacatttccagccacttaaccaccaatgaacccattcactaatccattaaactattcatctatgtatccatccaccagcccacccatccacccaaccactcacctacccatatatccaccaacccacgtgtgcctccaccgcagtctaagatgcatctatccattcaccagcacgcccattcatctgcacacttgctcattcattcagtcactgactcactcattggacaaccattcactgagtgctgttatgtgcctgagctgtattaggtatagagaatgcagtggtgagcaaaacataaccctttcagtaaggagctcactgtctgatggaggagagacacccctcagcaaccgattagaattagcacctgaaaagtctgatgatggagggaaaaggcctataaccaagcagcaggaagcaacttctgaactgcacctgggggccaggtgtggtggctcacacctgtaatcccaccaccttgggaggccgaggcgggcggactactgaggtcaggagtttgagaccagcctgggcaacatggtgaaaccctgtctctactaaaaatacaaaaataagccggaaatcgcttgaacacgggaggcggaggttacagtgagccgagatcatgccactgcactcgagcctaggcgacagagtgagactctgtctcaaagaaaaaaaaaaaaaagaattgcatatggggaattgatgaaccaaaatggtagattcactgtttcctaaacatccacgctcagctttctgcctcgaagcttttgttcctgctgttctcccatctggcttgaggtcagccagtcccttctgtccaaagctgacctattctctaaggcccagaaactccccttctccaggaagccttccacaagcaactggcccttggtggagcccattccatggtctccatgcccttagctttctcccacaaccgttttgtccagttctgcttcacggggtccctcccagagggcagagatggggtctttctttccctccaatctccaagcagaagactgggcactcagggagtgtctgatacctcctggacatgaacagggcaggaacagctctcaagtgagctacacagggctggacggggtggggtgagctcacctgcagacggctgtgtccagagaggtgggtcatggccgaggaagccgggggcacctctgggcccagggtcccactgctgaagagggagtcaaccacggggctgaagctggggggctctgggaagtttgaaggcatgggcggctgtgggaggcgggagttggtaaagaaatctgtaattcagacacacagggcaacagcagttagggccagggctatggctgggaaacagctgagaggagagtggcctgtccccagccttggcgggtggggacatggggactggcgggcagagggtgggggtcccttccacagaagattgtgaaactgggagggtttctgtctcgattaggggaagcagcaaccgtcttgggtggaatgagcttgcgtgggagagagcaggggactgtggatgtgaacagggaccccaggaaggagccccctcccctccccagccccaggcttagctcaggaagtccccctccccaccccctggtggctccccttccctgatctgctggaggtgcagaaagggggtgcccagagcgagtgccagggtggaaaaggggtacggtgctaggggaggaggcctggcatgggaggggccccagggtggcagaagttcaagagggtgagttggagatgagggggaacgtgaggtcactgggtccgggacaagcttggtttgttggaaggtcaacaggtggagcctaggagtggggtgaagagtgtaatggggcgagaggggcctaaggctgggctccgagtggggtgggggcgagaggggcctaagggtgggctctgagtggtgtgtgggcaagagggagatatgggtgggctctgagtgggatgggggtgaggggggtgcctaaggctgggctccaagtggggtgtgggcaagaggggctaagggtgggctctgagtggggtgggggcgagaggggcctaagggtgggttctgagtggggtgtgggcaagagggggatacgggtgggctccaagtggggggggggtgaagggggacctaagactgggctccaagtggggtgggggcaagaggggctaagggtgggctccaagtagggtggggatgagagggggcctaagggtgggctccgagtggggtgggggcgagaggggcctaaggctgggctccgaaaggggtgggggcgagaggggccctaagggtgggctctgagtggggtgggggcgagaggggcctaagggtgggctctgagtggggtggggcaaggggtctgggaagcctgcgagagctgggggaggcagtagcggattgtttggggtgcgggttgtgtaagtcctgggctattctggttttgggaagcagctggccacggcctgaccacatcccgggcctgggcgccgcccgcccacccgctcccttccgggcacctttctctgaccctgaccagcctgtgatccgtgccagctcctgaggcctcttagtctgggcagttccgaccccaccgtgacaactccccacagacctgggtgggccccagctcccagttttttccctcccacccccctgccaggagagctgctcaagtctgcctcccaggagccacctccaaggagaccaggagtcagttagataaggtcaccccaaacccagaacccactgcagggtcaagtgtgtgtgtgtgtgtgtgtgtgtgtgtgtgtgtgtgtgtttgtgtcttcacccccaaccccatcccccagagatagaatcgtgctatgttgcccaggctggtctcaaacttctggcctcaagccatcctcctgcctcagcctcctaaagtgctgggattataatgagcttgcgtgggagacagcaggggactgtgggtgtgaacaggaaccccaggaagcagtcccctcccctgcacagcaccaggcttagctcaggaagtcccccttcccatcccctggtggctccctttccctgatctgctggtacagaaaggaggtgcccagagagaatgccagggtgggaaaggggtgcagggcgaggggaggaagttagccaccgtgccttgctgtcacccaggttggaatgcggtggcaccatctcggctcactgcaacctccacctcctgggttcaaacgattctcatgcctcggcttcccgagtagctgggattacaggcatgcaccaccacactcagctaatttttgtattttttagcaaaaatggggttttgccatgttgcccgggctggtctcaaactcctgagctcaagcgatcctcctgctttggcctcctaaagtgctgggatgacaggagtgagtcaccgcgcccggccctgtgtgtcgtcagtggctttgctttgcaggagggtgcagagcctgtgtgttgcagtcgctgaaccctggagtctcagcatggggtctgcacgcagcctctgcctaccctctgggtgtctgtcgctccgtctgaggccatgtgaacctgtcctgccatgatagcatggtgcacgtgcgtctgctctgtgcctgtccgcgtgtctaacctcatggcaaaacggtgtcttcttgctgtccacctgcctgcctgcctgcctgcctgccttcctgcctgcctgcctgcctgcctgcctgcctgccttccttccttccttccttccttccttccttcctttctttccctctctctctttctttcatctctctctctctctttctctctttctttctttttttttttttgagatggagtctcgctctgtagcccaggctggggtacagtggcacgatctcggctcactgcagcctcccaggttcaaacaattctccttgcctcagcctcctgagtagctgggattacaggcccccctgctgcctttctttaaaagggggaccaggccaggcgcggtggctcacgcctgtaatcccagcactttgagaggctgaggtggacggatcacctgaggtcaggagttcgagaccagcctggccaatgaggggaaaccccgtttctactaaaaaaaaaaaaaatacaaaaattagtcaggcgtggtggcgggcgcctgtagtcccagctattctggaggctgagacaggagaattgcttgaacccgggaggtgggggttgcagtgagccaagatgatgccactgcactccagcctgggcaacagagcaagattccatctcaaaaaaagggggaccaggtgggagatggcgagtggtcactgctgctcccccatctcccagggtccacagttcctgtcactaggtccccgaggccctggctctagaatcagcctcatgctgtgcctggccccaggccgctgagggcctagggctcctccctgctcacagctgctgcccactccctgggtcccgggcaggggtcatggggccgcaaggccctctcatccctgagtcaccagccacccgcttaccatcgttgcccaggcctgtccccaccctgccttgagagaagttgcttcccagcccgagctgctcaccagggcccaagtccctccctagcctctgtcccctccacggacctgacctgtcatcccctccctgagctcctctgcctctggctgcctccctgagcacccctcactaagcctcctgcctccatagagttctggtcccctccctgggtttccagccagacctccccagtgggaggctcttgggggcaacgagagctgccgtcttggtggtaccagtgcgctctgccctctgggtacacggaatgtttgataagagagggccacacgagccacctcctctgtgtggcccacactttttcccccatgcgccagcagccacccgggcttgccagacatcgcctcctagccccagtccctgctggtcttgcccagaccccaggtgggggtggctgggctcctacctgtggccgggcgctgtgtgcccagacagggccgctgccctcccaggctggcctgctcccagggcactgccatgcacacttctgcccctgggcagcccccaccccctcccgggactggaacaggggtgggggtggttcctcattccctagttcccgccccataggcctccacctcttgattgacaggcccaggaccccgtggggaaggaattaggaggtcactaagactaagctttatcccagggaccctctttctgtccccaggggcttcgatgagacgggctgagcctggatatctacctggcccgcacatagctccgggggtccctaaatgtgtggctatcgggaataacctgcaagacctacagcgaagtgaggaaggccacttggaaagtcaattgtgaaaacagagacatttgtccacatgtgcttctactgacaggagcatctctgggaggacactgaggaatcagtaacttggtggccctgtggtcaggagagggaggcagggacactcatgacttacaaaaattgctttaggccagacgcggtagctcacacccgtaatcccagcactttgggagtccgaggtgggaggatcgcttgaggtcaggagttcaaaaccagcctggccaacatggcaaaaccccgtctctactaaaaatacaaaaagtagctgggtgtggtggcacatgcctgtaatcccagctactcaggaggctgaggcacaagaatcgcttgaacctgggaggcggaagctgcagtgagctgagatggactcactgcattccaacctgggtgacagagtgagactccgtctcaaaaaaaaaaaaaaaaaaaaaaaaaaaagctttacaagatatgatgcatgcctgggattttctttaaaataacgcactgggcacggtggcacacacctgtaatcccagcactttgggaggctgaggtgggaggatctcttgagcccaggagttctagaccagcctgggcaatacagggaggccctgtctcttcaaaacataaaaaaaattagccaggcataatggtgcgtgcctgtggtcccagctactcgggaggctgaggtgggaggatcacttgagcctgggaggttgaggctgcagtgagctgtgattgtgccactgtactccagcctgggcaacagaatgagaccctgtctcaaaaataaattaaattaaaataaaataaaatagaaacataacagaagagaaggaatgttctcggataaaagactggccaagagttgataagtcggtgacatcagtgatggtgacttgggaggtttttgctgagctactctttctctactagtgtgtgcatgtttgaaatgttctctagtaaatagttttattttttattttaatttttttgagacagagtcttgctctgtcacccaggctggagtgcagtggcgcgatctcggctcactgcaacctctgcctctcaggttcaagcaattctcccacctcagcctcctgagtagctgggatcacaggtgcctgccaccacgcccagctaattttggtacttctagtagagatggggtttcaccatattggtcaggttggtctcgaactcctgacgtcaggtgatctgcctgactcggcctcccaaaagtgctgggattacaggtgtgagccaccatgcccagcctagcaaatagttttaaaatgcattgtgtgaaaaataaatagacccaaataattcaaagttcttctctcccctgagagagtcccagccttcactgctttcttgggagcccctggttccctggccaggtactctcttgggccctgcccccattggaggccacaccagctggacaaaaggagaccaggaagaaccctcagaaaccacccagacctgccaggcatggtggctcatgcctgtaatcccagcactttgggaggccaaggcaagaggatggcttgagctcaggagtttgggaccagtctgggcaacatggtgaaacccatctctaccaaaaatacaaaaaaaattagccgggtttggtggtgcacacctgtagtcccagctactcaggaggctgaggcgggaggatcacttgagtctggagggcagaggttggcaccactgcactgcaaccttggtgacagagtgagatgccatctcaaaataaataaataaataaaaagacagaaaaaaagaaacgacccagactatcagccctcccagaggggcctgggatgggctcatcggccttcctcacacagaccctgcccgtccacccgacctggggaggggctcgccccacctgagatgtccatgaagtcatccaggcttggctgcagtggcgtcaggtccggctggatcatgtcagcattgccgacgtaggctggaggcagcagtggcgacatcagcagcagcaggcagggaggagcagggtccccacccccatccccagccatccctcccttggcctcctggaatctcacaggccttcacccctctcccctgccctttctcagaccctcaccatcctcaggcggcagctgcaggggcgaagggccggactgagtcatggtgaagagagtgtctgagatgtcggacaaaaagcaattgaggtccaggagctgccgcccacccggctcctcctctgggtcccccagcagcacggggaccacactggagaagagctgtttgcaccattgctccggcggcggccacctgccttccgcctagggagacagagccgtcagcagccgctagagagctcccactgccccgatcttccatatcacccctctccagggtcaagtggtcagcaggacagagggtctgtctgttcacacctctgtcacctttccctagtggacctagcttgctgcttgaaaggccaagatcactccattggcctctaagaacttcccccaggagatagaccaggatgcagatacaggggtccccttcctgctctttagattttttcctgtctgggaccccagttctttggtccctctggtttttttttttgtttgttttctttttctttttcttttttttttttttggagacggagtctcactctgttgcccaggctggagtgcagtggcgcaatctcagctcactgcaacctccacctcccaggttcaagcgattctcctgtctcagcctcctgagtagctgggattgcaggcatgcgccactatgcccggctaatttttgtatttttagtagagacggggtttcaccatgttggccaggctggtctcgaactcctgacctcagatgacccacccgcctcggcctcccaaagtgctgggatgacaggcgtgagccaccacgcccggcctggtccctctgttctcccatgcctcccaccacttgctcaatgacctggggtcttctcaccacctcaccctcaccccccaagaagagaagagctcaacaaatgaaccacaggatggcagtaacatcccacattccaccctcatgcccagccactgtcttgcccactgaggcggaaactgtcaactctgcctcccatctacttggggggcaaagggatgcccttgcctgctggacttacagagcacccacctgcttaggggccaggaggtcatcttccctgctgggcttacggagctgcagggacacacagagttggacaccggatcccttgccccatcctccatcactttccccccaaagtctcctctactcacaagcgatgagatcccccatttcccatcaggagctcacccgacccctaggtaaggaggccgctaggagacgctgtggccacacggtggcgctgtcggcccgggactgaatggagggcccgaggggcgcaagctcgggggtcaggatcccctttccagggatcttccgaggcgggcggtagccggcagccgcaggaggaaagctctggggcctccctggccctcccccactgacccgcttcttgtagtagatgcgccacttgtggtattcccgcatcaccacctcgatgcgccgcttccagtagttcccctccaggaccacggcctggggtaggggccgggggagggggatcagtagagaggggagcaccgcacacccatctcccacccttcaccccatccctgtctgctcagcgcaaggctacaggaggcaggggctggtcttggtgggtgggcaggtgggcaggtgggcaggcggtccagaacccagctacctccggcttccggtgcgcatcagcctcaggcccctgcaggggggtcacgaagccacacacggggctcttcctccgcttcacatctgagagaagggggccaggtcaggggcacccagcttcctcatcccccacctcaccccaggggactgggactcaagtgacaccctgcgaaatcctgcttggcctttgacgttcagattaagtgcccatgctgcctcctccaggaagtcttctcggatgatgctctagcctcctagatcttcctttttttttttttttttttggagatagggtttcactcttgttgcccaggctggagtgcaatggcgtgatcttggctcactgcaacctccacctcctgggttcaagcgattctcctgcctcagcctcctgagtagctgggattacaggcgcccacgaccaggcccagctaatttttgtgtttttagtagagacggggtttcaccatgttggccaggctggtctcgaactgctgacctcaggtgatccacctgcctcgggcttccaaagtgctgggattacaggcttgagccacctcacccagcctgatcttcctctacagggcactgtgaatccaacctcccacaccttctctgggttcctctggagccccataggtacacttgcaaagactgctgaatggattgtggggccataggccacagagagtgagctgcctccagaaagtcctggttagggctgggtgcggtggctcacacctgtaatcccagcactttgggaggcctaggtgggtgaataacgaggccaggagatcaagaccagcctgccaacatggtgaaaccccgtctccactaaaaatacaaaaattagccgagcatggcggcacatgcctatagtcccagctccttgggaggctgaggcaggagaatcgcttgaacctgggaggtggaggttgcagtgagatcacgccactgcattccagcctggtgacagagcaagaatccatctcaaagaaaaaaaaaaaagaaaaaaagaaagtcctggttagactggcaggccaggggcctagagccttgggtcctctgcctcagaaggctaggcactacccactttcattgcagagaaccacccttggttcacttctgaccaccaacatgtgtcctcttccaggcctccacctcccctcccagtctctaattctgacctctccccaggctcttgcccttggccccaacacacactccaggctcttttttgtttttgttgttgttttgaaacaggttcttgctctgttgcccaggccagagtgcagtggcgcaatcatagctcactgaagccttgacctcctgggctcaagcgatcctcccgcctcagcctctggtgtacgccaccatgtctggctaatttttaaattttttgtagagacagggtctccctgtgttgcccaggctggtctcgaactcctgaggtcaaggaatcctcttgtcttggcctcccaaggtgttgggattacaggcgtgagccactgtgcctggcctcttcctttttattactgttatttttaattttttggtagagacagggccccactatgttgctttgaggactggcctcaaattcctgggctcacgaggcttttctttatctcctagcttccctggccactttttttttttttttttttttttttgagatggcgtttcactcttgttgcccagcctagagtgcagtgccacgatcccagctcactgcaacctccacctcccgggttcaagcgattctcctgcctcagcctcccaagtagctggaattacaggcacgcgttaccacgcccagctaattttttgtattttcaatagagacgtggtttcaccatattggtcaggctggtctcaaactcctgacctcaaatgatcccccaactcaggctcccaaagcactgggattacaggtgtcagccacctcaccgggccctggccgctttgtgtgtgtgtgtgtgtgtgtgtgtgtgtgtgtatgcttgaaacaaggactgaatctgttgcccaggctggtgtgtgtgtgtttgagacaaggactcaatctgttgcccaggatggagtgtgtgtgtgtgtgtttgagacaaggtctcaatctgttgcccaggctggagtgcagtggcagggatcttgggtacttcgatctccgcctcctgggtgcaagtgatcctcctaccttagcctccagagtagctgggactacaggtgtataccactgcacccagctaatctgtgaatttttaaaaaaaattcaacatggtttcaccatgttgcccaggctgttgtcaaactcctgggctcaagcgatctgactgcctcagcctcccaaagtgctgggattgcaggcgtgagccaccgctcccagcccctgaccacttttcactgactcctttgcaatgcccaccctgcagcctctctcactctggccctttcctgctctagcctcatatccagctgcctggggaccctccctaggatgtcccaaaacttgccacaaaaaccccactgactcccagcattccaggtctgactgttatattccgggtctaattgagaaaaaaatctcaatctcataggatctgtgacatttctcccgctgtcccctcccctccatcctctctcactgtgtcaccccttggcctggtgtcatttctcacagggacctccctgactccagtgtcacactcggagctcatcttccagttgcagccaggacaattctttctaaagtgcagttcaggtctggaaccctccatggctccctactacctctgggacaaagtccacactccttggcttggcttccaaacccgtccccctcctccatgactgggccaccacttgcttctctcagcatctcatctcctttttttgagacagggtctcactcttgtcacccaagttggagagcagtggtacagtgctacggccttggctcactgcagcctgcacctcccaggctcaagcgatcctcccaccttagcctcccgagtagctgggactataggcatgtgctaccatgcccagctggttttttgtatttttggtagagacagggtttcgccatgttgcccaggctggtctcgaactcctgagctcaggcgatccacctccctcggcctcccaaaatgctggaattacaggcatgagtcactgtgcccggcctccctgtctcctttatacacctcaccttgaagccacacagcccaccttttcttttccttttttttttaagatgaagtctcactctgtcacccaggctggagtgcagtggcctgatcttggctcaccacaacctttgccttctgggttcgaacaattctcctgcctcagcctgcctagtagctgggattacaggtgagcgccaccacgccccactaatttttgtatttttagtagagacagggtttctccatgttggcaaggctggtctcgaactcctgacctcaagtgatctgctcgcctcggcctcctaaagtgctgggattacaggcgtgaaccaccacatccggcccttctggtcttattctaacagggaagcccctcttaccttccctcctctgcccacaattcaggatagcgcctcctccaggaagccttcctgcctgccaaagcccacagcgctgcccacctcccctccaccctggcctgtcaggtctttacatgctcgccttgctgcagggagtaaaagcagctcctgcctttggcacagagcttgacacacagctggtctacttagaggcaacctgagacttttcctggctgctctgacaaagagaacaactgctgacccttcctgccccagccaacttcctctgggacaaacgaggacacagaggaagggggaccactggaacatgaaatttactagggctttttagcatcatttacaaagttctgtcctaaagaacattctccaaaatctgctgggcacggtggctcacgcctgtaatctcagcactttgggaggctaaggccggcgtatcacttgaatctaggaattcaagaccagcatgggcaacatagtgagaccccatctctactaaaaatacagaaattagccaggcgtggtggcgcatgcctgtaatcccagctacttgggaggctgaggcatgagaattgcttgaacccgggaggcagaggttgcagtgagctgagattacaccactgcaccccagcctgggtgacagagtgagactgtctcaaaaaaaaaaaaataaaataaaataaagcattctccaaaatggacactgataggattgaaggaggggttttgtcctggtttctgagcccagattggacagaaaacaaagggctgggtccttgggtgcatagactcccagggggctagataaggaaggagggtctcaaagtgtgtctgcccctggctttccagatgaggaaatgaacaccagcaaagatgaagtttgtcctggtacggtgtggtggctcacgcctgtagccccaacattttgggaggctgaactgagaggattgcttgaggccaggagtttgagaccagcctgagcaacctagtgagaccctgcccctacaaaaaattaaaaataaaaaatagctgggtgtgggggcgcatgcctgtagtcccagctactagggaggccgaggtgggggaattgcttgagcccaggaattggaggccgcagtgagctatgttggctccactgcactccagcctgggtgatgaagtgagaccctgtctcaaaaaatagaataaaattaagtttgttaggccaggcgcggtggctcacgcctgtaatcccagcactttgggaggccgaggtgggcggatcacctgaggtcgggagttcgagaccagcctgaccaacatggagaaaccctgtctctaccgaaaatacaaaaaattagccgggcgtggtggtgcgcacctgtagtcccagctactcaggagggtgaggcaggagaatcgcttgaaccccggaggaggaggctgcagtgagtcgagagcacaccattgcactccagcctgagcaacagagtgagacccccatctcaaaaaaaaaaaaaaaaagtttgtccagggctctcagaaagtcagggccaagtgaagcccccctccccagcccagagaccccatcctctggactgtttctcatggaaaggctgtaaccatgtggcttcctgggggctggggcaggctttgtttaacactgataagttcttcccttcactcagccgcggaaccctttgcacctatgctgagacagatactgggacaggacacatggatgaatcaggcagggtgcccacagcttagcgggagagataaggaaagtaaacaaacaacccgagacaatgcaaagtggaaagtccttcttgccccaggagcggtgcaaagtgccagggagctcccaggacaccaagacgatttcagagtgtgggagtatgactgttggatcaggaaaggaagaatcttagaggataggagcctgcagggggtggcagagcccttcctgcttgagccctaaggcccgacattagtggcgtcaagccaagtaagcccttctcctccccactcccgtgaagcccaccttcaaacctttggcgtttagggaggaggaggggtcttgacatttgttgtatgtgtgtcacgtgctgctatgactatgacagtgagatacagatgatctcactgaaaactcagtgaacctcagaaataggacctattggccgggcgcggtggctcatgcctgtaatcccagcactttgggaggccgaggtgggcagatcacttgtggccaggagttcaagaccagcctgggcaacatggtgaaaccccgtctctactaaaaatacaaaaattagccaggcatggtggcatgcgcctgtagtcccagttacttgggaggctgaggcacaataattgcttgaactgggaggtgaaggttgcagtgagccgagatcgtgccattgcacttcagcatgggtgacagagcaagactgtttcaaaaaaaagaaaaccaagaaaaaacaaataggacctgtcattcccattttcacaaatagcaagcttcgactccgggaggctagagaatttcccaagcccacacagttaggacatgctagggctggactgaaacctcactctgtctgattccgaacctggggtccttccagcaacttgtgcaatagctggagatcagtgtgtctgggtgaggaccccaggtgacatcatgcctcagctgccatcagaaatttcttctgcaggctgggtgtggtggctcacgcctataaccccagctctttgggaggctgaggcgggcagatcatctgaggtcaggagttcgagaccagcctggacaacatggtgaaaccctgtctccactaaaaatacaaaatttggcgggtgcctgtaatcccagctacttggtgcccacagcttagtgggagagataagggaagtaaacaaacaacacgagacaatacaaagtggaaagttcttcttgccccaggagaggtgcaggaggctgaggcaggagaatctcttaaaccagggagacggaggttacagtgagccaagatcacgccactgcactccagcatgggcaacatgagcgaaacttcgtattaaaaaacaaaacaaaaccaaacaaaccccccccaccgccataatttggagttggggaactgtggacttccagccagccccagctctgcttcttttacgctctgtgaacctgaatatgtcacttgccttctgagcctcagttgctcatccataacatggcggtaataaaacctatctcccagggttgctaggaagccttaaataaggtgattcacgaaagtgcctggcatgtagataaatggaaaccagaaaacacaccctctccctgcttggatgaaatccagcggggcgaggacagagaatactgcgtgtggtctctcctgggctttgcattcccagctcagtgcagcctttgatcctgcagcagaacctgacctgaatgaggtcccaacacagggctggcggatccaagtcctctctgcctctgctgccctgccatggggagtggggtgttcccaaatgaatgagaatgtgacctccttaaggatacatcatgtattggataccaacttagtggcaacaccctggaatacctgttatctccacaccaaccatgaaagttaggactattggcctcgttttttgttttgccctttttttttttttttttttgagacggagtctcgccctgtcgcccaggctggagtgcagcggcgcgatctcagctcactgcaagctccgcctcccaggttcacgccattctcctgcctcagcctgccgagtagctgggactacaggcacccgccaccacgcccagctaattttttgtatttttagtagacaccgggtttcactgcgttaggcaggatggtctcgatctcctgaccttgtgatctgcccgccttggccttccaaagtgctgggattacaggtgtgagccaccgtggcctcgtttttatagataaggaaacaagttcagagaggctaggcaactagcctgaagtcacacagccagcaaggggcagagacggggtggaggaactagctctgggcaactctaagtccagagttccttccacgagatggcatggcctctctggatcccctctgcccaattggccatggtgggcacctactggatattcaggaaggacttcaatgaaaggctggtggagacccatgcgggatcctcagtttctccatttacaaagtgatgcagttggccccgctagtgtctaatggccctttttaccctcgcattcaaggcacccaactatgctaatgggatgcaaaatgggctttgaactgtacctcaaatctcagcctaccctagtgctactgaggggtgacctctgctgtgcccagcttcacagtggaaacaccctttgggacctattccccgagacccgctggaggtcaggagctattcaggagtcctggtgctgggggcctggtctccccctaaaaggctgtcagggtcaggcgtggtggctcacgcctgtaatcccagcactttgggaggccaaggtgggcagatcacttgaggtcaggagttcaagaccagcctggccaacatggtgaaaccgtctctactaaaaatacaaaaattagctgggagtggtggtgggtgcctgcagtcccagctacttgggaggctgaggcaggagaatggcttgaacctgggaggcggaagttgcagtgagccgagatggcaccactgcactccagcttgggcaacagagcaagactgtgtctcaaaaaaaaaaaaaaaaaaaaaaggttggcagaactctgctagtgctggccttgaggaccccggggattttcctgggcagccaccatgtagaaccctctggcaggagggttggagggggcagtccctcccggcttgggaggctggtggtagccactcacactggatataccaggccctccagatggcgttgttcaggcggatcttgtctctgcagagcagcttgaggcctttgaaattcttccacttgggagacaccagcttgccactgtcaaaggggagaggagtagggttagggagatgcagtgctgccacagaggctggtccccatattccccatgcactaggcatccatctatggttggcatttgaggggcccctccaaatctggccccccaacccaacctgcctgaaattcctatccagagagtcagaccttcaaaatccccttccagactcccaccagcggcccctgtgttccctggggagacctgtttgtcagtctactgcagaacaaaagccacgctgaaacctgtggatcagctcggccctggaagcaacaatgtccagtggcctcacaggtgtgtcttggaggctggctggggacagtgctcaggcccatttctcatttaagagaataagaaatgaccttcctgggctgggtgcagtagctcacgcctgtcatcccagaactttgcggggccaaggcgggtggatcgcctgaggtcaggagttcgagaccagcctagtccaacatactgaagccctgtctctactaaaaatacaaaattagctggctgtggtggcgcacacctgtaatcccagctactcaggaggctgaagcaggagaattgcttgagcctgggaggcggaggttgcagtgagctgagatcacaccgttgtactccagcctgggcaacaagagtgaaactccgtctcaaaaaaaaaaaaaaaaaaaaaagaccttcctgagagtcagggaggaaaggggcaggtccgaggtcactcaggcctccttaggcccaggagaggcaaaggggatggccatggtttgcctggtagagagggagcctctgtgttttgttttggtttggtttggttttttttggtttgcttttggttttgagacggagtctcagtctgtcatccaggctggagtgcagtggtgagatctcagctcaccacaacctccatctcttggattcaaacaattctcgtgcctcggcctcccgagtagctgggattacagttgtgcgccaccacgttcagctaatttttttggtatttttagtaaagacggggtttcaccatgttgcccaggctggtctcaaactcctgacctcaagtgatctgcccaccttggcctcccaaagtgctgggattacagatgtgagccaccatgcccagccgagggtgcctctttatagagagtggcagtcactgccttcatggtacagtccttttggtgtctgccatgcccagaatcccagggtggcaacctggactcagcgagaaggtgtgctcttctcagggctgcacagaagacaatgaaccaacagatcccaaaggaaggccgctaggatgagcaaatggtattcatggagacagagcaccctcactctaaccctagctgtccatcaaatccacaggatgggctgggcgcggtagctcacggttgtaatcccaacactttgggaggccaaggcgggaggatcgcttgagccaaggagtttgagaccagcctgggcaacatagcaagaccctgtctctacaaaataattttaaaattagccgggtgtggtggcatgcacctatagtcctagctactagggaggcgaggtcagaggatttcttcagcccgggagtttgaggctacagtgagctatgatcacgccactgcactccagcctgggcaacagagcaagatcctgtcttgaaggaaaaaaaaatccactggatggaagagcttacactggtgagggtcctgctaggcacaggccaagtcttctgcctccaggaagctgagccaggaggccaagacattcagggtcttagaccccctgctagtctctccctccctctctcgtctccatccacaagccagggttgtgtaccagtcccctctagcccgccttttgcatcccttactcagatctcagatgggaaggctgaggccccaagtcttagccattttttcatttttttgagatggagcctcattctgccacccaggttggagtgcagtggcatgatcttggctcactgcaacttccgtctcccaggttcaaatgattctcgtgcctcagccccctgagtagctgggattacaggcatatgccatgacacccagctcacttttgtatttttagtagagacggggcttcatcatgttggccaggctggtctcgaactcctgacctcaagtgatccacccaccttggcctcccaaagtgctgggatgacaggcgtgagccaccgcacctggcccccaaggcttagtctttcagaaaaccatacctgcttcctccaggggtctttcctacattctgggggtgaaatgtgggtgggtgccagtctgactccgcagcctctccctacttgagtgcattggtcattgggccctctctcctccctggtctccaagttcctgtgtttgctttggggtgggggtgggggactgccccctccccaccagggacaacaggcctcattacccaaataagatacacagcccagctctctgggccactggctgggcccctccctctgagaattagataaacaccatctgtttggtagggagacatggaggtgggggtggggggagactctgctacctcctgggccagcttcttctgtggcacctggtgggggactcctgagtctgttgtccctgtctgtatcccagcaacctcccagcccattctgatcaccccgtgtcgcacccttgacctgcctgccttctctcccgcttccatgctaaggttatgacgttcatggcccaggcagggttagagcagatgtgacagtgacaatatccaagcccaggaggaagaaaaggatttggggctgtgagagaagagactcagcctggaggaagagcgtaacgctagggttcaagaactttttatgactggctggggatggctcacacctgtaatcccagcactttggaaggccgaggcaggaggactgtaggaggccaggagtttgagatcagcatgggcaacatagtgcaaccctgtttctacagttaaaaagttagctggggccaggcacagtggctcatgcctgtaatcccagcactttgggaggccgaggtgggtggatcacctgaggtcaggagttcgagatcagcctggctaacaacgtgaaaccccgtctctactaaaaatacaaaaattagccggacgtggtggcaggcgtctgtagtcccagctacttgggaggctaagccaggagaatggcgttaacccgggaggcggagtttgcagtgagccgagattgtgccactgcactccagcctgggcgacagagagcgactccatctcaaaaaaaaaaaaaaaaaagttagctgggcatggtggtgcaaacctctagtctcagctactcaggaggctgcagtgggaagatcgcttgagcccaggagttcaaggctgaagtgagctgtgatcacaccactgcactccagcctgggcaacagagtgggaacccgactcataaaaaacaagtaaattctggttgggcgcagtggctcaagcctgtaatcccagcactttgggaggccgagatgggtggatcacaaggtcaggagatcgagaccatcctggctaacgcagtgaaacccggtctctactaaaaatacaaaaaattagctgggcgtggtggcaggtgcctgtggtcccagctactcgggaggctgaggcaggagaatggtgtgaacccgggaggcagagcttgcagtgagccaagatcgcgccactgcactccagcctgggcgacagagcaagactccgtctcaaaaaacaaacaaacaaaacaaaacaaaacaaaaacttgttatgaccaatagaaaagtctgatgaggagcagtggtgggcctgtaacctaagcactttgggaggctgaggggagaggatcgcttgaacccaggagttcaagaccagctgggcaatacagtgagaccttatctctatttaaaactattaatagggccaggcgcggtggctcacgtctataatcccagcactttgggaggccaaggcaggcgaatcacctgaggtcaggagttcaagaccagcctggctaacatggagaaaccccgtctctactaaaaatacaaaaattagccgggcatggtggtgcgtgcctgtaatcccaactactcgggaggctgaggcaggagaatcgcttgaacccaggaggcggatgttgcagtgagccgagatcatgccattgtactccagcttgagtgtcacagcgagactctgtctcaacaacaaacaaaaaacaacaacaacaacaacaaaaactattaaaagaagaaaagagctgggcccagtagctcacacctgtaatcccagcactttgggaggccgagacgggtggatcacaaggtcaggagttcaagaccagcctggccaacatggtgaaactccacctgtactgaaaaaaaaaaaaaaaaaaagccggatgtggtggcaggcgcctgtaatcccagctactcaggaggctgaggcagagaattgcttgaacccgttgggtggaggttgcagtgagctgagattgcgccactgcactccagcctgggcgacagagtgagactccgtctcagaaaaaaaaaagaaaagaaagaaaaaggcaggacacgatggctcatacctgtaatcccagcactttgggaggctgaggtgggcagatcacttgaggtcaggggttcgagaccagcctggccaacatggtgaaacctcgtctctactgaaaattaaaaattagctggggatggtggcacatgcctgttacctcagctactctggaggctgagacatgagaatcgcttgaactcaggagacggagattacagtgagctgagatcatgccagcgcactccagcctgggcaacagagtgagactctgtctccaaaaataaataaataaataaataaataaataaataataagaaggagaagaaaactctgagacttagagagggggttgagaaaaccccaagttcagctgcccacctcccacctttcaggaattccttttagattgccccctaaccaggtcctgtttgctcccctgcaccctcaaggccactcttcctaaagctagccagctctgaccatgaacaagtgcttccttgaagcttccagaaactacctccctggggcttccacccacggagccatggaagacggcctcctcgatcctccctctgcccacgctaacctgcagagggtgaaaccttgccaggcctctgcaggctggtctctgggtcaggctggtccctgattcaggtgggtccctggtcaagctcgctgttcttcccaccaccttctgaactctctgccttactgtctcttcccatatagtcactcccctgggacactcagctcctgtaatctgctcccctccaggggacccctggaactgggggtctttgaggatgaaaacactgtcccagttcaagcctcagggcttttccactaccaaatggggaaatctagaagctctcctggtaccgagccaaccctccatctccctccatctccctccctccctccatctccctccctccctccatctctctccagctccctccctccctccatctccctccctccctcccttcctccctctctcccttcctccctccctccatctccttccctctccctccctccatctccctccgtctccctccctccatctccctccctccctccttctccctccctcctccatctccctccctccatttccctctatctccctccctccctccatctccctctctccatctccctctctccatctccctccctcctttatctccctccctccttccatctccctccctcccttccttccttcctccccccatctccctccctccctccctcccttccttccaacaaggtctcactctatcacccagggtggagtgcagtggcaccatcatgtcttactggagcctcaacctcctgggctgaagtgatcctcccacctcagactccccagtagctggtactaggaatgtgccatcacacctggctgattaaagaaaattttttttggccaggcatgttggctcatgcctgtaatcccagcacttggggaggccaaggcaggtggatcacctgaggtcaggagtttgagaccagcctggccaacatggtgaaatctcgtctctactaaaaatacaaaaaattagctggaggtggtgggcgcctgtaatcccagctactcaggaggctgaggcaggagattctcttgaacccggaaggcagaggttgcagtgagctgagatggcaccactgcactccagcctgggcaacaagagcaaaactctgtctcaaaaaaaaaaaaaaatttttttttttttggtagagacaggttctcagtatgttgcccaggctggtctccaactcctgggctcaagcaatccttggatgagaaccttggcctcctaaagtgctgggcttacaggcaggagccactgtgcccagccagagatttactattaatatttgggtatttgggaagaaaacacagtcctctctaccccagctatctctgactggggttacatcagccttgagtcagcctctgggtgggggggcaattttgggggtgcgctctgtcccttaccttgccagctccccagaacctctcctctttggtcacccatcgtcagggttggaagtgaggccccctcccaaatagagtgatgtgtagtatataatgagcagccaaagttggggttgggtgggaaatgggagacccttaggaggaggagtgccggcatccggtgtaccaggaccttagatgccctgtcccaggcagtcgcgtgacatttggggagggagggagaagggacgggaatttgaactttccacacgggtccgacgccctggccgatcgggttgcaacatgacctgggccaggggccagagcttgtgggccaaggttactccgcctccagccaatggggtcgcagctgggcggctgcggttgggggcaggcaacactcccctcacagtccccaccccagctcctgctcccccgcagggcggcaggtgccgatctgtagccagcggttctcagaaggggaggaggcgccgcggaggaagaggaatatttgcacagagaaaagatcaaggccggccgatccccctttctcccctacgggttttcggttgataatttatactggcccctcaactccggggaactttgctccagggcactgggccaggcctcgggttcgcgccctcctctgggacgcggggcgtggagcggcagcggggcgcggcctgtgcgctctcggtggcactaagcgggggtcccaggcagcgacgggcgctcagcctagtgtggcgacgtgggtaggcgaacccaggcctcccgggcaccggcgtaacctctgcgagctgcgcctcttggacatttctgggacatcctcctcccgccacccttaatgtagcagatcaagaagaggtgtctcagcaattgcggggaggtggacgtgagagtgggccagttccagtccactttggttatgaactgggacaatcaggggcgctgggagtatctcagggtccaggaatagggcgggcttgggccggggctgctggggagaaggccgaggcctgcagggggtcgggtggagtggctccagagtggagagtggggatgggcgcgggtggcctagggaccaggggcgcctggcatttttgtagggacggaggggctgggaccagagagaggggaccagaggtccaggtagaggtggggcgcaggcggtctgcgcttcggggaagagggaatgggggaggaatgggaatcagaaatgcgtgggtccgtcaggggccagcgggctgggccgctgtaggaggacctcggggctgggagaaagggggtgtccagggcgtgatcggagcctccgggagccgcaggaccgggctcgggtggggtgttgagggccccagcgcgcagtcctgccccggaccccccccccatccccacctggaagccaaggccgtcagggcccggaaccgccctcacctgtaggccaggctcaagcactcgaagaggcgtgtgagtgtggggtcgatactgcgcggcccgaagtcggagggccccacggacccctcctggtcgcgccgccggggcagcgagtcgctgtgcggcgacgacaccatgaagtgaccgctgtggatgacctgcgagcggagcaagccgcccgcgctgcgccggagactcgggtcctccgagtctgtgtccgagtccgagtctgggctgggcgcgacccgcgggacctgcaagcccgcggccagacctgccagcgcgccggccatggctgtcgccgccgcaaccgcctggtccctgctccgcgcagcgcggggaacagctcttggccagccgggcctcattaacatagccccgcccccacaccataggccgatcgggtgggcggggcctgggacggggcggggcttgtattagcataatccttacgccaggtgagaacccggtgctctggagctctggcgggttggccccatctcccttcccgtctttccttggagtcctgatagagccgcccctactttgctccaaagggatattaagaaaggtcaggccggacgccaggggctcttgcctgtaatcctagcactttaggaggccaaggcgggaggatggcttgaggtcaggagttcgagaccagcctgagcaatatggcaagacccccatctctaccaaaaaaatgcaaaaattagccggacatagtggagaaagcctgtaataccagctactggggaggctgaggtgggaggattccttgagcccaggagttcgacaatatggcaaaaccctgtctctaccaaacatacaaaaattatccaggcatggtggcgtgtgcatgtagtcctagctactccgaaggctgaagtgggagaatcgcttgagaccaagaggttgaggctgcagtgagcggagatcgcgccactgcactccagcctggatgacagagtgagaccctgtctccacaacaaaagggtcccctatcacacctgagcctgaaagcgcctcaggacctggggtttgttctttcaggggcaccctcctgtgaggccagagatcaccatctcccctcacctaactcctgcccttcacctccaacccccgccccccatattagctcttctgggtcctccacataggtagaagcccccaactctcaggggcctgatgtggtaagcccaaggtaatgcccctgaagggcctggcccacaggaggttgctaacacctctagttaacatggtggccaacacggtggccgggcgcggtggctctcgccttcaatcctagcactttgggaggccatggtgggtgggtcacttgaggccaggagttcgaaaccagcctggctaacatggagaaaccccttctctactaaaaatacaaaaattaccggatgtgacgatgcgtgcttggcttataatcccagctactcgggaggctgaggtggaagaatcacatgagcccaagaggtggaggttgcagtgagccgagatcgcgccctactgcactccaccctgggcaacagtgaaatcctgtttcaaaaacaaaataaaatacttaagaaaaaatatatattaaaaaaattgtgatcattacttcacctgcacagagaggcccaaggggagcctcgagggactgttactggtagggatgggtggctcactggaaggtggacatcccctaggcaggcatctacccaggagctctgagccccttctctcactgacactgaggtccagcttttgttcctgcttctttgtatttttatttatctatatacttctatttatttattgttttgagacggaggctcactctgtcacccaggctggagtgcaatggcacgatctcggctcactgcaacctctgcctccctggttcaagcgattctcctgccttagcctcctgagtagccgggattacaagtgcccgccaccatgcccagctaatttttgtatttttagtagagacgaggtttctccatgctggccaggctggtctcaaactcctgaccttaaagcgatttgcccacctcagcctctcaaagtgctgggattccaggcatgcgccaccgtgcccagcctatttatatatttttagagacagggtctcgctctgtcacccaggctggagtgcagaggcacggtcatagctcactgcagcctcaaactcctgggccaaagcgatcctcccacctcagcctccctagtagctgggactacaggctcatgccaccaaacctggctaatttttttttttttgtagagatgaaatctgcttcagcctcccaaagttttgggattacaagtgtgagccactgtacatggcctttctgcttctgaagcctcttttctcaccttgaggacagaaaccagactgaggcattcacacctgacacctcactggagcgtttaactaacagcctcaaagatgggttcagaggcacaggagagcaaaaacacacccaagcatctctgaggggcagcagcaaagcctggtctagtagatttccagatttcccccaaggatgtccctagtgggtggggacaggaaagagttgtaggcacatgctaagctctgctggctttctgacaggtatcctgtgtgtggtcatgttagggaaagcggaggaggtggtttcccatgtgtggcagccttggaaaaggttgacatgcagcactttcttccagcccacaggaggatcacacagcacctaggatcacaatggcagtgccctgagggccccagccactggctgtgggaggaaagtgattatccaaggctgctcacaggccagcccttccacccacctcccttggccgggtatcttctgtctctgccaaatgttcgcatcacattcccaggagccccagctgttctgctccatcctccctgctgccctctgtaggatgtgcattctctctgcccatccctgccaggttaggaaagggggttctgatgctcaccccactctccctcctttggaggggctctgccctgcttcagagagccatccccaagtggccctcttttttttttttttttttgagccagtctcagtctgtcacccagactggagtgcagtggcatgatctcagctcactgcaacctccgcctcccgggctcaagcgattctcctgcctcagcctcccaagtagccgggattacaggcgtgtaacaccatgcccgactaatttttgtatttttagtagagatggggtttcaccatgttggccaggctggtcttgaactcctgaccacaagtgatccacctgcctcagcctcccaaagtgctggtattacaggcgtgagccaccgtggccagctctcaggtggcagttaaccgtcttttgaggcccttggtacagaggctgacaggatcattacttacccctatatgcctgtctggcttctccccctattcctccgtaggccattgaggcaagactgtgtcctagcatctctgaacccccacactgggtacctggagacttgggggatgcttgaagaaaggggcatgagactaagaggagcgggtggggtgctgtggaggaggttggataggaagtgtcagctccgccctcgcctctggcttgggacctcctggctccggggaccctggctcaggtgaagaccggaattgatccttgctctgctgctaattccatgagtaacactggggagatctctgtctctctgtcttactggcgatctgtctcactacctgtaaaattgagggccaaactcagtgctttctttctttcttcttctttttgctgttgtaaagatgaggtctcactatattccccaggctggtctcgagcacctgggctcaagcgacccttccaccacggcctcccaaagtgctgagactacgggcatgagccactgtgcctggcctgaattcagtgatttgttggggatccaggaatcttggctccaagtctctgctggccgtgtctccagatcaccccaccgtgctctccccatgctctgaaaacatcagagttgtctcctgcggtttcagggactttcctctgagctggatctgagcgggtgggaagattatgagtgaattctctccttcacccaacatccctccttccccagccatgaattgcccctcaacaggcatctgcatctcatttctgccctcctccagggcttaataacacctctagaagcctaaccgctgaaaagacaaaccctgactgcacaatgcaaaacatccaaacactagagtgtccaataaatgcaaggacgtccacagattctgatttctcctgtgtttagagacagggtctcgctgtgtcacccagcctggagtgcagtggcacaatcatagctcactgcagcctcaaactcctgggccaaagtgatcctcccacttcagcctcccaaagtgttgggattagaagtgtgagccacttgtaatgggaccacaggcgccgcaccccctgttcagggcaccattgcccagataatagcacagccatgtacatgtaagctggctcacgctcttgctgcttctctagcctctgttactatagccagcagtttacagcctctgtacaaacaagtcttgttcatggtccatggagatgcaagacaagatcctaactgtggtgtgaatacctggctgtccccagccatcccacctgatgtcacatcctctctgccttccagtcttggtcctcagggctcttcacccagcctgcccttccttgttgggaaagcccacctgtccttgaagtcccacctatgacatcttccccaagttctccaggttatttctgagttcccaccacccttgttcttttcttttctttttttttttttgagaccaagtcttgctctgtcgcccaggctggagtgcagtggcgtgatctcagctcactgcaacctccacctcccggattcaagcgattctcctgcctcagcctcctgaggagctgggattacaagggtgcaccaccacgcctggctaatttttgtatttttgtagagacggggtttcaccatgttggtcaggttaatcttgaactcctaacctcgtgatccaccctcttcagcctcccaaagtcctggaattacaggagtgaggcaccgtgcctggccgcaccacccttgttctaatataagtctaatttcattcagctttgcattcacagtgatgacgcacgtgcttttcctccccactagatggcaaattccttgagagcaagaatcactgctgggcgtggtggctcatgccagtaatcccagcactttgagaggccaaggggaggattgcttgagcccaggggttcgagacaagcctggacagcatagcaagactctgtctctacaaaaaattaaaaaattagctatttgtggtcttgtagttccagctacttgggaggctgaggtgagaggatcgcttgagctcaggagttggaggctgcagtgagctataaacatgccactgtactccagcctgggtgacagagtgagaacctgtctcttaaaaactaaaaggcacgttcataaattattccatttactagtgagcctgtcaactgtgtgtatatgtgggtgtgttagaattttcattgccattttacagatggggagactgagactctgagaggtgaaatgatctggcggattgtggtgagaattagctatataaagctaacctttatggagcacttaccacctagcaggtccgcaggatcttcacaacagccccttggcttgtcttttttattatttttatttatttatttatttatttatttatttatttatttatgagacggagtcttgcactgtttcccaggcaggagtgcagtggcacgatctcagctcactgcaaattccgcctcttgggttcacgccattctcctgcctcagcctcccaagtagctgggactacaggcgcccgccaccactcccggctaattttttgtacttttagtacaggcggggtttcactgtgttagccaggaaggtctcgatctcttgacctcgttatctgcccgcctcggcctcccaaagtgctgggattacaggccagcttgtctttttttttttttttttttttgagatggagtctcactcactctgtcacccaggccagaatgcagtggcatgatcttgggtcattgcaagctctgcttcctgggctcaagtgatcctcccacctaaacctcccgagtagttgggactacaggcgtgtgccactatgcccacctaatttttgtattttttgtagagatgggattttgccatgttggccaggctggtcttgaactcctgagctcaagcaatcctcctgccttggtctcccaaagtgctgggattacaggcgtgtgccactgtgcccggcctaccctttgattttcaacacattttgcagataagaaaacaacctttgctgaaggtcacatgataagaagagaactgggattcaaacgcagacaattgaatgccagcctgttccacaagtacctatgttctcaaactcaaagggctggccattgtgcaggaggatgtggtacgagcagacactcatctactgctcctgccagtggaggcaaaatcactttggaaaggtatttggcagcatctactagcattgagcatctcccaccttagttagaacccagcagtgtgcacacatgtgcaccaaaacacaagactattcgtggcagcactgatcttactagcccaacactggagatgccccggatgcctatcaacaggtgaatggataaatacattgcagaacagtcacactagggaatactttttttttttttttgagacggagtcttgctctgtcacccaggctggagtgcagtggcatgatctcagctcactgcaagctccatctcctgggttcatgccattctcctgactcagcctcccgagtagctaggactacaggtgcccgccaccacgcccagctaattttttttgtatttttagtagagactgggtttcactgtgttagccaggatggtcttgatctcctgaccttgtgatctgcctgcctcggctcggcctcccaaagtgctgggattacaggtgtgagccaccgcacccggcccacactagggaatattaatgcagcaatgagaatgaacactctacagctaagtgcagccctatgggtgaatctcactgattatgtattaaacaaaagaagcctgacacggaagtgtatatgttgtaagatttcattcatataaagctccaaaataggctcatctatggtgttaggagtcagggttgcatttagcctcagggtgactagaagggctcaagaagagagctatgaaggatgttgctacttttttttttttttttttttttttttttaggtagagatggggtctgctatgctgcctaggctggtgtcaaactcccaacctcaagtgatcctcccacctcagccactcaaagtactgggattacaggcacgagtcactgtgcctggtcaaattttcttcctttccttccttcttcctttccttcctctctccccttctccctctctccctctctccctctctctctcttctcccctcccctccactcccttctcctctcttctctccagtcttgtcttgtcttttttcttttctttccttttcccttcccttccctgccctcccctccactcccctctcctgtcttttcttttctttcccctccctcccctcccctcctcttcttttctcttttcttttcttttcttttttcttttctcctctcctctccttttcttttcttttctttccagacagggtatccctcagtcacctaggttgctggagtgcagtgatagaatcatggcttactctagcctcaaattcctgggctcaagccatcctcctgcctcagcctcctaagtagctgggaccaccacactcagctaattttttaaatttttttattatttatttattttttttgtagaggtggagtctcattatgctgtccaagctggtcttgaactcctgggctcaagtgatcctcctgcctcagtttcccaaagcactgagattataggcatgagccactgtgcctggccacattttgtttccttatctggattctggttatatggggatgttctctgtgaaaattcatggagttagatacttatgacatgtgcaccatttacatgtatgttagacttagtggttttatttgaaaacgaaaccgactttgcacccatatacatatatgaaatcagccattctacatcctgattcgcccttacaaggtagtgtgagaggtgttccatgggttatttccctcggccacaaccatcttcactgatgtcctagtgcagatccagggcccagccctgttcccctcctcacctaccctgtgttcctgtgtgtgcctcagtgtgacagtctggggcttgtcacagactgtcttcctgtgggaaggaagacaaggggcttgtcacagactgtcttcctgtgggaaggaaagtcttcctttccctttcattccttccttctttccttccttccttccttccttccttccttccttccttccttccttccttccttccgacggagtcttgctctgttgcccaggctggagtgcagtggcgcgatctcagctcactgcaacctccgcctcctagcttcaagcgattctcctgcctcagccttgtgagtagctgggattacaggtgcccaccaccacgtgtggctaattttttgtatttttagtagagatggggtttccctatgttagccaggctgttcttgaactgctgacctcaggtgatctgcctgcttcggcctcccaaagcgccgggactataggagtgagccaccccaccctaccttttttttttttttatttgagatggagtcttgctctgttgcccaggctggagtgcagtggctcgatctcggctcactgcaagcttcacctcccaggttcatgccattcttctgcctcagcctcccgagtagctgggactacagtcacccgccaccacgcccggctaattttttttctatttttagtagagacggggtttcaccgtgttaaccaggatggtctcaatctcctgaccttgtgatccacctgcctcggcctcccaaagtgtttttttttttttttaagatgaagtctcactctgtcacccaggctggggtacagtggccagatcacatctcactgcagccttgacctccttgggctcaagcagtcctcccgccatggtgtgtgccaacgtgcctggctaatttttgaatttttttgtggagacagggtttcgtcatgttgcccaggctggttttgacctgggctccagccatcctcttgccttgacctcgcgaagtactgggattacaggtgggagccaccatgccaggctaatttttattttttttgtagagacaggatcttgctatattgcctaaactggttccgaactcctgggctccagcaatcctcctgcctcagcctcccaaagttgctgggattccaggcgtgagccatggtgtctggctgatagtctggagtttgatggtgccctaaacagcctgagcacctcaaagtgagaaacatgcctctgcctcttttcactgacccctcagctcctctcaccagcttacatactcaggaagccactactgtggctaggggtagattggcatctaggtgcggggacgagggagatgatgtatcaggcctacggaaggacttggcaaagttagcttggcaagattaacttggcagttagcttctcacaaagctcactgagtgagaagaggatggagaagcggacaagagtgagagagaggagtctcgaactgtgtctttaactggcggcaagttgggaagtcacttcccctgtctggatctcagtttctgtatctgtaaaatgggtgaacaaaccatgaacgaaaattggataaatatgactatatcgaagtgaagaagttggaccagacttgttttcatatcagaagtaccccaattgttctaccaaaaattacgagtttgccaggagcagtggctcacacctgtaatccaaaacactttgagaggctgaggtgggaggattgcttgaggccaggagttcaagaccagcctgggcgacggagtgagatctcatctcaaaaataaataaataattatttactttaaaaggaaaatttttttgagacagagtcttactctgttgctcaggctggagtgcagtggctcgatcttggctcactgcaactgccaccttccaggttcaagcaattctcctgtctcagactcccaagtagctgggactacaggtgtgc

SEQ ID NO: 1144 - DNA, 24345 bp, Homo sapiens
gatgtcctaccctccgatctgggaggtgaagggcgggacttccagcgcgctggtgctgcggtgggaggtgcacgcgcttgggctttaagcggctgggtcgggcccacgtggacccggcggcaagcaccacctctgggcaccgtgagcgcggcggcacgcctgccggcctgtcttcagaaagggtcacccccttatgtcgggggtggcctggcctgagccgctgcctgcatggggcaaatgcctcagttttatagaaactcctcctttgggtattttttgggagctggtgggagttggatctgggacagcagattgatggcatcatgcaggccactcctgacagagcccggctgtcaggatttctgagtgcttcggtcgggcaggggacaaaacttatgctttaaaccaacagatccagagacaatggccccgatgggatggagcccgaaggcgtcatcgaggtgagactggagaaatggaattctgtcctcccccattacaactttcagccgtatagagttagagtggcctcttgattgatttcccagatcatctagaagcagctggtttccctaaagggaggagggttgtaagctctgaggcttttgttagtaggcaccagattctgtttgctcggagactacagctcagctccaccttttccatgactcaagctttaatttctttgcatcccctagagtaactggaatgagattgttgacagctttgatgacatgaacctctcggagtcccttctccgtggcatctacgcgtatggttttgagaagccctctgccatccagcagcgagccattctaccttgtatcaagggtgagacctctcagtcccagaagacattgtggactgtccctgacctgggtagagtggcatctggttggtgatgcccatctcatatcagccagggacaaagcaactccttgttcatcccagcttggcttttgatccgtgcccatgcctggttcatgccttggacacataggtttcctttaaagaggtggtattgtagccagcttatatttgcatctacagccatgtttctagtccagcttggtgtgcaatactagatgagttaataactggtccttgtttctgatctggttcccattgtgtaactgtgttgattgggaaggtagtttgtgagccatgaaatgcttggttcattggttgcttattgacctcattaacctaggacttgaatatcccaaagggtatgctctttaccacattcaactcctaatttatttgtttaggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactctcgagacctgctgggttaattaaaagctatttcttacccaaacgtaaccattgcttcctccacccatttcctgagtcaaatgggaaagctgttgggtgaagcctggctggctgggcaagtttgactgtgttctgaataagcaccttcactatgggctaagagatcccttggtgtgggggtgatcttacagtagtcagagcagatggacagtccttttcacccttgcttaatagccagagctgtttcatgcctggggcacacacaattctaatgctggactttttcctgggtcatgctgcaacactgatgtcagagcatgtttttaaatgttctgtggcaggggcagtgattattctgggtgtggataatgtaagaagttacagcagagctccattctaaggcacttggctctcagttttctcagagtgaacatgcctcgtagcttgggtcctatggcaggagtgcaataggacatggatatgcatcacctgttctataaaactggttgctggctgggtgtggtggctcaactcgtataatcccaacactttgggaggccaaggcaggcagatctcttgagatcaggagttggagaccagcctggccaacatagtgaaaccccgcttctactaaaaatacaaaaattagccaggcatggtggcgtgtgccttttatcccagctactcgggaagctcaggcaggagaatttaacccaggaggtggaggttgcagtgagctgagattgtgccattgcactccagcctgggcaacgagcaaagctctgtctcaaaaaaagaaaaaaaaaatggttgctgcgtgatgaggcagttggtcaaattagttttcagaaggttaagggttctaaatatctagagtaaagaaactgaattaattatctgagcggcctcattgtgaatcactgtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaactgacatatgagcacctgcctctctctgctcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtctttgtactctgagagcagactacttggctcctctctgttttttatcagcgaagttggatatatctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccatatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgatgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggtaaagctaaaactgggggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgacctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcacgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctacaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattccagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtctcgggctccttagagggaggacaccatattagtgccagtggggaagtcaccgggtggaattacttctttgtggagtttgtgctgtagcgacaatgaaaaacgaagagtcaacttttataaaacaaaataaaaattaagtcaaatcatgccaacctttattagatcgctagcagggttaaacttaattcaaagcccctgatgaatcgggccttcattgcacccccaaaggctccgccaccctgattgctttctttccagcctccaggtttgctcatagtctgatttcggaataatttgcctcccttcctttttctgattgcgagacagctccacaagggtcaccgtcagaccgtttggggagcgtcagtctgcccctgtcagttcatggtacctctcttgagctcgtggggcactttgttttagccgcattcatgacccgtgagagtcagactcccactagaccaagttccttgaggggaaggcttcaaggctagagaagttgtggatggccagggcataaaagcaagccttgaaagggtaaggtttagtccctgagtaggggccagggacagtcagagtgttcaagaaagagtggtatggggcgggcacggtggctcacgcctgtaatcccagcactttgggaggccgaagcgggtggatcacctgaggtcaggcgttcgagaccagcctggccaatagggcgaaaccccgcctctactaaaaatacaaaaaattagccgggcgttgtggcaggcgcctgtaatcccagctactcgggaggctgaggcaggagaatcgcttaaacccgggagacagaggttacagtgagccaagatcgtgccattgcactccagcctgggcaacaagagtgaaactccgtctcaaaattaaaataagaaaaaaaaaatggtatgaagacttgtctttggagagagaagacatgtgaaatggggcacccattggcccagagaagggaaataaaggatcagagagctcttgggcatttctcagctttatatggggaagcaatggagagccgtggaggtcaagccaagtttgggtgttaatttatagggaatggaagattggatgtggggggtggtaggcatcggagaaaagctgttttggaaagtaacagtctggggcccggtgcggtagctcgagcttataatcccagcactttaaggaggctgaggcaggtggatcatctgaggtcaggagttcgagaccagcctggccaacatggtgaaaccctgtctctactaaaaacacaaaaattaaccgggcatggtggtgtgtgcctgtaattctagctacttgggaggctgagacaagagaattgcttgaacccaagaggcagaggctgcagtgggctgagattgggccactgcactccagcctgggtgacagagcaagactctgtctccaaaaaaaaaaaaaagtgtggtggtttggagcaggaaggaccaggactttctcactgccctccgcctctcctccccccaagacaatgcaagaccctggtgtgggtaagggggctcggggagagcccacaggagcttcaagccctggcctgggtttcagacatctcctgtctgcttacccttttttctctcctcagtcccctgcctcaagattctcctcagcaaaggcctggggctgggcattgtggctggctcacttctaggtatgtctcttatctttctttccagctgttgggttggggtggaggtgctgagaggccatcaactgtgtgggtgttcgttctatagctgttgtgttgcatcccaaagaatggagagtcctcagtcctacttttctcatctttcccctagtaaagctgccccaggtgtttaaaatcctgggagccaagagtgctgaagggttgagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggcgggtggatcacctgaggtcaggagttcgaactggccaacatggtgaaaccccgtctctactaaaaatacaaaattagctgggtgtggtgatgggcacctgtaatcccagctacttgggaggctgaggcaggagaatcacttgaacctgggaggcagaggttgcagtgagccaagattgcgccactgcactccagcctgggcaacaagagcgaaactcagtcttaaaaaaaaaaaaaagggacaaggggctaggaaagttttaagcccttttagaaacctaatcatcaccagtggaggtgatcttgagaaggggtgagcatcccgagaatggccacgattcagaatgagccagtcccgtgtgggggctgtagagaagcgtgatcagagcatagtgtccctggatggatgggctatggaggctttccctgcctctttctaggcccgcctttcttcctcccaactcttgactctgcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgttgtgggggcagggtgggggggaagagtagaagatcaaagtgtgggggtgttgtacttgggggagcatgggaagagctcaggtgacagagccaaaggtctcaactcctcccctagcttctccaggcagccaccaactaccacaacgggcacacaggccagctctcagccatcacagtcttcctgctgtttgggggctccctggcccgaatcttcacttccattcaggtgagtgcaacatcttccttctagaaggcactaaaacctcgtcttacttctcccagctaagggccaaagctgccccgtgaggaacctttgtccataagggaacctttcttgagctatgctgaagggtaaccctggctctgtctcttgcaaccaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtgtaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaatataattgtatgttgtgcggctctccctggctatcatgggaggactgcaggctgcctctgaactgtagtccaacaggagaaagggttgacagcctggggtaggggatgctgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgccacccacccagccctggctacccagcccgctgggcgcagcaggcatggaagccgaccccgggatggagagcccgcggccctgttggggcacgctcgggagcgggcttgcgtgctgcacggctgttttcctcttggggagtcaggccaggaaagggcagaatgagctcggcctctccttgccctgggggctgggagaggaagctgggtcacacacaggccagaagcaggggggaaacggggcatctaactaggacacagtcgcatccaggggtcagtcacctgaccctacagggcccaccaccttcagactgagatggaaacgccctctgggagaaccctgatccgccccaccctacacaggccccggaggtactgggcctgcgcccgccacaccttggccgcgagtggcctctgcttgggtgggctcccgtcctccggcatccgcccccaccaaggctccagaagaggggcgcatgggcctccgtcttcggcccgcttcccaggcactcacccatagctgccaggcaggtaggctgtcgagtagctggggggtctgtacccaaagcctctgctcggttgggtggtcgcgtaccccggcccccagagcgggccgccgctggccaggttgcctcttccctgtccgcagcgggaaggtccggcgcccgagctcttggccttgcgccgaggccggtacttgtagtcggggtagtcgcgcaggtgtcgggcgcggagccgcttggcctcctccacgaagggccgcttctcgtcctcgtccagcagcttccactgcgcgcccaggcgcttggagatctcggagttgtgcatcttggggttctgctgcgccatctggcggcgctgagcggagctccacaccatgaacgcgttcatcggccgcttcaccttctccaggggcagcgtcccgggggccgcggggctcccagcgccctcccgctcctggggtcccgaagatgaggaggcagcagccgtggcagccggaggctccaggctccaggcctggtcctgtgaggagcctggtagcgccatgggttgggagaagccttaagagggcgtcctgaatgccctcccctcaacgtgaagcgtcgatcctgaaaatggaaaggtcttcccagtctggagtcgttgccgaggaacttgggtccttaaaaagtgtattttatccccaagcccagagcttaaaccggagcctttgcttccaacctgttcggcacactttggggagagtcgaatgcaaaatccgctgtctggtgccccggcactgaagaggtgttctgaggcctactgactgggggacccccggtccctctccccgacccgcagctgcgatcagaccgaccttccgtggagggggtaaaccataaacccctttgtggtctccggagttccgacagctgccaggcgcggataggccagacctctcccacctgggctcagcgtttgtggcaggcgggccagacctgggaacagcttttaaagactgactccgcccctgtccctcccataagactgcacctccttaagggcgccaacatcctcagcccgtaggtaaacccaggtgtcctgtttgtcccagcccccaacaccctcagggtgccacgccccccgccccccccacccaagacctgatgtcaggccttccagcccgttgctgattgcctcccctccctgaagcacaggcaatttaaagccaattctttccacaatgggatcaaacacagggggatgaagtgccctcagggcccgagttgtgctgagaggagcttgggagcatcccggaccaccaccccaacccctttcctggtgcctgttgctcctcaaatcccagaactgcccctggggcaagaaaggccgaggagggagaccatttttgtttcctgagtcattccagcaggtgcttgggccgtgattcaacccctttcccaagtgagaaaacttaagccctcccaactccagtccctaaacctatatttctccactgctattgaattatggcaagttttagcttcagtcgtccaagtcatgaggggggagccaggaaacccaggacaactccccaagttaagaggtctgtgatgcgcatgccggagaaaaagcctggagccagaacagaacaccaccaagaaggccggaccccgggctccagaggctgctgtgagggaaccctgctccccactctgcccaacggcccagcccaagccccaggcctcaggtaatcggattaagcagcctgccttggctctcagcttctacaggaacagctccagctctgagcagccctgcctagcctgtgctgtgactcagggtataggagtggcccaactccctctaccagcaaacttgggggaggggagaagcaacaaggcacaagcccccctcctctgaaccaggagggagaacctgggcctggggagtttaggaatgtcaggaattcccagaagtaagaccatctttgggacaagagacaatgaagagaagtcagatgtggaggaacagaaaacaagagccaggggccagggcaggtcagtcctagagaaacaaatggaccaaactggggacaaagaaggcacaggagccagacagccatttggatttttttattctctttttaaatactgtacagtgaaaaataaatacgccttctcatccaccagacaaggttggtcccctccccagggggaccttgtcaccccccttcatacacacccctggttctactccaaaaccttccccgtgcctcccacccacttatctcttactatccccgtcttccacagtgatgaggccccagaaatggggggtacaggatgggaggagggatagcaggggaggccccctgaacggtcaaatctgggtgggtcgaggagcaccccccaccaacaggtggagaatgggggtgttcagagagagattggggcattagaggataaaggcacatccagtctgatggggaaggagagaggctccccttaccctgggggtagggtggacaagagggagggggtatgaccctgttacacacccctccactagctcctggaggttggggggtacccaagctgctgtgccacccccctcccccctagataagagcagctccagcgcaggtcagttgggcctgtgagggccatggtgttgggcagcaagcgagatggagaagggaggggtgcaggttggaggttttatgaaaccccattccaccatactacccaactccaagggggcggagagctccccattctccgaggggcccttaggaagcttgctgacagagtcaccctgaggggaaagtgggaaagaaaacagaaaagcaagaagcggtgagtagaaattcaggtgggagacattccctaccatccaagccctcctggcatttggtgatccagaggttggttccctgatctcatgatccagtctctcttacttgggatccagaaaatgtgaaccacactttcttctctatcctattcaaagtttacactggtctaaactccatcagacacagctgcctctgcaattcagtaggagatttgtgaaattttttgtgccccctgccccagagtaacaacaaaaaagggatggggtaaagcacatcttgcctgcctaccttctgtcctgaaagagagtcttctgagggtttagtgcgttccaggggtggcctctggcggctctgagactctgctcgtgagatatagtcagccacagtcactggggaaggcaggagattaagactttcagatggaattctggtagccagcctaagacacccactgaacccgaacccctgattttcacaggggtgagcatcccattctctcagctctgaggaaggattctggtgtccagagttggctgacctggctggcggtctccactgatagagccatcagtccgattaccacggttacggcggcggcggctgcgattacgacgttgaggtcttgattcatcttctgtagggtaggaaaaaaccagagtcacacatccaacctcccaccctcgattcctacccatctctaactttccagaccccaggcacaccctcacccaggccattctctgtcatgttgggcccatctgattccaggcctccatccatgacggtcctgtcttcatcagtgcggcggcggcgggagcggcggcgcctggcacttgctggggggggttccccaggttctgaatcaaccgggggctctggttcagacgtgtccaataggctgtagggattactgtctggatccttcagcactggtcagaggaagaagaggaggagttggcagtcaggtgcccatcatctttccttttggcccatattcatgaacccagctgtctggtacctgagctaatagatgaagaattgtatctcgaagtgggccggggggcaggtgggggtcccctaccccggcccccagtcggccgcctccggctttcttcccctcgggttgggggatccctgtcgccaggcccagctcggttgggctcctctctcttctctgactcagtctctgaagctgtagacacatctgagctggggcctgaagaacacaatgggatttattcacggccattcatcccacctcaggatccatcacatcccccaaactggaagaattctccttctcactcacaagcctcccagccaatcaatcactttttcatcatctccattccagatttccccaaacttccatccagacctctgcctctacccacaagccctgccactccttgcctcctgttcccataactgtctcaccataggcaggaccgcctgtcctccggccacggccacggcccccatagctgcccccataggttcgagtcgcatggagggaggaggaggagctctcatcagtgctatatccagccttgtcgctgccaccgctgccccgcccactcccaggagggcgaaagcccagcccaatctgccgaagctgctcatcaatttgtagcctctccaagcgaagctgctctacctcctggttgggtaaaagatggaagaaggggaaggagaaataagatcagtgccttgcttcatgcttctgcaccctgactgtccctctatatctaacctctcaggaatgcagggagaaggaagacactggctaaacaaggaaaattctgggacccaaccctatagccccaaatttccacagatgttttctgttctacacggagagacaaacagagaaccaaaatccctgagctgacccccacagcagtcttagttcccttttcacacccagcatttttctctcccggcctgggtacctgcaggtaggagaggtgatactccagcaaagcctgggcattgctgatgttctctcgggtgccaacaaaaatgaagggaaccattccctagagaacagagagcagaaacgatggatcagaaaggaaaatgaaatggaaggattaacgccgcccagtctcctaggggagcctgcccagtgggatcattctgggctctaaatctactagtgttaaacaactttccgtactccaccctctcaaagaacaatcccagccctcagaggacaatcccatttacttctggaaaccaatctctatgcccacttgccccgtacccatacctcctccctggggttcttcttgtcattatcaccttccactcgaaccctcaccacaccagatttatccacaatctcctggatcactttcccgttctttccaatcactttgcctggaataggtaaatgaggaattcagccttttattttttttaaggaaataagaataaagctgatacaccgtcttccagcctcattttctttatatggattccatttacttcattctcctgcttctaggtttctgatgtgtttttacaggacaaaatgttacaatccctagaaatttattctttcatttttatcactcccattacagactgtttctctgtccttgtgaaactgggagtccacagggaggtgccaatcctggataaaagctcagaatcactgtagagaatcttgattctgacctctaactgtatatacacaccaccaactcaccaaccaggttcctgggcacttgcactgagtcctcagaaaactcaaggtagcttcgggcctgtcggcaagcctcgggagtctaaaggaagaacagcagggagttgttactaaaacagaagaccagctggatgtggtggctcacgcctgtaatcccagcactttgggaggctggaggcaggtggataaattgagctcaagagttcaagactagcctgggcaatatggtgaaacgccatctctactaaaaatacaaaaatcaaaatacaaaaatactaaaatactaaaaatacaaaattggtggctcacgtctctaatcccagctactccggaggctgaggcaggagatttcttgaacccaggaggcagaggttgcaataagctgagattgtgccactgcactctagcccgggcaacagagtgagttagactccatctcataaaaaaaaaaaattaaacaaataaataacttaaaaaaaaaaacagaggaccttggccaggcacagcggctcacacccataatctcaacagtttcggaggctaagaagggaggattgcttgaggctaggagttaacaaccagcttgggcaacagagatctggtctatttttttgattttttggtctcactctattgactatgttgcccaggttggttcagtggcaccatcatggtgtactgcagccttgactttccaggctcaagtgatcctcctgcctccgcctcccaagtagccaagtagctggggccacagatgcatgccaccacgctcagttaacgttttttggtttttggtttttttggggggtaaagacagggtctctctatgttgtccaggttgttctccaactcccaggctcaagtgatcctcccctctatcttcccatttcagcctcccaagtacctgcgactacaggtacgcaccactacttccagctaatttttaaatttttgtagagattgggtctcactatgttgcacaggctggtctcaaactcctaggctcaagtgatcctctcactttgacctccgaaggtgctgggattacaggtgtgagccactgtgcccagtttgaggcttattttctacttcggcctctcttccctctatcccctaagagacccagaagaaagacatcctttgctgacctccccatagatgcggaaagtgcaggtctcttcacccaactcaatggcggtcaccccaggtacttttcgggcctgctggatgttggcaccgtgagtcccaattgccagtcccatcaggtcctctcgcactgtgaactcctcttggaaggctgctgccaactgcttgcttgtctgaaaggaaaagtcactgtaggaatcatggtggtagaatctcacagtcccaggcacacgaccctttgcataacttaaataaggaaaactgtgtgatattaatagaaagctagaaccactctggagtccgcggaccacgaggacctgtgtggaaaggtcaggaactttttgttttttctttgagatggcgtctcgctctgtcgcccaggctggagtgcagtggcgcgatctcagctcactgcaacctccgcctctcgacttcaagtgattctcatgcctcggcctcctgagtagctacgactacaggtgtccaccaccatgcctggctaatttctgtatttttagtagagacaaggtttcaccatgttggccaggctggtctcaaactcctgacctcaggtgatccgcccgcctcagcctcccaaagtgctgggattaccggcataagccaccacgcccggccaaggtcaggaacttttaattccactccttccaaataccagtggtttgtgggggaggaaaggtaaagagggcagagtttggactgggacacaccgaagttctggatttggccctaacagtatctgtccctaagagtatctatctgtgtgatcttaaacaaaacatactctgcctcttgtgtcatctgctaagtgattatatccaacttatcttattctcaagactagcaagaggattagacaaggctggtgtgaaagtacttctcacaaggtacatgcaagtgtaaggaactcttaccttaatcaaacaaatatcaactcatccccaaataaaactcaacaacttaagtaaaaagtgaggggtaggctgtgcgcggtggctcacgcctgtaattccagcactgtgggaggctgaggcaggtggatcacaaggtcaggagatcaagaccatcctgccaacatagtgaaaccccatctctattaaaaatacaaaaattagctggccttggtggggtgtgcctataatcccagctgcttgggaggctgaggcaggagaattgcttgaaccagggagttggaggttacagtgagccgaggtcatgccactgcactccagcctggtgacagagcaaaactctgtctcaaaaaaaagtgaggggttaagaaaaacagaaaacatgcctctagaacaccaggctttcacttcatttctcaatcagtccttagaggaacccctgggttcaggggcaggaagacaggaaaggttttagaggagtgaatcccatgttgtaagcaccaaatagaaacaatacctgaaaggagacattcctagattgaaatacactacttcccacttccaagttggataggactgaattataccaaggatttataccaggcaagaagagaaagttggaaaaataaactaagttgagtgttcaaaatcactacattaggaggggaggggaagagatctacaatgacctataagcgtcttctagataagcttgcagaacagctgggttttcttttttttttttcttttttttgagatggggtctgtcacccaggctagagtgcagtggcatgatctctgctcactgcaacttctgcctccctttttttgtatttttagtagagaaggggtttcaccatgctggccagactggtctcaaactcctaacctcaggcaatccacctgcctcggcttcccaaagtgctgggattgcaggcgtgagccgctgcacccggcccctttccggtttttagaggcttcactactaggcatgactgattaaatcactgatcctcagtgattgccttaacctttggccccattcccctcccaggaagttggtgggggtgaggctgaaagttccaaccctctaatcatgaagccacctagaggggctagccatgaatcaactcatcagcacacaaaaacacacatcactggagattccaaggattttagaagttgaatgccaggagcctggtcaggagaccaaatatgtatctctcagtatcacagagcctgtcagtcctactggttttactcgtaaaatttatcctacataaaactactctctctctcttcctttagcactccagttcaagtttctcacctggactactgtgctctgttcctgcttccattcttgcccccctttccatctgtcattgaaacaggagtttaaaacagaaggcactttcggccgggcacagtggctctcgcc

SEQ ID NO: 1145 - DNA, 36661 bp, Homo sapiens
gaagaaaatgaaccatcatacactgttggtgggaatgtagaattgtgcagcctctttggaaaccagtctggcagttccttaaacatgtggaaactctacacataaagttctcagaagacccagaaattccactcttaggcatatataccaagagaaatgagaacgtatgtgcacacatatatggatgtttatagcaatattattcataatagccaaaaagtagaaacaactcaaatgtccatcatctgatgaatggataaatggtatgtggtatatccatacagtggaatattattcagccaagaaaagggaatgaaggctgggcatgatggcttgttcctgtaaccccagcactttaggaggctgaggcaggcagatcacttatgcccaggaggtcaagaccagcctgagcaacatggcaaaaccctgtctctacaaaaaatacaaaaatttgccaggagttgtggtgcatgcctgtagtcccagctactcgggaagctcaggtgagtggatcacctgagcctgggaggtcaaggctgcagtgagctgtgatcgtgccactgtactccagcctaggcaatggagtgagacccagtctcaaaaaaacaaagagttgggggtggtgaatgaaatactaatgcatgctatattgtaaatgaacattgaaaataccatgctaagtgaaagaagccagtcacaaaagacaacatatggtagtcatattccatttatatgaaatttccatactaggcaaatctatagaggtagaaagtagattagtggttgcttaggactagaaggaagttggggagatatgaggatgagtgtaaaaggtacaggatttctttttgaggtgataaaaatgatctaaatttgactgtggttgcacatatctgtgaatatactaaaaaccactgatttgtacactttacatgggtgagttgtatggtgtgtgaattatatttcaataaagctgggttgttttttgtctgtttgttcatttgtttttttgagatggagtcttgctttgtcacccaggctggagtgagtgcagtggcgtgatcttggctcactgcaagctctgcctcctgggttcacaccattctgcctcagcctcccaagtagctgggacttcaggcgcccaccaccacgcccggctaattttttatttttattttttttagtagagacagggtttcaccgtgttagctaggatggtcttgatctcctgacctcgtgatctgcccacctcggcctcccaaagtgctgggattacaggtatgagccaccgcgcctggccaagccgggtattttttttaagtgaaggcaaggagatcagtgaaagaccactatatatagtagtgtgggtgaaatgatggtgtggtggtagcaaactggaagaaataactgaagaaagaatagacaggggttgaatacgggactgaaagaagagtctaggatcactgccaagcttctgttcatatgatgggtgggtggtgataccagtcactaaaagaataaaaacagctaatatttacatagtacttaattacccggcaccattccaagcattttgcatgtattaattcattcagtcttcaacaatcctattagtaggtaccattattattgtcattttacagagaacaggaccagagaggctagtaacttggctaaaatctgatagctagtaagaggcagagctgaatctgttgttcttgttttgagacaggatctcgcttggtctcccaggctggagtgcagtgattcgatcatagctcactgcagcctcaacctcctgggctcaagcaatcctcctgtctcagcctcccaagtagatgggactacaggcatgcaccaccatgctcagctaatttttttaattttttttgtagagagagggtctccctatgttacccaggctggtctcaaactcctgggctcaagcgatcctcctgccttgagcctctaaaagtcctgggattacaggcatgagccactgcacctggccaagagctgacatttaaacctggatattctggctccagagtccctctcttagccacagtactatgccgcttctctggcagtagaaagggccagatttgggtatagtacacttccaaattcaccacaaatatatcaatcacacaccacattccaggttgtgggccccaaagatatcctgccccaacagaaggtctccccattcccactgtagcactgaagacccagaaccccaatacaagcaagtcagcaaactgcaggtccagagcacagtcctaaatgctcagcctcgtctgcctgcacctgttccagcctcagttctcacagcttcactcaacagccatattctcacaggagatggcctgggttgggtggggcttggagcaaaagaccagcccagcagcacaaacttgtttccagggatagaatggaaaaggccagaggaaaagcctcattaggaggcagctgggaaaggcgaacccagtgagtacttcatccgaggaacctccctacaacccgtcctggccacaaaaacagaactcccaccagttggccctgagtcattcattcccctcccgcccccagggaaggggtgatttcctgcaggcagctcaggctcctcccaggggctgtgcatcctcttatctcacccaaggccctctcctagggcagggcaggcaaaccagaagctggctgcagtggggctgtccttgtatttcctcagcgggccttggattctggggtcagggagagacccagcagcttaaggaccactcaggagccaggatgtctcatgaagagcagaggacagagggctgaccaaactgggttctctgcagctctctcccttggggttactactgggcaactactggtcctgtttccatttacttgagttaaacctctccagatgcctgttttgaactcagactcatccagctcaagactcacaccatgccctgtgccaggcttataatgttaaatgagtgaataaaatggaggaaacagccataacatgctcctagtcagaggtatctgtgcagtagttaaaagaacaggctttagagtcaaacagacctgaatccaaatctcagctccatcctttgatagtgactttgaactcactgactccttctaagcctcagctttctcttctgtgaagtaaggacaaaggcacctaacagggtggttgtatgatgaaatgagacaatgcattcccacagtgctggcaaacagcaagtgctcctcactgctaggtggcaggatcctggcaagagagggagttagggaggagggggcaggcccactcccacccagcgcctaccccaggaggagggccttaagatggcagtccccgggctggatgcggtggctcatgcctgtaatcccagcactttgggaggccgaggtgggcggatcacgaggtcaagagttcaagatcagcctggccaacatagtgaaacctcgtctctactaaaaatacaaaaattagccaggcgtggtggtgcctgcctgtcatcccagctactctggaggctgaggcaggagaactgcttgaacccaggaggcggaggttgcggtgagccaagattgcgccatcgcactccagcctgggcaacagagcaagactccatctcggcggggagaaaaagaaaaatgacagtccctacttggggattcagttcttatgtagctagagtgggggcacagcatgtcattttatacataagaaccccccaacagaggctcaagtttctgcgggaactcaaaggaagaaaggttatgtgtgtgcacccaaatgacttcaaggggtgccctttggggtcacccttttgatttgtgtctaattattatggctcagttcctattccacatcctttgggaggtacatgccttcctgtgtttctaccaggactctccaagggtttccatccgacaggtgtcgttacctcttttcctttgttccgaaagcaccatgaatggagggttttgtgtacagtacactttactggatgtctgggcatgctgtagggaagccaagcactcacagaatagggagcatactgaggatttggcatcatcattctggaattctcctcagacagtcctacctggaatttctcactggttgacctttcttctcctcaggtggccatctttcacttaccggccctcctccgttttctctggagttaccacaggacattctaaaattcccatccatttcatttcccccaaactcagctctctaatgcttcctatcaaggccatgcccaaaggcccatccagtttgtttctgatcacaaaagagctacagggcctctaaaaggaatgtgaaattgtatttcgcttttttaattagccttttcccccagttgcatatagttggggggataagaaaagactcccaagaaatagtgacttaggggcaggcagaatcacaaaggaagttccaacaggctaagtggggagggtctgtgcctggggaagcaatgggaacaaggccctgtgcctagaaaggggattgggtatggggactagtgaatggagcatcctgagggggagattccagcaatgggggtcttgtgctgcagcactgagggatgagccttcctcatcttgtggagctgcagaaagatttccagcaggaagaaaataaataaaagcacatttgaacctcagaaaaagcactgagtaaggatataccatttgtcaactatcagaatggcaaacttaaaacttaacgttgactggccgggtgcagtggctcatgcctgtaatccccatactttgagaggccaaggcgggaggatcgccagaggtcaggagttcgagaccagcctggccaacatgttgaaaccccgtctctactaaaaatacaaaaattagctgggcatggtggtgcacgcctgtaatcccagctactcaggaggctgaggcaggagaatcgtttgaacctgggaggcagaggttgcagtgagctgagatcgcaccactgcactcctgcctgggcgacagagttaagactctgtcaaatcaaaaacaaaaaacaaacaaaaaaagttgacaaagatgtgggggaaatacagcaccctaacacgctgctaagtgtataaacggaaccattatatttatttatttatttatttatttatttatttatttatttagagatggagtttcactcctgttgcccaggctggagtgcaatggcacaaactcggctcaccgcaacctccacctcccggatttaagcaatgctcctgcctcagcctcccgagtagctgggattacaggcatgtgccaccttgcccggctaatgttgtatttttagtagagacggggtttctccatgttggtcggactggtctcgaactcccaacctcaggtgatccgcccgcctctgcctcccaaagtgctgggattacaggtgtcagccaccgcgcccggccggaaccatcattttagagagacaactagcaatgttgagaaagagatgaagcgatagagaatcctagtgcctaaagctacctgtcccaaactttctaactggaaaaaactgtcagttgttgggaaatctgaaaacatggggagataaagggcaagtgcacaggtacgggctcacgagagccaaaagccagttatcttcccagctcactgcttagtgacatcatgttagtagcttgaaacaggccatgacggaagtatttacaccacaaaaagcagcaaatgctaccaaacagaacaccctacctcaccccggccagtttgtcagcacactacagcctgagccaatcctcatccagcaacctcttgagttctctgaacaatcgctacccagagatcaagtaccagttttataagccaggtctttggccttacatcccaaaaggaaagcctaggcctgctgagcagcactggactttcaagagcctgccggactccttcaccaaagcaggcagacctatatggcctcctttctcctagatatcccagttcctgcttgattttctaaagaaatcaaggcctgggccaagtgtggtggctcacgcctataatcccagcactttgggaggccaaggcaggtggatcacgaggtcagcagctcgagaccagcctggccaacatggtgaaaccccgtctctactaaaaatacaaaaattagccagacgtggtggcaggcgcctgtaatcccagctacttgggaggctgagacaggagaattgcttgaacctgggaggcggagtttgcagtaagctgagaccatgctattgcactccagtctgggtgagagagcgagactccatctttaaaaaagaaagaaagaaagaaagaaatcaaggcctggagaagacagcttttttcagctgtgtggaagcaaaagaaaatgggaaaatgacagggacagagagtggaccgcctcccatgcagaagcagaaagcccctgtctcaactctcttgacagtcatacacaagccccttgcagtctctgcacctttaaccgctattatactgcctccctgtagaagacacaggacttagacgtaggtgtagagggagaaggaaggtttgaggataactctcaggttccaggcttaggagcctaggtagcccatgagagatgcagaacagagcttgaagagagggcctaaagggtgtatgggagttagttatatttggggcttggtgaatttgaagtgcctatgggacaacaaatagagatgtctgattgagaatctgaagtttgagagactgatgagatcttgcaagttaccagtgcgtagatagagttgaagccatgagatcactctggcaacagaaaaggctgagcagggacacctggaggcagcaagatttaagagaaagagcaaccacagaaggaaactgagtggggacatgataggaggtaggaggaaatcaggagaatgtgacattggaaggatgaagattatcaagtgttgcagaaaggttgaatacgaagaggattaagatgagtgacacagtgagacgattttggctggctgagagggaagaaagaaagcaggagataagattcaagtaggcaggggccaggtcaggcagagccagacatggcatcagaaggcgtttgagtggtattctaagtgggaaatctttggaggattttaagaggggagtgaagaaatctgatgtgcattttaaacataccatgctgttgtgcggaggacaggctggggggcgagggtgggaatggaggtggggacaccagttaggaagctattacagtaacccagacttggattaggacggtaagggtggaggtggttaaatgtgttcagattcagtgtacattttgaaggaaggtctgacaggacttgctaattaattggatgtagaatgcagagtaagagaaagacagggatcaacaagtatggaaggtgttggttcgagcaactgagtaggtggtaatgctatttacagaggtaggcaaggctagaggaaaacaaaataaacagggttaggggtgggaatgagaatccagagttttattttgaccaccttaagtataagatgcttgccgggtgtggtggctcacacccgtaatcccagcactttgggaggccaaggcaggtggatcacctgaggtcaggagttcgagaccagcctggccaacgtggcgaaaccccgcctctactaaaaatacacatacaaatacacgccaggcatgatggcaggtgcttgtaatcccagctactcgggaggctgaggcaagagaattgcttgaacctgggaggcagaggttgcagtgagctgagattgcaccactgcactccagcctgggcaacaagagcaaaactccgtctaaaaagaaaaaaaaaaaaaagtataagatgcttttatatatgcaagtggagaagtcaagtaggcagttggctatccaaatctggagcccagggaagaagtcacagctagagataccatttgaagtcatcagcatacacagagcatcaaagccatgggactgcatgaacactgaagttgtgttttccctctcacttgatctcacagaagtttgggtagcccttgcctggggactggggaaggcatccaaagtcattaccatcagtcctcgtaatgtgagagccaggtacagctaaagacaaatctgagtcagggactgcttgcagagaaatggtgccagagaaactaagacttcacaggagagctgaaggtgttccatctcctccttgatactgaggatacttagtctgtacagccagcaatgggagccctagctgaggcctgaggggctaaaaatgggagttgatgtggctatgcaccctccccacaactcacctcctgtccccacctccacccacacaagagtcaagcctcctagaattggcataaaatccacatacagagcagtcccaggaggaggcttggggttcagtgacaggagatgagcacaggctgaagagctgagaccagccatccactgaatttttttttttttttttttgagacagagtcttgccctgtcacccaggctggcgtaccgtggtgcaatcttgggtcactgcaacctctgccccctgggtttaagagattctcatgcctcagccttctgagtcgctgggactacaggcaagcactaccacgcctagctaatttttttgtatttttagtagagacagggtttcaccatactggccaggctggtctcaaactcctgacctcagatgatccacccagctcggcctcccaaagtgctggtattataggtgtgagccactgcacccagccccatccactgattcagagcaaacaggataaaagtactgaagaccattgcttctccaactttaagttacattcaaaccatctagggattttggtaaaatgcaggttctatttttgtaggggccagctccacagggtcagtgggtttttctccctgtgtgcaaagacgagagatcatagaaataaagacacaagacaaagagataaaagaaaagacagctgggtccaggggaccactaccaccaagacgcggaaaccagtagtggccccgaatgccaggctgcgcagttatttattggatacaagacaagggggcagggtaaggagtgtgagccatctccaatctgagcaaacaggataaaagtactgaagaccattgcttctccaactttaagttacattcaaaccatctggggattttggcaaaatgcaggttcaactttaataggcctggggtggggcctaagattctgcatttctaataagtgcccacctaatgctgttgctcctggtctacagaccacattttgagtagcaagggattagaggcagccgtggaggccacccataatggagagggcatttccagttccagggagaatgtgtttattcatgcgcaaagtcacagaactattaaagtggaaatacccaccatttggcatggttgtggggcagagagttatttctcagcagattagcctcccaagagcatagcacagcatggctgttatgcaggtgggttctgaaggttgacctcctgagctttatgtcttagtatgtaatcttgggcaaatctttaacttctctgtatctccgtttcctcatctctataatggaaataacaagactattgtgcggattgtctaagtgaatggatataaagtgcttaacacacggcagcatagtaagtgctcagtaaaagttgctattctgatgctattataccattctataatcgttagcacagatacagaggctgagttgccttttggtacacggtcaaatatacaacccccatctccctcacaccaaaaggcctgtgtcctctctttcaaattcctccttccctcctgcccactccccctcccctggcccctggccccagtgtggtctggatgggccccagaggggcagggacagggacaggacgtggggctgtatctgacaggaacctgaggggctggcctgggaggggattggggcccagcttcctgaagggaggatgggctaaggcaggcacacagtggcggagaagatgccctcctgggccctcttcatggtcacctcctgcctcctcctggcccctcaaaacctggcccaagtcagcagccaaggtgaggtgcacagagggtggagatcacctatgcccaggaagagggagccctgggaggtgatgcagggccccgggaggggaggtagagtaagaggctctcctgctggtcccctccccttccacataaacatgcctgggaggacccagggccaactcaccagctgttccttagatgtctccttgctggcatcagactcagagcccctgaagtgtttctcccgaacatttgaggacctcacttgcttctgggatgaggaagaggcagcgcccagtgggacataccagctgctgtatgcctacccgcggtaggtgctggactgtgccccactccccatgtatctgtccctgcacttagctgagtcccactccagcagctttcctgcctgtccgaggaccactctgaatacaagccctaagtacctactttttgaacagatgtgctttggatgtatgtgggccccagctccagccctacataacccctaatcccacctatcccaggcagtgagaagaaaaatggcagtactagagacagaagttgggcatgggcccaggtctgggtcctcagggctccgcatggtggctgtgtaggagggacctcttctatgccaacagggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggtaagagccatcctcctgtcaccctgccccctccacttgctgcccccagtccagctcccggaatcagacttgcctgtgcccttccagctcagcacggatacccctattaccagaccccctgaggcaccccaagactcccttgtcattcctcccagccttggcatctagagctagaaatgcccaacagatcattcacaccctgttcctcccatcgtcaacaaatcatttattcatccattcaagagttacagaatacctactgtgtgccagacactgggctaggtgatggggatatggagagaaaaagggatccctgcttacaagaagcactgagtctagcaagccatcatactgcaaagaagtcactgttctcatgagagaagaacagaatcaggagcctccctagcctgccctccaggagaatgacagcctacaatttttgaatccagaagctgccccaattcagcccccagcacccctctctgcagtccagaggctgagccatagactgtggtactcagagttctgatgtgccctgtcttgccctcaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagtatgctgaccttcttctgccccacctcttatctcctaccttcaatcttgccccaggaaaggacagaccatactttggggattccagacctaggttcgtccttggagagttagtataggctcagatatgagccacgcctacttaggggcttcctactttgggtcattcccactgacaaaagcaaaggctttcaggcctccaaattaatggagatttcgcaacaaaaccctgaacaccacctgaaacccaccaacttagcccctggtctgtgtgcatatctatccagcaaggagctgagctcctctccacagagatgctgtgcaaatataagggttggaggctctctcagctgacaggcagacctagattgtgaagctgggattttcctcccaaggcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcaggtgagtcaacaaaggaatagggagatggggaggagataaaagaatatctctagggaagcctgggctagatctgaagctctgggaaccatggtccttcctgatgatctcgaacttgccactggacaggaactatgttcagggaaagaagagagaataggagtcaatgttctaagttatatgtgtagaaattatctgaaatctgaacaccctatacagtaggggcacacgggccctgatgggacttacttctttgactttagtggcacttggactgcaatgctttaccttggacctgaagaatgttacctgtcaatggcagcaacaggaccatgctagctcccaaggcttcttctaccacagcagggcacggtgctgccccagagacaggtgagagctgaactgctgattgaggttggtgtcatgggagtgagccacaatcttgcagaaaaaaagaagagagtgttcttggtcctcttcactctccttcctttgtctccaaaccatacagctttcaatgctctcttatctattctgtcatcctccaatcgatattttatcttctcaacccctctctgttcccattgggaatgctttggtttagtttagccttaatcatgtcactgggaccattgcaacatcctacagtctaattcacctccaatgtattccccatgctgctaacagagtgatctttgttaagctcaaactgtgcatgacctttgtaaagctctaactttgcatagtctccccttactcaaacatgtactgcaatttctcattatcaaagccataaaaaatttagcctggccttcaaagacttccaccaagcacctcattgattcttcatcctctccatatctaaatctataaccaagttgtattgattttacctattaactatctctagaatctgcccacttgtctatcactgccattatcctactacaacccatcattaattctctcttgggctactgaaaagacatagtaactgatcaccctgagtcttccaagtaattcttcacataggtgctgaagggatcttttcattttgttttgttttgagacagtctggctctgttgcccaggctggaatgcaatagtgcaatcttggctcactgcaacctccacctcccgggatcaagggattctcctgcctcagcctcccaaggagctgggattacaggcatgtgccaccataccccattaattatttttgtatttagtagagagggggcttcaccatgttggtcaggctggtctcgaactcctgacctcaggtgatccacctgccttggcctcccaaagtgctgggattacaggtgtgagccaccgcacctagcctgaagggaccttttaaaagtgcaaaaatgaatgtaacactccctgcttaaaaatcttcaatagcttcccactagtcttaggataaagaaaaaaacctctaccatggacttgaaaagttctgagactcagcccctacgtacttcttcagcttcatcttgtgctatgctgccctttgatccccatgctccagcacagggcttctgtggtcccctcatatctggcatattcccttctgcttctaggtctttacactgctgtttacccagccctactgcctttacttaacttctacttatcctccaaatctcaactcaagcgtcactttcttagggaccctcccctggccttctttattaagtccaatagcactaatatacattcttgttgtaccatgtaccgcttcttcttcttctttttttttttcttttttttttctttttgagacagagtctcactctgtcgcccaggctggagggcagtggtgccatctcggctcaccgcaagccccgcctcccgggttcatgccattctcctgcctcagcctcccaagtagctgggactacaggtgcccgccaccacgcctggctaattttttgtatttttagtagagatggggtttcactgtaagtgttagccaggatagtctcgatctgacctcgtgatccacccacctcggcctcccaaagtgccgggattacaggcgtgagccaccatgcctggccgtacctctccttcttaagtacttatcatagtcatactttcatatttatagtttatatgattatttggttgataataaaaatctggccaggcccagtggctcacacctgtaatcccagcactttgggagactaaggtgagaagatcacttgaggccaggagtttgagaccagcctagacaacatagtgagacttcgtctctacaaaatttctttaattagccaggcatggtggcacctgtattcctagctacttgggaggctaaggtgggaggatggcatgagcctaggagtttgaggttacagtgagctatgattgcaccactgcactccagcctgggcaacagatcaagactttgtctcaaaaaaaacaaatctctcagaactccagttgagaaaggctgatcttgaccacatatgatccatgagggcaagatcaatgggtttttattcaccaatatattctcacctaccaatagtaggtgcctggtaaaaaattgttgaacactattaactatttaaatgtattcttccagtttttttctatgtatttacatacatctctatacaacatttaaattttattatttttgagatagggtcttgctctgttgtccaggctggagtgcagtggcatgattatggctcactgcagcctcgacctcccagactcaaacgatcctcccacctgagcctcctgattagctaggactacaggcattttctttctttctttctttctttctttttttttttttttaagtagagacaaggtctccctatgttgcccagactggtctcaaactcctgagctcaagcaatcctcccatctcagcccctctaccacgcccagcctaacatgtaatattttttttttttttgagatggagtcttgctctgttgcccaggctggagtgcagtggtgtgatctcagctcactgcaacctccgcctccagggttcaatcgattctcctgcctcagccccccgagtagctgggattatagatgtgcgacaccatgcccagctaattttttgtatttttagtagagacgaggtttcatcatgttagccaggctggtctcgaactcttgacctcaagtgatccacccacctcagcctcccaaagtgctgggattacaggtatgagccaccacacccagcctaatatttaatttttaaatataaattggattacattacatatatggtttgttgactcacctttttgcttaaaaacatgtctcagagatcattacaaaaagatgtaactcattctttttaataactgcatacatatccataggattgagatgcctgagtggactaaagggtagcaaaactgaagtcatcatttcctctatcaaaacttgcttttcctgctgggcacagtggctcacacctgtaatcccagcactttgggaggccgaggtgggtggatcacctgaggtcagcagttggaaaccagcctggccaacatggtgaaacctcatcattactaaaaatacaaaaattagtcgggtgtggtggcacgcgcctgtagtcccagcttcttgggaggctgaggcaggagaaatgcttgaacccgggaagcggaggttgcagtgagctgaaatcgtgcccctgcactccagcctgggcaacagagagaagactctgtctcaaaaaaaaagaaaaaaaaaacttgctttttctttattgtctccgatcctaccatgaattcagttttcctggactgaaaaatagaaatcatcctggacttctcccattccaataccctccaggcctaaccagaaatagtcttgtcatttttaccttttcaatatctcttcaatcatctctttccctgtctctcactgctgctaccctattttcacatcctcatcactttgcacatgaaaaactacaagaatgtcataatggatttctctgcttctagtcggccctcacaaatcctttctacagactgtagttagaatgatcttcctaaagtacaaaggtagctatggcacttccctgcttaaaatccttaaatgtctacataactaccacaaggttagtagtaattcaagttcaagctccccagaaaggccataaggccatccatgacatggtctgcagtctcacatttaccacctaccaccaggccctttatgcgaaaaccatctgcaccacttagaatttcccccaaagcaccacactctcttatctatgcacaaccatgtgcctgggatgcctgtttgtcccttttgcctatcctatttttagttcaaaactcagtctaaacatcgccgtatccaggaagcattccctgaccctcccagtctgggttggatgctcccctttgatgctcccaagccagtctatgcacatcacagaaaaatatcatgtttgtttttctgtctttcccactgaaattagagctctttgaaccttattcctctatgcactcatagggcctggcacagtaccaattggcacatagtatcaattatttgttgattaaatgggtaaacatacccattttagtgacggtgagccacttaggggttataatcaagagggagacatgattcaattgttcaataaagaattattgagagtgactttttgcaaggtactggggataaatagtgcaacaaataaaatggaaaaggggccaggctcggtggctcacacctgtaatcccagcactttgggaggccaaggtgggcagatcacttgaggtcaggagttcgagaccagcctggccaacatggcgaaacgccatctctactaaaaatacagaaattagtcaggtgtggtggtgggtgcctgtaatcccagctactcaggaggctgaggcaggagaatcgcttggacccaagaggcagaggctgcagtgagctgagatcgtaccattgcactccagcctgggcaacaaagcaagactgtctcaaaacatttttaaaaataaataaagtggaaagggttccagcattgttggggcttacattagtagaggggaggggaaaaggagggggagaaaagtaagtaaagaaataaaggaacaaagttataatagagactaaaggggggcgtgtggtgggtggggggtgggtgttgctaatttagactgagtggccaggaaaagcctcaccagggaggtgacagataagccgagatctaaatggcaagaaggaatgagtcacatgaagacctacagtcagagcaatccagggcaaaggcaaagtgcaaagatagcacatttggcatatctatggcacagaaagaaggcctgtgcggatgaagggtgataaactggcatgagaatcataagagatgagaatggcaaggcaaggagaaaccaaatcacagagtcctgtaggcctggtaaggggtttgggttttattccaagtgggatgaagagccactgaaggattttaagcagtaaacaatgacaatttgacttacatttttaaaagatatgtttctctgtgaataaataaataagagtagaagcagaatcaccagtcagaaatttgccttaatccaagcaaggaatgatagtggcttcatctaacatagcagtggtaaagatcaaaatcaatagtttgtgacattatattctggacattatcacatcaacatttttggaaacaaattctggtagctgtgtggagaacaacttgaaggtagtggcaaaaacagaagcagaaaagccagttaggagactattgtcataatctaatagcaaaataacacataggggagagtaggaggaatgacgtatgagaacacgttaaaaatagaggatatttttctccagaaagatgagggttctttaatctttgaaacaatcctgtgaggttggtatcattaacccattttacaaatagaaggaaactggagcagagataaaccaagtaatttgcccaaagttacacaaaggtaagccaagacctcaactcttggtgaaaacccatgctgttttcacatatcatgccaggtctttcctcaaagggaagaggccagacaacaaagctgacttcagaaaacatcatggcaaaatagcaaaaacaaacgaacaaatgaacaaaggaaaaaacaaaaagaaaacatcatggcataaagacagagggaaagctctggaggcccctggaaggaaggagttaaatgataatccctgcaggccatcgttcttgtaggatgggaagccttgggattagtctctggggcaggcctgattcaatgactctgtggggctgggtcttaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctggtaagaactttcttcctcattcttcccacatagttcccacccccactgaatctgaccctgtgcccaggatccccaactctgacccttctgaccgatggctctggtggcacaatgccttgtgcacagaaggacttaagctgctccctgctgacatccctgtagtgcgcctccccaccccaaacttgcactggagggagatctccagtgggcatctggaattggagtggcagcacccatcgtcctgggcagcccaagagacctgttatcaactccgatacacaggagaaggccatcaggactggaaggtatggtcaagcaacaaatgcccacagacctcactacgcaggggatccctggggttggccatgcctgttagcaggagtgaaagtgtctatgtatccagtctctgctagtatatctatgtttatcagattcaactggtatcttagtctctcttgggcatctgatatttctggctactcctacttaacatttctcttccctttgtctttgggatatcagtcttccccgattttcctcctacctctctgactgaactttctcactctcctctcctggctcctcctttccagccttccacaaaatgctgtgcttcctagagtctcatcctaggctcttttctcctctgataaaataaatatgttctccccaggtgagtgctttaactccatggtttcaatgtccatacattaacaatcgcaattttaccattctaactcccatatggaaaggaatttacaaaccacaggcaaattaccaaaatgtttgaagtctgtttcctcattggtgaaatgaggatgaagctatctaccttatggagttatagtaaagattaaatactatatctaaatacctagcatactgcctggcataaggaaggtgctcaatatacattacttaaatattagtttgtctacttttattctcatttgccacacatatatacaactatgtacaacatcttatggttctaccaaaacttcctccccctggacatttcagactcagtctatccagaatggaactcctcttcctcctgaagctttacttttttattgtgataaaacttacatacaacaaagtgtacaaattttacatatatagtctgtacttgtgtatacatccacataaccataaccaggatcaagatataaattatttccagcacctcagaagctcccaatgctccgacacatcccccgccaccaaaggtaatcaccatcctgacattaccattgattcatttggactgttgttgaactctataaaatggaaccctaaagtatatcttcctcaaacttacttctcttctgtgtcctgtctctgacaatggcaccgctacttacccagtacccaagcctagaagcacccttgactcttcttgctcttcccttatcccttccccttactcatcaactaagttgatggcaataacgtactaatagtcctcaaattcctaccaggattgccttagactcatctgtgaccatccagccgtgtcatccatgcttttagcacactaaactactctgtggcacaaaaccaagcattaaatgcttctctggacttccgtggtgccttgcactaattaattgttgtgattatttacctgtttggatgtctttctcattagatatgtaagagacggtgttttattgctttctccccagtgcctaacccaatgtttggagtatcacacagttcataaatgtttgctgccttcctgcttgtacacatgatgcttgtaccccagcgcctaacgcaaatctggcatcctctgcagcatgagtattatttgtggcatggtctgtgtggctctgaatatatctgtttctgggggtgtccatcgcccgacctggagttgtgagaacacccggtagggtgtgcgtgtaccgggatccctgccgagggtgtacctgggtgttggtgttaggatacgtagctctctgaggtgaggtctgtgtctcaggaggtgggcctggcacgtttctctcgggcagagcgtgatcccgttagggagaggctctcggttagggcgctctatcctgttgctgggaagcgtgttttctgccggtggggctctttgtgggaatctccgaccgcctggggattcggagctgcaggatttgggtcaaacagacgctgggctatcgaagccccgacgccgggccaccgcacgcttctttgctcaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccggtgaggcaagccccggccgcaccaaagccgcacagcgcctgcgccagggactgggcgccgggtgcgagtggggcggggctcggagaggggcgaggcgcggggcgcggagaggggcggggccctgaccttgcgggccgacggctgcgcaggtgcccgcagtgcccaggggcggcgaggggcggggccagagtaggggctggctggatgagggcggggctccggcccgggtgggccgaagtctgaccctttttgtctcctagcctggatctccttggtgaccgctctgcatctagtgctgggcctcagcgccgtcctgggcctgctgctgctgaggtggcagtttcctgcacactacaggtaccgcccccgccaggcaggagactggcggtggaccaggtggagccgaaggcctgtaaacaggcattcttggttcgctctgtgaccccagatctccgtccaccgcccgtgcgcacctacggcttcgccacttcctgcacgtcacctctgggactcgccgcggctccttacactctaacacgcccactataccgcccacctcgaacagccccgcctcctgctgctcacctcggcgactaggccaccgtccacccttcagccaaactgcccactccacccccatccaatctgccgtcaggtcccacctcctaaacctagtccaaacaatggccccctttctctagccctacagacacgacctgactcactgaaacagaacctcttgcccctccgatctagcctcacacagccaccagaataatctttctaaaatgcgcacatgaacctatcaattccctccttaaatcctttcaatagctcccaggatatagtccaggctccctatgatgacaagcgaggctctgcaaaatcggcccctgccagcaagcacttcagcctgttctaccctgtgcatcagcctttccaaactggttttctccacaagtcaggttttacttctcagtgcctttgcacataacgtccgctctgcctgaaatagcctccctgtctcactaaacccattcatctgtaaataactttcttcaccaactcttaagaaacctttcctgaccctcccccttttggccgctgctctgtgctccaatacagtaccagtagtgttttactgtgtttatttctttatatatcttccctattataccttacttggtcatctttaaatccttagcacagtgcctgccaaaaagcaggcccttaaataaatgttattaatgagtgactcatttatgtgggaagacgaaggctgaggagaaatgccattggaggctataaacatgaagggtagaatgcatcccacctccatccttcatctgctgcttctttaagacttagctcagaagtcatctcctccagatggtgtcttctgatggtcctgggctggttcaggtgccactctcatgggctaccatctccctctgaacatacctctctttgaacttttaatctgcccatacgtatgagcagactgaaaggtagcctccatgcaggtagccagatccaacaaaaaagttggagaagtaggaggaggtggtctgctgagccaggcatactcagtttcttttccccaatttaccaggtaagtcacaccttctcccctggagagatatgagtgaggtcactgaagcggcctgaaatgttctactgacgtccctccacatggaaatatgaagctaaagaatccaggttctggccgggtgcggtggctcacgcctgtaatcccagcactttgggaggccgaggtgggcagatcacaaggtcaggagatcaagaccatcctggctaacacagtgaaaccccatctctactaaaaatacaaaaaaaattagccaggcatggtggtgggcgcctgtagtcccagctactcaggaggctgaggcaggagaatggtgtgaacctgagaggcggagcttgcagtgagccaagaccgcgccactgcactccagcctgggccacagagggagactccatctcaaaaacaaaacaaaacaaaacaaaacaaaacaaaacaaaacaacaaaaaaatggaggcccctccaatacatcttaatccatattcttcccagatagactaccctctccagtaacttactaataagctccactgattttcttcattcattcattcagctaatttactgagcacctactatgggtcagacactattctacaccctagaaatacaggagtgaataaatagacaaactctcttttctcggggaccatatgttctagtggggtgagacagacaaaaagaaatatacataacaatgtaataaatgtacaacaagtcaaatactataaggaaaaatgaagtacagcaggagatagcctgtcatggggaaaggaagcagcactacagtggtcccctcttatccacagtttcactttttgtggtttcagttacacgcagtcaattaaggtctgaaaaaaattacatggaaaattccagaaataaacaattcatgtattttaaattgtaagtagcacgatgaaatcacttgccatgccgctctgtcccacccgggatgtaaatcatccctttgtccagcatctccacgctgtatatgctccctgccccatagtcacttagcagccatcttgcttatcagattgactcgttgaggtattgcagagctgtgttcaagtaaccctcattttagttaataatggccccaaagtacaagagtagtgatgttggcatattgttctaattgttctattttattagtagtcattattaatctcttactgtgcctaatttataaactttattgtaggtatgtacgtatagaaaaaacatctgctgggagtcttgaaacatatcccctgcagataaagagggactactgtgtttcaggcaaggtagtcagggatgacatttgaacagaggcctacaatgaggtgagggaatgaatccagtgttccagacagaacaaacattggagtgtttgaggaaactgcagcaccctttgttgaacctgcccaccactgacttccctcccctacctgaggttttcttcttactctactcccctgcccaactttattgccttgaccatgctcttatatctccaagccttactccccggcctcactgctcccccaccccaactgctgtcctcctccctgccaatccactgccatggctcagtctgcttctcttccttctcccccaggagactgaggcatgccctgtggccctcacttccagacctgcaccgggtcctaggccagtaccttagggacactgcagccctgagcccggtgagtgtgcttccctcccctgtgcccaccaccaaccctgcctggtactggatccttgccccaacaatacaacttgttcaaggtccttgccctaccagtgtgccatccccaggcactaccccagcactaccccagcccttctccttcctgtacagtccagcccctcctcccacaggatctgctttaatccagcgcctctcctcatctctcccagcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttgaggacaggctcctcactcccagttccctggacagagctaaactctcgagacttctctgtgaacttccctaccctacccccacaacacaagcaccccagacctcacctccatccccctctgtctgccctcacaattaggcttcattgcactgatcttactctactgctgctgacataaaaccaggaccctttctccacaggcaggctcatttcactaagctcctcctttactttctctctcctctttgatgtcaaacgccttgaaaacaagcctccacttccccacacttcccatttactcttgagactacttcaattagttcccctactacactttgctagtgaaactgcccaggcaaagtgcacctcaaatcttctaattccaagatccaataggatctcgttaatcatcagttcctttgatctcgctgtaagatttgtcaaggctgactactcacttctcctttaaattctttcctaccttggtcctgcctctttgagtatattagtaggttttttttatttgtttgagacagggtctcactctgtcacccaggctgcagtgcaatggcgcgatctcagctcactgcaacctccacctccgggttcaagcgattcttgtgcctcggcctccctagtagctgggattacaggcgcacaccaccacacacagctaattttttttttttttttttttttttttttttagacggagccttgctctgttgccagactggagtgcagtggcacgatctcggctcactgcaacctctgcctcccgggttcaagccattctgcctcagcctcccaagtagctgggagtacaggcgtctgccaccatgcctaatttttttctatttttaggagagaccggttttcaccacgttggccaggatggtctcgatatcctgatctcgtgatccgcctgcctctgcctcccaaagtgctgggattacaggtgtgacccactgcgcacagccccagctaattttcatatttttagtagagacagggttttgccatgttgcccaggctggtcttgaactcctaacctcgggtgatccacccaccttggcctcccaaagtgttaggattacaggcatgagccactgcgcccggctgagtgtactagtagttaagagaataaactagatctagaatcagagctggattcaattcctgtccttcacatttactagctgtgcaaccttgggcacataacttaatgtctttgagccttagttttttcatctgtaaaacagggataataacagcaccccatagagttgtgacgaggattgagataatctaagtaaagcacagtccctaggacatagtaaatgattcatatatccgaactactgttataattattccttcttactctcctcttctagcatttcttccaattattacagtccttcaagattccatttcttaacagtctccaatcccatctattctctgcctttactatatgttgaccattccaaagttcttatctctagctcagacatctactacagcactgtgatgctttatgcaactaactgtttacatatctgtcccctgctactagattgtgagctccttgagggaaaggaacatgatttatttgtccttttcccccagcacctagagtagtgcttggtgcatgatagtaggccttcaataaattttttctaaatgaatgaaatctttctggacaaggttaccttaatcccatgccagctgtcctcatcctctaaaccgttcataggcagcagtaaatgtgctcagacagttctgattatggactctcctaacacattctaattctcaaacaaatggttttgttgtcattgttttttctggctccaaatatacccactgtatcagtcagggtcttggaagaaatagatgacacactcaaattgggtaatatgatgacagtgtaataaacggcaaacagtatttacaaagatgagggcaagatttgggaaaaccatcaaggaacagtgcaagtgcctctgaggctaacaacaacaaggtgctggcactagccctaggcatcaaggggtaagggagggagtggttcccagatcaccagagagtagctgtaagacagggctgccaggaaggagtcatggcctttctttggtggaggggtgcagccaacctatgggcaggtggcaatgagagatccagggggatagacagctcaatttcatgctcttcccattccagtcttgagtccctaggagtaaagtcagagcctttcatgtggctggggaggaattatggagattgggtatactggatgtcatccatttgtcccacccagacctattctccatccttctccatcttgtcctatgcttagcaaggctgattcatatggctggcatccaagcattctcctgggctttggtttctgcttgggttccaacagtaggaggatattatggattgaattctattcctctcctctccctcaaattcacatgttaaagtccttttttttttttttttggccgggcccggtggcacacacctgaaatcccagctacttgggaggctgaggcacaagaatgacttgaaaccgggaggcagaggttgcagtgagccaagaccacaccacaaaaaaagataaaagtttttttgtttttttttttttttttgagacagggtcttcactctgtcgcccaggctggaatgcagtggtgtggtcacggctcactgcagcctcaaactcctggtctcaagcgatcctcccacctcagcctcccaagtagctgggactactggaattacaggtgtgcaccactagcttggctaatgttttctgtattattattatttttttttgagatggaatcttgctctgtcgcccaggctggagtgcagtggcgcgatctcggcctactgcaagctccacctcccgagttcacgccattctcctgcctcagcctcccgagtagctgagactacaggcgcccgccaccatgcccggcgaattttttttatatttttcgcaggacagggtttcaccgcgttagccaggatggtctcgatctcctgacctagtgatccgcccgcctcagcctcccaaagtgctgggattacaggtgtgagccaccgcgcaggcctgttttctgtattttttttagagacaaggtgatactatgttgcccagactggtcccaaactcatgagctcaagcaatcctctggccttggccttccaaagtgctgggattacaagtgtaagccaccacacccagccagatgttgaagtcttaactcccagtacttcaaatacgaccttattaggaaatagggtcattgcagatataattagttaagatgaggtcagggccctagttcaatatgattggtattcttataaaaagagaaaattggacacacatacacacagaaagaaagccaagtgaagatgaaggcagagaacagggcgattcttctataagccaaggaatgacaaagattgccggcaaaccaccaccagaagccaggagagaggcatggaacagattcttcctcacggttctcacacaactctcatgacaccttgatctggaacttctaacctccagaattgtgagacaaccaatttctgtcatttaagccagtttgtggtactttgttacagtaactctagcaaacgaatatagaggatatcaggggatgggctacacaagtcacctatacttgccggcttcccgttctccctatttcattctttccgcaactcctccaaaatggatctcaagcacccactttcctgatcctgctctctccaaagtcatcggtaatttgattttcaatggccaaatctgaccctttctgtcatcattccacttgactacatatattagggtatctcccacttcaagatccatgtctggataatttccattgccttccttcattcatttattattattattattttgagacaaagtctccctctgtcacccaggctagagtgcagtggcgcgacctcgctcactacaacctgcgcctcccaggttcaagcgattcccctgcctcagcctcccaggtagctgggattacaggtgtgcaccaccacacctggctaattttgtacttctagtagagacagggtttcgccacattggcccgactagtcttgaactactgacttcaagtgatctgcccgccttggcctcccaaagtgctgggattacaggagtgaaccatgacaacctgcccaaatcctttatttttaaatgtacaaattccctgaggctataccctttatccttctctatagctaccaccagaagttgcaaattattgccatatcccccccctcagatgttttatttggtccttccctacacagaaaccccacaggtaccacaatgcctagcagatgaagtccaaagtctttagcttaacatttaagaccctgaccaacttgacatgagacaaccttttctatgttttctgggaattccccacctctaacctaagcatatccaattccttattttccaaggtaattggaaatagagaatgcaaaggcttcaagtcaaagataataacattatctgtaagcatcggagtggactttaagctaatgactgaaaatgatttttccagcctctttctgggacagtatagcgtattgtttagattgcagggattagtcagatagtttgaatcctgggctcccctacttattattggctgcatgcctttgggcaagtttctaatctttctgacccagtttcttttttctgtaaagggaagatggggtatctatctgccttatgggattaaggattgaactcgataatgtatgtaaactttttttttttttttcagacagagtatcgctctgttgcccaggctggagtgcagtggctcgatctcggctcactgcaagctccgcctcccgggttcacgccattctcctgcctcagcctctcgagtagctggaactacaggcgcccgccaccaagcccggctaattttttgtatttttagtaaagacggggtttcaccgtgttagccaggatggtctcgatcttctgacttcgtgatctgcccgcctcggcctcccaaagtgctgggattacaagcgtgagccaccgcgcatggcctgtaaattgttttaacacagtagttagatggtccataaatggtaccattattacttttatgattgctgctccacctctgagcacattcatacaattcactcaagtcattattagagcactagattgagtgcgagtcagacctggattcccacaaacttctttgtatgacctcgggcacatcccttccctgggcctccgtttctccatctgtaaaatatggatttgttgtcggggtggggaggctgcaccacgcacaggttagactaatggatctctaaggtcctcacatctttaaagccccaaggggataagccacagtgcctcctgtagggcagtctaagcttatcttccagataggcaggtttgaataccgatcctttttcttgaccttaaggaattcattcacccttttcaacctcattttccctgtttgtaaaacaacagcaaacgagacaaacacacgttacttcctttctagcagggttcctacccggcgccaagcaaaagtggaatgtaccctaagtagctctggccttcttcctgctcccaagcttcccaattccgtcccctgccccgctgccgcccgcggctctccttccccttctaggaacggctcaagcgccttgggcactccatcgggttctgcaccgagttctgcatcataaatacgactctcgtgtaggatttaagtgtgaacttctgcaggttctcggaccctgaagcacccggggccagacattccgagctcgcggcggtggaaggcacgcaaaagggcgaaccgagacgactccaggacgctgaggcagcgcaggccccacccggccccgccctgccccgccctgtcccggccggctttccagtactagtcctctggcgccggctcccagcccctctcgtacccttcaaatcgcgctccgccgctagactctcgtgatagctgagactttccccggaaggcccgcccccttcgccggagaggccaatgggctagggcaacggttgcgacggttggattttgaaggagccaataggcgctcggagcggagagtttaagaggcgtaagccaggcgtgttaaagccggtcggaactgctccggagggcacggtgagaggtggtggggctgagccgaggtggggccgtggccagggggagggggtgctaggccggaaggggctgcagccgagggtggccctgattttgtggccggccaggagcgaaggggtccctttctgtcccctgagcaccgtcgcctcctttcctccagggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggtcagtgaggtgccaaaggaactgagtgagagcagccttcatactttctccctggggagcctggtcagactgtcttctctttctccgccccaggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggtatgtgtcccagaggggcttaaggcacgggacctgactgttctttggataataccatcttgctccttcactaccctttatgccaggaacatcagaaagcctgggctttgaacctgaacggttttgatgtagaggaagccaagatccttcggctcagtggaaaaccacaaaatgcgccagagggtaagacccgaagttcctggttcctggagggaggtgtcagttcatctccagggctgagcacagatatctgtctcctcttcctatctaagattgagggcaagggaggtgttgattttcccagcgtctagactcactccgttgccacaggttatcagaacagactgaaagtactctacagccaaaaggccactcctggctccagccggaagacctgccgttacattccttccctgccagaccgtatcctggatgcgcctgaaatccgaaatgactattgtaagtgcatccttatcctcgcctcatgcatggagaaagagggcctgggaccacacaaacaaggaagctcatgctcttctctccacctctgacagacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcaggtgagacgtgtccagtgctgtcattctcaccagtcccaatgggcttgcacagctggaggatattaatgccaagtcccaatctctgatcctagtgggcttctctctctagctatgggatgtgcagcagcagaaacggcttcgaaatatgaccagtcactctgcccgagtgggctccctaagctggaacagctatatcctgtccaggtcagtggtttttgttggtctatggtagtctgatatttgcccaccctccccttgactgtacacccctgaactgaaccagctctggcttgcttgcatttggtgctgccacagaacctgattcccttctttcctcctccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggtgagtagggttgggctgaagcctctgcagaccctcacctataatctggggactgttaaggggagaagggatggtaggattggactgggttaatctgtgacccctagagctccttgtctggctctagtacctgctgaccccacctttattccatctaggccgtagcatggtgtccctggcagtccaatgtcctggcaacaggagggggcaccagtgatcgacacattcgcatctggaatgtgtgctctggggcctgtctgagtgccgtggatgcccattcccaggtaatcttttgcctgttcctgcctctcccacatgcattcttaccgggcaactacattcactccaatggcttcaccaactctatgccctggtgattcccaaacttctaactcagctctcactcatgagcttcatttccaacagtctgtggctatctccaatcctatgtcctataggcaccaccaccttgatctgtcccaaattaaccttgtcacttccccttgcctccctgaaatgtgttccttcctgtctcacattgctttggaatggcagaacctgctcagaaatctgagaaacctcctagaatttttcatcctcctcaccaggatctatcagttttacctcaaaatatcattgacatctgtcccctcccctcagcctcatccttccaagtggaggcccactacaatggcttcctcactggtgtcaagcattctttgttatctcctgcaatgcatcctccatgctgtggtctgttatactgtactgtccttaaacctgtgatggcttcccatcacttatggcatataatccaaatccattagaaagatacttgaggctctctccttccactccccccacattcagccttcactgtagatatggactctagagccagatggcccaagttaaaattctggctctgtcatctactaaacttgaatgtgacctttggcaacctattgaacttccttctgattgattcctcatctatccaatggataatacagatgctccctgatttaagtcccagtaaacccactgtaaaggtaaaaaatggttacatcagcgagtgtctataatttgcctctcaaggaacttttgtatggactatgatcattcaactctgagtctggagcatgtggcagggtgcctaacactagaatgggctcagttctgatttaagtagccttggctatatgtcatgcccacaccagctcctctccacaggtgtgctccatcctctggtctccccattacaaggagctcatctcaggccatggctttgcacagaaccagctagttatttggaagtacccaaccatggccaaggtggctgaactcaaaggtaagtggctaggtgaaaagccggacataaaaggccacataatgtatgactgaaatgtccagaataagcaaatccagagaaaaaacacattaatggttgccaggggctgagagagggtaatgggaaatgttgaaaatgtcttagaattagttttaacagttgtacaattttgtgaatatactaaaaatcactaaactgtacactttaaaaggatgcattttatggtgtgtgaattatatctcagtaacaccattgaaaaaaaagggaggaggccaggcacggtggctcacgcctgtaatcccagcactttgggaggctgaggcgggcagatcatgaggtcaggagatagagacaatcctggctaacatggtgaagccctgtctctactaaaaaacacaaaaaattagccaggcgtggtggcaagcacctgtagtcccagctactcgggaggctgaggcaggaaaatggcatgaacccaggaggcggagcttgcagtgagccaagattgcgccactgcactccagcctgggtgacagagcaagtctcaaaaaaaacaaaaaggtaggtgggtggcccagtgcctcctttatggctatggctgcatcagcattcgtatgtactgttctcatttgctccaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaatctgtttcagctaatgcctttcttctttcatgacctatgtcccagcagccttcctaggggctctactctactgggatcagagagctagatatgtcctgtgggagcctggaccatccatccctcttgtttgtggacagggctaagcgtgttgtgttcccccacctcctctgttcacatacgtatacacacagcctccgtggtttcctctgtcacttttaattaagacacaagttgagtaagcagcctccacaggctgtattcccaggcccccgcccaccctgacctttggcccagaagctactgcttcagtgtgtggggtggaggagtgagactgggtccacagtgacattattgctgacctcttctgtgtgaggaaaaaggccacgagaccctttgtggggccagccctgagtgctcctctcccaagttttaaggcagggagggggaaataactgtacagcccttttagcccccagctctggagtggcagacagcaatgaggccacatccctggagctgcccgggggaagtgggtgaggaaccaaagccgtggtccctgtagagcagctgtggggaggggagggccagtcccctgctcagtcctgaccacataagccttggtcacaggtgtaggtggagagggcactgacggacactgccctaaggtgcagtcctgaggcacttaggtgggcgcctatctaggccatgcttctcagttggccttgaccttggcaatacctggagctccattttgctgaagtgcacggggcagccgcttgcccttggtataagagtgataccagaagttggagaacagcatgaagaagatggtgccatacatccagatgaggtgaataatgactgggtactggtagttacagctggacataaagtagtactgggagatgtgcagtgagaccaggacaaactggatctaggatagagaaagaccagggtcagagggaatagtgagaggactagaggggaagagggggtagagaaagagacaaacgttgagtagggagagatggggtcaaaggtgagacagactggataaaggcaggatccaggctaggaatgtggggggatggttataggtaagtcaggccaagcccctcaccagctgaatggctgtcatgtgctttttccaccaaaggtagggttgtgccacagggccaaaggcagataatccgtagtacaggtacattatgacatgcacggaagagtttatcatggcatggaaagagcccattcctcctgt

SEQ ID NO: 1146 - DNA, 53691 bp, Homo sapiens
ctggcctcaagtgatctcctgcctcggtctctcaaaatgctgggattacaggtgtgagtcactgtgcctggtcatccaattgtctccattgaaaaaggtgctgttaggaatactggaaaatctgccgcagatgttctctattcactgttctcacagagcagtgaattcactgctctgtcaatgctgttccttttcctggacctgattgccaaaacctgacctcttctctttgagaaaggagacccaaactcagtgatttaatagattataaatcaatttggggctacagaactgtgaattattcatttctaacacagacttggcatataacaaactagctactgagagtcttctgccatgatttattgatagagccctgctaagatagataattttgaaatatttcccttgttttcatggtcactgatgtttcaaaagatttgggactaagtagggcaaaaggacactgaggttttccaggcattgagaaagggctacttttccccaggccacagcaaggaagaggaaaggagaggagaggcaagcagtagagcaaacaaacagtgaagctttctgattttttttttttccattcattccagttcatcaggaattgtaggatacctgccaaatatccagcagcaccagcaccatgggaagtacaaaagaagcactcagtaaaatgggctctcgcatgccaatgcgtacagggacctggcgggtaagaccaacgaaccagtgggtaggaacaagaagcatggaacactctaggtctcttatttacctatgtttaaaatatttaaacttttctatttactgtaaggaaataatgtaagcatgatgatagatagcaattgattctacttcgttatcaagaacacagtggggagtggtgggtactacgatgtcctgcagaaccaggaccccatctaaggtgggtgggactggcatcctttattaggttctggctatagtcaggataggcataccagatcttcaatttttcaagagaagccagacatcaatatttttatttttatgagatctttatatttccaattgttggcatctaatgaaaatatttagacattaccatagcagccataattctgtggtcaaacagaattggcataattccctgaagaaatggacactgaccttatgtaagttgccatctgcctgaatgtataagacatacatactaacttgagtacaaaatgaaaatatatctggcatgtacttaatatatgttcaacctcttcctctttttcccattataaaacagtatttgtgtgatagaaaacaaaagtcagcaataggcatttcatatctttcctacttctttctaagaagggtcaatttccttcctccagttggggaagaagagagaccaagaaaatcagcatcaagcattcgttttgccaacaaggttgatgggtaaggaggtcagtagagggctacatttctctactcaaagatggactcacagacaaacagtctggagaggaagagaaagactggggcaaaggggagaaaaagcagaagatagagattcagggcaggtgctgatgggctaggaactttaggaaaagagagaggaaagtttaaagggggggtccttaaaatattttgccatgtgatatatacatgacactctgccctgtatacccaagacatttaaaataaaatccacagtgctctttaatgcatccatagtcatatttgcatttgctttaaggtgagaatgagacagccaggtgggctacctgagactgtgccccagtgagtggtcatggctaaggaggataaaggagtgctgactgcacttaaccaactgaaaaccaaggaacccaaggtctgacaacagaataagacatctgaccataaagagattccatgcaaaatcctggtcctagagctggatattgtagcaagaagagaaagctcattgagaggcgagggcggagcatgggcagaggtgagggtgtgcttggtgtatcctagcctggcaggtatatggagccactgtggtgagcagaggttttatgttcagaatatggctccttttcatgttagaagggggatcctctgatatcctcaactgtagcttagctttcagttctggtcaaatatataagcttgcttctccaccctcagtgtgtcaaagccctgcagggaagacccacaacatcatgttcttagagaccagactgtcagacatagcagcaccaggttttgaattttagaaataatttttatgtgtgtgatgggcatttgtagttacactggctatgcatgggctttttcaggcctgtggaacgtgggtccaagacactgaattcaggagctagctagtactgccgaggcagtttcatgtgtgagctggacacacagcaaactgtcagttgaggttgatctgaaggagatttgttcttttatttttctgagacagtcttgctctgttgcctagactgcagtgcaatggcacaatctaggctcactgcaacctccgcctcccaggttcaagtgattctcctgactcagcctcccaagtaactaggattacaggcgtgcaccaccacatccaaaaaatacaatttttttgtagagaaagggttttgccacattgtccaggctcgtctcgaactcctggcctcaaatgatccacctgcctcagcctctcaaagtgctgggattacaagtgtgagtcactgtgcctggccgatggagatatgttctaacgaagggtgggccacttagctcagtgtgttcgcaagagtaagagagaacagaggtggattagaggggttggcaagcctggttccagctctggcttccacagaggctatagagcccttggcagggcaattaacctccagggacctcagtgtaaaatgagaacatttctatattagctctttgagaaatctctatactattttccatagtgactgtgagaaatctctatgctattttccatagtgactgtactaatgaatatacctatcaacagtgtgtgaattctgttttttctgagtcctcaccaacattttttttttttagtcttttaaataatagttaccgtaactggggtaagatgatatctcattgtggttttgatttgcatttccctgatgataagtgatgttgaacactttttcttttatttttgtggtactttgttatgtcagaacattttttcatatactttacttgttggccattggtatgttttttttttttttttgagaaatatctatgtatgattcagaaatctcactactggtatttatccaaaagaaaggaaatcaatatatcaaagggatacctgcatgctcatgtttattgcagctgtattcacaattgcaaagatatggactcaacctaagtgttcatcactggatgaatggataaagaaaatgtggtatatacacacaatggaatattattcatccatataaaagaataaaatcctgtcatttgcagcaacatggatggcactggaggttattatgctaagtgaaataaaccagggacagaaagacaaatattgcatgttcttactcatatgtgggagctaaaagagttgatttcatgcagctagaaaataggatgatagataccagaggctagactctgggaagggtgtgtgtgtttgtgtgtgtgtgtggcgggtggtggtatagaggttggttaatgggtacaaatatacagttggatagaaggtgtaacttctaatgtttaatagcaaagtagagtgactatagtttatcaacaacgtgtagtgtatttcaaaatcagctacaatagaagatttgaaatgttctcagcatatagaaatgataaatactagaggtgatgcatatcttgaatatcctgacttgatcattacacattctatgcatgtaacaaactatcacatgtaccatgtactgtgtaaatatgttcaaatatttgtgaaccaaaaaatttttaatgaaaacattctggttctgcacttgaggattaaataagacacaaatctgaaagttctggaaaatgtaacagtaatagctaatgtttaccagtgctaattatgagccaggcatctcatttattcctcataacatccttgtgatgtaggtatacttatcccaatttttacagatgtccaaactgaggtacagagaggttatacagctcatccagggtcacagctagatctggacttaacttcctttggtataatacaaaaatatatttggtctttgtcccaggttcctgacccagagctcctaaaacccttggaatttcccgagtaataggtatgtcttttgttattcataaggaggagattcttttgatcacccctgagtttatcctaatgaagtgacttagggtatggcccctagacagcttaggatggggctattcactagaaataacaagtcattagaggattggaactttcagctctgtccacagacctccaggatgtgtttgcattgggtggtacggggatgttggggagcactggagattgagctccataaaaactcttgaaccaggatacctggagagcttccatgttggtgaacagatcaaggtgccaggtaatggtgtgcctctaaagaagctctgcacaccacacacacacacacacacacacacacacacacacaccttgccctgtgtagctattccttttggctgttcctgagttgtagactctagaataaactggcaaacattgaattatacataattcatatgtagatatatttatatatttaaatatgtatgtatttatttgctaaacaatcgattctgggcagtgggtgataatagagaaacactgaccgagcttacttagggtctctgtatcccgagggaagggtcagacccttccgcttgaacattgagctgttagattagattcaaatctgaaataaccggcacagcaactcccattctgattcctctgaagggaacgaaaaagtcaggaaaggtaaagatcatgcaaccagcagcagagagaacatgcctgctctgaccccgcccagcctggctcaactacaggatcgtccgactggtttctgccacaggcatgtgctgggaaatatgagggaggctgcccagaaggtggtggctttgtagttgtgtcttgtttaaactcttttattgtagagcatccttctttccaggccattcttcacctgagggaaagattagggcagcttcacgatgctaggcagtggtatatttttttagtgatctgtataaaccatttttttttcaaagctgacagcaagaacatctggagtcttactctattttctctcagggttcaatctactcaacattgttgagtttccctatctttcttgtgaggtaacaagggtctgtatattttaatatatcccactgcaagagtaaaatggccccaggttctaggatcgggcagcctaggttgcaatcctagctctgaaaccactagctcagcaaccttgggtaggtttcttaacctgtgtaaatctcagtttcttcacagtacacagtaatatgttacatagagatgagaggattaaacaaaagaatgcagatgtcccctatgtgtaatgcagagcaattactagatattagctgtgtgctagttactctttatagcattattaaaagtgcttgtcagccatgctacaagctgattaccaaaagaaaattttgcttattttctttgtatatttcatactgaaggagtaaaagctgtcacactttatttatttatttatttatttatttatttatttatttagtgacagggtttcactgagttgcccagactagagtgccctggcatgatcacagctcgttcagcctagacctcccaggctcaagcaaccctcctgcctcagccttctgggtagctaggaccacaggtgcatgccatcgtgcctgctaattattttattttttgtacagacaaggtttcactttgttgcctagcctcaactcctggcctcaagtgatcctctggcctcagcctcccaaagtgttgggattacaggtgtgagccactgtacctggacctcattacacacttaataaaataaatagattgcataatgccactggtcactcatcagccaccaaccttggcaattcacttctctgacagtctgtttccttcttttctagctgggccaatcactgctatctcccaagataccctggttgaaagatgtttgggaaaggtttcaagtactatctggagtaaaaggtgttactgttgggatacatgacaatgagcttctacggtcagatattcatttgagtttgaacttgggatacgtgttgagaaaaccagttctgctcaatttttaaatcctaggacactcggtaagcattcaaaatgttgatttatttctttgagaaaacatctagtaatcttgaaactctcttgtcttttttccctctccttctccagagtttgattttcttcccataaaatttcattatactgttggcagcaactattatttttgccttttgtacaaataatctttttagtttatattcaggcacagcagtatctgcgatgctatagtttacattacagttcactcttggtgttgtacattctttgggttttgacaaatgtataatgacatgtattacccattatagtatcatatgaaacagttcctctgccttaaaaatcctccgtgctcaacctattcatctttccctcaccccaaactcttggcaaccactaatctttttactgtatccataattttgccttttccagaatgtcatataattggaatcaagaaacagtatgtagccctttcagactggcttatttcacttagtaatatgcatttacagttcctccatgagtgttcatggcatcatggctcatttctttttaacacagaataatattccattgtctggatgtgccacacagtttgtttatttattcacctattgaaagacatcttggttgcttccaagtttgggaattataagtaaaattgctgtaaacatcggtgtgcaggtctttctgtggacatatattttcaactcacttgggtaagtactaaggaatacaattgctcgatgcgatggtaagggtatgtgttgttttgcagtgcatcaccaaactgccttccaaagtggctgtatcattcccccaccattttaaggcacagcctggccagccatgccaggatgtagcattgacttcttagataggtgaacatcccaattctttgtgcctatcttgagatatgctattatggacaatcacattccaaggcagcatagggcaaattcctatgtttcatgctcagtttaacaaatgtgtgttattagagggtgtgtctggatggaggtaacttatactgtgtccaactcacctattgctatgttggcgtgtgaaagttgagaagtgccacgatgtgtttgcacctgtaagacagggaaggcgtggctgtctcttcttcctgaaaaagcctcttggctttgacactgcccattggtgtctctttcccctttgctgttgctctcctgaggacatgttggtcattcctcctcattcactggggattcgcctcctgactcatagttttccttttcttaccccaccataatatccacccccgacttctcagttcctttaccttctcatctctaacaacatttttctcaccttccaccagcaacccactacccataatcaccctcagagccttcacagcaacagaatctacatgcctcagacatctcagtttcaaacaactcaccctttcagcaccacaacttacattttctgattcactcaccacaattccttgaagtcacagggcctgcaatctcttgacttttcctttgtctcacagcccatcagcccctctgttttctcatcacccctcattaatgtaaaccccaggatccatcttctcaccaggcccctgaactttcttctgttatttgctcctacccagcagaccccaatcctgactgaaattcactctgccttctccatgcctgtcctgagtagctccaagttgctgattaacaaccactggccaggctgagtggcatcatttgaagccatcatctcaagctgcagggggacattcatgctcctgacacgcctgttatactttactagttaatgtttccactttctgaagtgctccttcatatcttttttttgtcttcaaatctcctacactgttcccctgaatcctggctaatgggtagcctctatctccctgagaatacagaagccagacaagagttctcttctttcctcacaccagtttagaagtgcatctgaatttgcatctggcttctgattcctttctactacaagaaagaaagcctccctctcctaacaaataatatttcttccttgggttttggatgagctcactttaaggagttctggattagctcacttcaaggatgagctcacttcacctctcccttccctctcccttcccttcaacatccactcatgcctctgcatcatcagcccctccgtctccactgcatccttccttctttttttcccccctttaaaggagaggggcaatataacttacgtaaaataacatatgtaaaaataacaatccagaaattttttggtgtttgtttctcaatacccaccctcaaatgtaaccacttttctgatttctattagaaaatagattaattttccctgattttggacttcctataactggaataatatggtatatattttttggtatctggcttcttttgttcaatacaacatatttgtgattaatccatgctgttgtgtaggtcaatcatctttattgctgagtagtattccattgcaaggtcataccataatttgcttatccattcttctgttggtggaaattgcaggtgttaccagatttgagctcctataaacaaggctgctctggacattcttgtacaggtcttttggtggaaatatactttccttttcatttggaacttctggtcatagaataggtgtatatttaactttattaggagctaacagacagctcttcaaagtggctataccattttgcattctcataaaagcagtgtatgagggttctggttgcttaacttcctccacaaatataggataatcagtcattttgattttagtgattctaatgggtgtgaaaagtgctttggggtcataagattagcccccattagaagttatctattattattatcaccagatcacgactcaaacatttttaataaagggcacctgagttccttctttattgtaatcatgcctcaatcttcttcttgtcctaacccctccaaaaaccacatcataacccccaatattggccatacatctatttaagtattatgtgtaaatatatgttggtaaatatgttaaagtattggctttataaagaggacccagtagagacatcatcaatgccccccacaatacccagcgagtgcttggaaaatggctaggttcgtatttttctgcagctccctagaatataacagtctaccctactttgttctgggctctgtccccacatcttaggagttgcattctctttcgggctgcacagccctatgggacgtcaaaccttgcctttcttgacaactgatgggaggtccctaccatcagcaccttctccagtctatcaacctgggttggacgtccctacctagacacagcttctcttggggacgctgtggaggaaatcggggtctcgggtgtggctatatactcagggacagaagctagacgcgctccgcagcctgaggtgggccaggcacctgctgggctcggggtggcagagacagctgtgcggtcccagctgttcctgagcgcaccgctgagggacgcactcccttctacaacggctgcaccccaagtcctcctcccattcctatatttttctccatcccctgcccacgcttaattagttatctcctccagacccctccccactggcctcctcccttgcacacgcgagctgggcagggaagagagcgcccggctcagtactgcgcgcgccctgcggctgtccggggccgcgcggtggccaaagcacagcgcgggagagtctgcgatgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtgagcaccattcctgatgctgggtgctggcatcgggcccttccttgtcttctgatcttgtccctgaccccgggatatgcgctgccttttccctcctcagcccgggctcccctttcccttcactctaacctattccttaagtttgactctgcactcaaaagttagggtgagttttgcccctccgaagtgcggctgcccaggacgcgcttggcacagagggaattgcggaaagttttactggcgcgctttttggccgggcgccggcgctgtgggaacccacgctgctggatgccatcgctaccccgtcgcgctccaatgcgtgtctttccagaggtgcccacatcaggccacagaaatctcaccacctgtacttgacatcccacttccttccttgccaagcactgtagctttatgtagtagtcgcttagaaaatccttgctgaaaaaatgagttaatcaatggaagcatttcagtaggttttgtgtcaaaaacttatctccaggtcatctgaagacccaattccagttgacggagagtaaatgcagaaattgcagattctgcttggactgaactaaattgctttgaaatattgtggtcttttccgaagactgggaattcctgggattaactgtgaaaattaaagcaatgatttggctaaatcgtgttgtaatcctgaaaatatttttcctatttcaatccactctcatttcaatattcccctagtcaggtcttcaaagaaacaaaaccagagtggggggcagtatctgaactctagccctcacaggtcatggggcatgatgaccacttcagcttaggaaggagctcagtcacctgtttgttaattttgcagtttcttcaagttgggccttgggagcaaattcaaatattagagtgaattaaaatggaaagatagcagcagtaaaacaaccatatagcttaaaaatgcttttctaaggagtcagaccatttttagcaaatagtaatatgtatttggtgtggcctgtgactctagaaattttttttttttgagatggagtctctcactctgtcacccaggctggagtgcagtggcatggtctaggctcactgcaacctctgcctcccaggttcaagggattctcttgcctcagcctcccgagtagctgggattacaggcgctcgccactacacccaggtaattttttatatttttggtagacacagtatttcaccatgttggccaggctggtctcgaactcctgacctcaagtgatccacccgcctcggcctcccaaagtgctggaattacaggcatgagccactgcgcccggccaactctaggatttttagctaaaaaaacaaacaagaaactcctccaactgtgagtatccagccatcatatgggaaacataacattattaagaagaagtaaactttctaactcacttcagtagtggtggctgttttctggaatacattgttcaaaatattgtgtcctttgaagaaaagcttatatattagggaaaaacaggttatgattagaaaactgcatttaatatttttgacacattgtcccttgcagccatcataaacattcatttccagcacagggaagcaaaagggagacaactcctggctctatgggggagaaatgggtcctcctggttctgacattggccccttctgtccctgacttattgagtatttagagcaggtctgtcaggccatggctccctgctcagtaatttggattgcccaccatgagaaaggtggttgagggaagtaggagttgcttccttttgctggaaggagaaaagcacccctcccctcctgcatcctacagagggctggccttttctgtgatcctggcagggtctgcagaaacctaaccagtttaagagcatcactggggagggtcatgagcatgttaaattgctggcatatcctctgttctatctttcctacctcctgatgtgtccgctacagcccagcacccgaacaaaaaaaaataataataacactatatctaaatgacatcaattcctgccactgctgcagtcttgcaatttaaccagttcttatgtgacctctggctttattggtgacagtcacaaacaattgtagtactgacttgaactaaatgatctcagcagagtgagatttcaaaaggcgcttaaaacctacagctctttgaatagttagcacacattctactcttaatcaggccttgtcttactgaagagtttggatttaatttaagaaacgcttcttcagacctttctgtacttaagtctggctccttaaatcattggtattaaaaaattaagtctgtaacaatgagaatacatatatttccaataaccaagatacatagcccatattgaggtcacagcatgtttcccaggagacaccagtatcctttacttgcctatcacaaacccagttcctctatggagcagatctgtatcattcctaacagtgccgctcctgatggcagggtgagtggttagattaattgtcttttttttttcagggatatcctatctgtagtgtctgttgctgcatgtggtgggttgacttcagagatagcaccagagaaaggcagacagggaggagtggaggcaaggtgggaggtagggtcagggcaccgacccaacttaaaaggtaaggccaagtgtgttcactctttgctacattctcagagtcttgcacagcccatggcactgggttggcacctcacgcctgtcagattgtgcttcccagggacttgccacacttttgactctactgagagccgttgagaactttccctcctgggctcaccactgctgccctgacccttgagctacacctcgctaatatttatctcttgcatttttgagctcttcctttctctcttctggaaacttcctccatgttacacacacacacgatacacaaagtctcctgttttaaaagaacaaaagactcttttcttgacttcatgtcctcctaacttcatcactacctctctccctcccttttcagccagacattttaatgtagttgtggacatctactggttctaccccattgcttcccgtccttcctcagtcctctgggcgccattctctggaaatgttcctctgtgctgtgtgtgacactgagggccactccctctgtgggacctttcattccctcggctaacctggtgctagtttttggatctcctttttctcttcatctcccggatacctgtgccctgaaagtcatctttggttcctcctactctttcattccacatgtcctaatgattttaccttccactatttctcaatttctccctttcctgcctccttattcttactgccccacttcatgccttcatcatctcttgagcaaacactatccatagtgcttgagagcttttcctgctccctcccccagccactgttaccactgccaagagtttccctgtcttcagtggctgccctccatctccagaacagtgtccaactccagagcacagctcccacggccatttgcggctggcctagcccacctaacttacagcctcattgccctcctctcaccagtgtcacagtgagctgctgctacttcccaaagggtctgcactccctgatgtactttctctacctcttctgcccagtcaacagctgctcctccttcaactccttccccaactcccctgaaggattatcaatgttgattattaataccatgaaggggatagtaagtgtctcccttgttgggcttctaagatacctgtgccctccccagtacagcatccccctcactgtactattgttctttgtctctccccgctggaccgtgtacctgctgagagcagacactttcattcagtttctgtccacagagccagacacatagtaagaacagaacacatctctgattaaattggaaatggataagacaccaggtagtgggggaaaattaattgattttgctccatgagctgggatagacctcagttacagtactcagcactgcataagtaatcaatacaggttttcatgaaactgaactgctttgagaacagcccaaagtatatctcatgttaagctgactattggcaccttctgcatgaaggcatgcttgttctgtgattctcctgtgtgagtaaagttgctcagcagtttccagccatgccatggttgtaccctactgattcctcttggggagtttgcccctgatatgctttggctgtgtccctacccatgtctcatcttgaattcccacatgttgtgggagggacctggtgggaggtaattgaatcatgagagcaagtctttcccatgctgttctcacaatagtgaataagtctcatgagatctgatggaaaaagagaaactcccctgcacaagctctctctctttgcctgctgccagccacataagacatgacttgctcttccttgccttccaccatgattgggaggcttccccagccatgtagaactgtaagcccaatgaaacctttcttttgtaagttgtacagccttgggtatgtcttttgttgttgttgttttttgtgagacagagtttcactcttgttgcccaggctggagtgcaatggcatgatctcggcttactgcaacctctcctgcctcagcctcctgagtagctgggattacaggcatgagccaccacacctggctaattttttttttttctgagacagagtcttgctgtcgcccaggctggagtgcagtagcgcaatctcggctcactgcaagctccgccccctggggttcatgccattctcttgcctcagcctcccgagtagctgggactacaggcgaccgccacctcgcccggctaattttttgtatttttagtagagacagggtttcaccgtgttagccaggatggtctcgatctcctgacctcgtgatccgcccgccttggcctcccaaagtgctgggattacaggcgtgagccaccgcgcccggcctaattttgtattttttagtagagatggtgtttctccatgttggtcaggctggtctcaaactcctgacctcaggtgatccacccacctcagcctcccaaagtgctgggatgacaggtgtgagccactgtgcccggccttgggtatgtctttatcagcagcgtgaaaacagactaatacagcccctttcttggtctggcccgaggtggccacttttaagctgcctgtaatatgctggccatataagagagctgagagaaccatgtcctcactgtaacacccaagtactctccactatcagagaggaagtcataacaacaccagttattcctggctccataggcacagccaccttaattttccaagtagcagtcagaagctgtggtctgacaatggatttttgtgctgcaaatgggttaaagaggctgtctgggaggtttagtgagtgcacgaattggcatttctggggtacgttgatgattggtaaagcagaaatatatgaactatttgatgttaagattgcctaggaaaacatggaggatttgcttgctgaacacacagatctttgtccaaggtcactctgtctatgctggcaaagctgcccctcctccaggcccccagtgatgctaagaattcacaccatctcctatccagaaccagtaactgcctgggaggttcctgatgggaatattctgcctatgcaggtgctttgcttccccggttagattagaaaacagtctgcactgtggcccctgttccttgcctcctctcttccaacttgttgactgagacagcaaatgatgcttaataagcagcatggttctgaacaaaggctctggaaggcctagagtgaaatgcttaataggcccacagcccctaccctccaagttatagaatgaagtggagcccactccatcaaggcttctatcctaccaccgaccactcattgagatgtcacttggcatcaggtgtcttttgacttgctcagcctgcaatgtttagagtgccattatcagcccaagaccaaactgggtaaccttggactccttcctgaatgtttcttaagctgtccaactttgcatttcagctgtgaataccttattgcctcttcactgagcaaaaatgaacagtttttaaatcccataattatgtctttagctgaataatcaggaaagctaataatcctctttaattcctcccatgtaactttcagtagctcaagggtataaagactttaatgtttgcctgtctttatctccagaaagctggattctgcattcggatatgatataccacaaaattcagagaatactgaaagctcctactggctctttcaatttaaaatacttactgctggaggagtagagatagagaattgggaagtaaagccccagttcttagggagtttgccatctagaaggaatgtcctactttcttcatcttcatgtccttactacttctcacatcttatctcacagggatcccagtccaaccttatgagcctctttcttgatctgtcagtacagctaataatataaaacagtaataacaaataatagctaatattactagtgcttgttatatgccagattcaagtctctttcctttaagagagaaagaaaaggcaaaaaaagccctccactgtcccctatcaaagggatattccttcctaagcgccactctctatctccttcttttgaaggcaacactgatagagcaatctccagggcaaaactggatccccaagctctcaacagaatttgttcttgttaatgtcactactgccttcctaactaccaagtccaatgagcacttttctgtcctttctcacttttgtagatgaccaagaaactctctacaccctttctcttaattcccttgatatttcttttctttggttttctcctcttcttgttctttctcaatccttctgtgttatggctatgagcaattcacacaaactgggtgtctgtttctttatctataaaacagaaatcatgctgtcaaccttaaggaattcttgtgaaaaacaatggagtccatttatgtaaaactatactatcaacttcaccatgttatatcaatggttgttttgttgctattaagtgtaaagtaataaaatgttacctatcagaatttcaaaatgatctcttttgatggttattgaagaatattttgtaaagcatcttagttatgtttttaaatggatgcttatgttcttaaatatattttcttcttttaagtggttgaaatacccccatatatatctgtgtacactattgattagccagtttttgttttctaattaaatcaaagttagatttcaactcagctcttgtatgattcatccacacatcctaagattttcataaatatgtgactttggaagaaaaaaatatctgctctcaagagatttgggaatctaattacaagcttacaataaatgcattgttttagtgtttgtttgaaaatcaagttgtgaataaattatatggtcaattatttcaaatgcccatccccagaacataataagaatatctcacattaatttggtgattattgttatttctcatgacctttcccatacaacatcttatttgaggtaaacagccattctgggagttaggagttctgttgcaaaagtcttggtaattttgtgtagctccttggtgaattgtcgtgcctgaccaaccccatatcctgccattgtccccagtcccaagttgactcacaaattccccactgttcccaccaccttgttctggcctttcttccagctctcacctaattgaatggctactgttttcttttgtttccctaacagttccatgggcatctcaatggcaggggccatgtctttcatccatcactgcgtcttacttgaatgtggtaggcactcaataaatatattacacatttaaacagatggaagagtggaagaagacctcaaggcacagaaagtttaacactgttagaaaacatagatcatttgttgacttccccaacatatccctcttggcaccttgtttttatttgtttaatggtcttccctaagagaccataaactttataaggggaggtagcctgtccatctggcatagtcaaaggcagaacctagtatatactcagcaatatttgtcacataaatgacttgatgattctctctttctatcttgtcttttagctcaatgaccaaggagaatttatgtctaaccaaatttttcttctgagcatggagggtgagcacagaggaggggggcaagggttacagggagctttaccttccagaattctcctatctgacgaatattagatagctcagcactggctggctctttcctagattaccagatctccattaagaaatacattttccagaaagaaagagagaggaagagaagagggaggagactgtgatggttgtgtgtgtgaaaggatgcgctctgcgtatgaatcctgaaggggattccatgttagtaaacaaagccctcttgtcaaagcctctctccactaatacaccctatctgctggaggcagatggaaacgagtcacgccaggacccatgacataaatattcattatgcacacggtgactgcagtgctgtgtgcatactgagtgatttctcacctgtctggggaagaaatggatggagaactggatctccccttgactatcatccacataggacctggcttcttacagatggaagacaaaacacaaattttattcatctaatttggaattgtgccaagaaagcctggagacagtgggatgtctgggcagatgaatctatagcaggaagtggttgatttcagccttttaggaacagccagagtaataggggatagtaattgaatcactttccacatggagttgaatgtgttcttcttactatttacaagctgtttgccagcctctggggcattattaggggataagccacattaacacagcagaacttgactctgccttcacagggaaacagctggcagagctggcaccggctcccagcagctcttgactttctctgctcagcttgcaagtgccaagagcttgtgtgttgctgggccaggtgcccagcgggtcctatggagactcatcttcctgtgctggagagaagtgattctcttcacagaaccaaccctatgagtgtgcagggggaagtgatggcagagctctgaaagaaaagaaaggagctcatgtaggaatagtcaccaagaaaggaactcgggaactcgcccaaattcattcaaccataaagtggcaggactcagattatcccagatttctctgacttcagcacaaccctccagatttcaaaaggacacataaaattctcaggagacaagggttcctgattcagctgaagacaagcaatgtgagagagggaatccctcatgttcttggaaccaagtgaggtctgtgtagatgagtcagagatggagatccagcagtggagacagccagcgggctgagaattaaattaaaaggcacaaaacccctccacatcccaagcaggtccttgttgcacattttttgccttgctgtaccaaccagaaaggaaatgaggtcatttttaacccatgaagtaaataaatctgtgaatagtagagtaggtaggaatccagcagttcagttgagtcatgattctcctttgccatccaacttgctggacaatcttgagacagggaaactcactacctcacaagcgctctaattgtccagacaatctcctttctattcagttacatcctgtctccctggtttcctaacctagctgtggacacagtagtattatagttaggtcttgagaactcccaggactccagtagacttgtgtgggttctcagtggggttgaccccattcctctgaggtcaaaataggcccttcatgaaggcttcctgagggtctttcaagttcccatccccattcggaccatgctatggggaatcttctttgagatggggtgaatgtgggaaggctggaggcagtccttttcctacccttgtgggtgaataagtccaggtgtgccatctacttcacttgaagggctgactcaggtgaaatcccagctgggcggctctcagcctccctttttctgtaccccgtggaatccacacagagcctggcctctccaattgctgtgctttgggggctctttccacctgcctgaccctctagacccccaaagccaccacagcctctgtggcaatgggacagacacatggtggctgtggagtttccatgtctgtgtctttgctgacttgggagttcctcctgcacaccatcccagccgccctctgcattccgccaccctaaggctggaggcttcaccatgtggcaagagaccagaaaatttaaaataccatgcccagtgcacattgcatcactcagggaccctgctggagggagagtctgttatcttttgagcatacagtaggtattcaaaaagtacaacacttggtgaatgagaagattggcattagtgatggaactgctcacactatgagctttgtattgcccaaacgtttaggttcttggtgctctattcgtgagtcagtgttggttttagaacgcaaacacttgaggagcagagattgtgttcttttagagtaagccctgcctctgccctgggactccagcttagaacatgcctgaagcatattaattgatgggtgtatcatttcctgaggctctctctggttgaccaagcttggtgatgttggataaggctccattcaaaggataaatgcctagatagtccaggaaggccaccatggtgcaggcaaagcagggaggccccccagaggctgtgagcttaggagtgctgacagccctttctcaccccacagggctggggctctgtgccgctactgcaagtgtctgtcaacatggccacaaggctgggagtactggacccagacagggcacaaatgggaataccagaaacacatggttcccactctcaacacctttcttctagtccagctgcaaaatgcaattcacatttacaaaacccatgtaaagacacttagaaagtagcctgttaaccagtggggagaaaatgcaaaaggagacaaccagagagatgtgcgaggaggtgagggaatgtgagggagcgatgatagtgatgagaaatccacactcctgactttcagactctcctcctccgaaatctttgctggagcttaaatggtgcaaagcccgtgagcatctgtgcctatcatggaaacagttagcatgtgtcagcacctgttaaatccctgagcactttgtatcattaattcttacagctatactatgaggtaggtatcactgcccctagttcacaaatgaggaaaatggggctctgagagcctaaacagcttgcctcagtcatatagctagtgagtggcagaaatgcaatctgagtcttcagttctgtgcctctaagagccacttggtttccactcacattgccaaaagtaacttcgtggagggtaggatgttctacagaatctaagtcgtggggtctcgtgctgactgttgctctgtttgctgcttcaggtaatttgttcttggtgagtctggcattggctgacctggtggtggccttctacccctacccgctaatcctcgtggccatcttctatgacggctgggccctgggggaggagcactgcaaggccagcgcctttgtgatgggcctgagcgtcatcggctctgtcttcaatatcactgccatcgccattaaccgctactgctacatctgccacagcatggcctaccaccgaatctaccggcgctggcacacccctctgcacatctgcctcatctggctcctcaccgtggtggccttgctgcccaacttctttgtggggtccctggagtacgacccacgcatctattcctgcaccttcatccagaccgccagcacccagtacacggcggcagtggtggtcatccacttcctcctccctatcgctgtcgtgtccttctgctacctgcgcatctgggtgctggtgcttcaggcccgcaggaaagccaagccagagagcaggctgtgcctgaagcccagcgacttgcggagctttctaaccatgtttgtggtgtttgtgatctttgccatctgctgggctccacttaactgcatcggcctcgctgtggccatcaacccccaagaaatggctccccagatccctgaggggctatttgtcactagctacttactggcttatttcaacagctgcctgaatgccattgtctatgggctcttgaaccaaaacttccgcagggaatacaagaggatcctcttggccctttggaacccacggcactgcattcaagatgcttccaagggcagccacgcggaggggctgcagagcccagctccacccatcattggtgtgcagcaccaggcagatgctctctagcctggatctgaggcacaccagcagcatgacaaactcatgaaatggtgggagagagtctgctgcaagggtgagaccaggcagcctgctgggccacactgtcctgttggcatcacagccccaaggctgggggaacttcatgctgggacaagcagcccatcaacgccatgggttcaggctgatccaggagatgctcacaggccacaggacctggaaaacactcttggtggtgtcttggggatttggtgcacacaagaccaaggaaaggacagaatgaggaaaggcctggggcagaagagcccaactccttctcatagctgaccctcatcctcctgccttggcctcctggctgctttctccccttccccccagcgtggcaggatctcttcctgttagcaaggatgaaagagagaggtcagtaggactggaacttggtaactgcaagggcctcaggtggggcaggtgcagagggcaagcattccacactccgccattgaccttccctacacacacacaatcacaaccacacatgcatcacaccacagacacaccacactatgcacacatacactgtgtacacatacatatgttacacacacatagccaccacatcacaaacacactgcaccccccccccccacacacacacacacagtcacactgctccagcatctggagcacaaagtccgcttggcctccttttctggttccatcatgttcaggttgtgtgacttggggaaagtctcctaacctccctgttcctcagtttactcatcttaaagtgaagatcatgccgtagtcagcctcccaggttgttgtgaggattctctgggataacacatctgcagagctgaggacagtgcctgacatgtggctagcaggcagtaatcattagcttttgttattattataactacataaaatgaaggagaaaagtcatatacaaagaaaggaagggctatcaccggatgcggtgcctcacccctgcctcagcttgaacccaggagttcaagaccagcctaagcaacatggcaaaaccctgtctctacaaaaattagctgggcatggtggcccattcctgtggtcctaactactcaggaggctgaggtgggaggatcacttcagctcagcaggttgaggctacagtgagctgagattgtgccactgtaccccagactgggtgacaaagtgagagcaagaccctgtctcagaaaaaaaaaaaaaaagaagaagaagtagaaggacaggaagggaaggggagaaaatggggtaggggacatggaagtggggaaagggcagctgcaccccaattcatttctatggttatgtatttgtggactttatattcgtagaaatctcagatctttgtttagcgccaacagaattaatagctttcttcagttccacaaacactgagtgccctctgtgggccaggactggtttgttgcctgccctctgcaaggtcacagtctgttgataaattagtatcaagtaatatccattggtgctttctatgtaccaggcattgtggtaagggcttgatatgcattatgtcatttaatccccacaaaactcttggaaaaagatactatgatcaattttcatagtaagaaactgaaactcaaaaatgtggaatgattgccagaattcagatagctatgttcagagctagatgtggagctcaagtctgtctgatgacagcaccctacttctatcccccatcatcccacctcggaatatgtggcagggacaaagtgcagtgggctaagtactgcatgtccacaatgtgcctggggtcctcagccacccagcggctttcctgaatgaagaacccaggattttcttggtgtgctgacctcttagcattatgctggatcctctttctggccttgcaatgtgaggaatctaggctgggtgctgtgcttagtcccctagccacctgggagcttgcttaaaaatgcaaatcttctgggctctgacaacaaggttttgtggggcaggtctaggaatctgattccaatacttgaggtccttgacctaactgttgggaatgaagatgtcttagtcctgatgatggcaatggtagtgtgctccacccagggagacctctcagtccacacctcagtcccagagaggtgcagaagagtcctaaggattctcagccacttttcctggctctgggcaaagtttgcagcgacctggtcaggcatgtattgttttctgttcttgctgcttcccctccccctagacacaaactacagagatttgccctttattcctaatttggaggagaaggaggcatcaatttcttggcaacagcatgtccacacttcctctccttatccctatctttcagtgctgagttgaatgcatggcacgtgctcagtaaatatggattgaaggctgtcttcagtttcctgggcccatagctgttacctggtttgccagggttcggcactgacaatccactaattggaattttttcttggatccataggtttttggtgataaaccaggagctgagagaatcaaaaagaatggtaaagcccaggcccaggacatcaagcaatgtacatatttggaatgacctcatgctgtgggccctgattgtaaataaaaatgcttttgcggaaacagcaaaatttggggaagcctgtcttccacctccttgactgaaaagtctggtcagaggtgccacctggctacttcctcctcatccttctaggaccttcctctggacccctcagttctgagccctccatgaaaccctcagccatcaaggggactcgaatcgggtccagatttctgcctgggttgacatctggggtgaaccaacacctggactcacacatcagccacactggatcaagcccaaagacaacgcagacacacacactatttgtgccgtcctctatcatctttttaccatccactcatttcttcccagtcccctttgtccacttctgaaatgctgtacttgtttgtgaaacttcttctagggtcactttttgctccatatgagtggctttcccctagggatatatatcaagataagattttagagaataaacactacagaatcacagcctatgagggccggggttgcgaaccccatgtactttgaaaatgctcctcaggtgcttctcatctgtagacctggttgaggaccctgctctgtgaatgcttctcggatgctcaccttcatccccatggtgacaacggctgtctctacctgtggatctccaactgcctgccacacatctccacctagcatggactaagtgctcactatatgccaggcactgttctaaggactttatgtggattaattatcatatttaagccccaaaacaatcctgagagggaggtactattattttcttcaatttatagatgaggaaattgaggcacagggaagttatgtactttgctgaaggtcacatagctagtaagttgttaaaccaggttctgaaaccagataatttgactatagagcctgtatccttagccactggctatattacctccttcaaactcacatattcacaaacgggatttctgggtcctatggtagttccatttttagtattttgaggaccttccatactgttttccataatggctgcagtgtttacatgcccaccaatagagcgcaagtgttccaatttctccacatcctagccaacgcttgttataggatttgtttttgtaatggccattgtaacaggtattcggtgatatctcattgtggttttgatttgcatttccctggtgattattgacgttgaatgtcttttcatatacctgttgtctatatgtatgtcttctttggagaaatgtttatttacatctcctatagattgaatgtttttgtctccctaaaattcatatgttgaaacctgtattagtcagggttctctagagcgacagagctaaggaaaatatatatagttataggtctagaagcaaacagaggtgctgggggtggctcctgaggagaatcaacattatcttgcctggcaactgcctcaggagaggccatcactgttgccttaggcagcacagggtttatttcctcagacaaaggtggaagggctgatagcagcatgggttggggaggggatgttgccactactggggatgtggaaggggaagctgtttcttctggcaaaaaaggttcatcagagtttacaaactccgtgtcccgagcttcatcagggtcatcccacacatccccattccaagttgcagggtcctattcttttctaagcaataccctcactttaacagtagacacctggcgaggctgtgcatgcacctttgattgcatgtcagccacttgcatgataagaactcgtgtctatttttccacaatttcaactcttcctctacaggagataagactgtcactctgggcaatcttagcagatttgagattcagtatctgcttctgaagctgggagatagaattgctgagttcatcattttctttcatcactttgtccatggaacttagcagcaaccaaccagcttcattatgttccttggttctccacatatggtcaaaggtattatgtatagagtcactaaacttcttgcctctcatgagtaatgaatcaggcgtgtcaaatgcatttattttgcataactctctaaacaattcacaccaaggactatcagtgttctccatactattagaagtagagtccttagcattttgaagtcctaatcatagtaaacagccaactgcaaaaaccctaaaaccaattaaagaactccatccttaatattctgttcctctagaacgactcttggtaccaaaatctgtattagtcagggttctctagagggacagaactaatggaatatgtatatatatatgtgtgtgtgtgtgtgtgtgtatgtgtgtgtgtgtgtgtgtttattaagtattaactcacatgaattgacaaggtcccacatgatgtcacatgatgacaaggtcccacaataggccatctgcaggctaaggagcaaggagagccagtccaagttccaaaactgaagaacttggagtctgatgttcaagggcaggaagcattcagcataggagaaagatgtagcctgggaggctaggccagtctctctttttacatttttctgcctgcttatattctggccaggtgggcagcttattagattatgcccacccagattaagggagggtctgcctttcctggcccactgactcaaatgttaatctcctttggcaacacacctgcacagacacactcaggatcaatactttgtatccttcaattcaatcaagttgacattctatattaaccatcataaaccttaatccccaatgtgatggtgtttagaaatgggaactttgggaggagattggatcataaggatacagtcctcatgaatgggattagtgctttaataaaaggggccctgcagagctcactgtccctttcaccatgtgagattacaatgagaagattgccatttatgaaccaggaagtgtgcccttaccagacatctaatctgctggcgccttgatcttgaacttcccaggcttgaggatatgaaaaataaaattttgttgtttaaaagccactcagtctaaggtattttgttatatcagccaaaatgaactaagacaaagtcctctgtctattttttaaaattgagttatttgtgttttttttgctgttaagttgtaaaagttatttatacattatagcaattaacctcttatcagatatgtggtttaaaaatattaatattttctcccatcccgtaggttgccttttccctctgatgagttttttcctttgctgtgcatttccttcgctgggtgtatttaaatttgatgtaatccttcttctctatttttgcttttgttttctgtgctttctgatgtcatatccaagaaatgattgctaagatcaatgtcatgaagctttctccccaagttttcttctaagagttttacagtgtcaagtcttatgtttaagtccttaacccattttgagttggttttctatatggtgtaaaatgggctccaattttatcttttttgcatatgcctacttggttttcccaaaaccactgaagacattgtcctttccccattatgtattcttggcactcttatcaaattagaaataaactaatagaaggaaattgcttcaacttaataaagcccatatatgaaaagctcacatctaacagcatcacactcaatggtgaaaaactgaaagctttttctctaagattaggaccaagacaatggtgaccactctggccacttctacccaagataatactggaagtcctagacagagcaatctgtaagataaagaaataaaaggcatccaaattagaaaggaaggagtaaaattgtctgttcacagatgacatgatcttacttatgtcttagaaaattctaaagattctttaacaaaacttgttagaattaataagtaaatccagtaagtttcaggatacaaaaaaaatcaatatacaaaagtcaattgcattttcatacactaacaacaaataatatgaaaatgaaattaagaaaataattatatttataatagcatcaaaaagaataggagtaaacataactaaggagatgaaagacttgtacactgaaaactacaaaacattgctgaaataaacataaaaagtcacaattaaatagatagacattccatgttcatgtattggaagacttaatattgttaaaatgtccatactacccaaaggaatatacagattcaatctaatccctgtgtaaatcccaatgacattttttatagaaatagaaaaaacaatcctaaagtgtgtatagaacccacaggaccctgaatactcaaagcaatcttgagaaagaacaaagctcgaggcctcacacttcctttcaaaacatattacaaaatgacagtaatcaaaacagtatgatactgacataaagggacatatagaccaatagaaaagattagaacacccagaaataaacctacacatatacagtcaatggatctttgacaagggtatcaagaatacacaatggaaatggaacttttagtgaccgcgtattacatgagaaattagaatctaaacaaacctcagccatagggtgagttagtgcttacctgccagtcccttcctgtgggcacttactaatgcatgagtgtagtacaccaaaggctgagactaagataagacagctgagagaggacccctgaggcatagccttcccataaccagatgatgactgagggaagagtaatagaacactaggataagtcctaccatggcactccttcatggaaagttctgcagctacactccaagaaatgggacagggcagcagaaaagagagagattactgaagcatggaaagcaacagtggcactgcgaaaaaaagagaacttgacagctacccagaacctggcagctgagctatgaagcagatacagatttctcatggttgagaaagctggtggctaggatataaagtataaagcaatctccagtctcatcaatgttctctcatcaagagaaagttatgttcccaccttcaatatgtttgaagctaacatttttaattttaattttattttttatattttttatagagatagggtctcgctatgctgcccaagctgttctccaattcctggtctcaagctatcctcttgcctccacctgccatagtgctgggattataggggtgagccactgcatcagtggctagcattaaatagaccctaactaaagctgcaacaaagcctagaccctggtaactacagattatattaactcagatccccacacttgaggcctaacaggagactgagtgtgccctaggtccagtctgctttatattactttactttcctcctccttattcataaataaatgtaaaagagaaaatacaaacgtttacctagacaaagcaaaacatgtcctcatctcttaaaaaaagacagtagggctggtgcagtgggcatggtggctcacatctgtaatcctagcactttgggaggccaaagcaggtggatcatttgaggtaaggagttcaagatcagcctggccaacatggtgaaaccccatctctactaaaagtacaaaaattagccaggcgtggtggcaggcacctataatcccagctgctcaggaggctgaggcaggagaatcccttgaaccccggaggcagatgttgcagtgagctgagattgcaacactgcactccagcctgggcacagagcaagactctatctcaaaaaaaaaaaaaaaaaaacaaagacagtgggaaaggtgaacaatgagtgtgatagagaattttagcatataaatgaaaactatatttaaaaatggaatgttaaagtgaaaaaaatattatatgagaggtgaaaagtttatttgaaagacaacagaaaattgggcacagcaaaggaaatggcacaaaacaaaatcaggaaggggaaaaggagcatggagcaaaacctggagaaaacagtcataagtttccaagagtcctttcctagtggagtcatagagtcatacaggaaataattacttcagcaatgaattgtgacaacacttgtgtgaaatgttgtctaccagggaagctggcctgggcctagatgtccagggtttttattgggagatcactcacataggcatcctctacctaccacggacccaaattccagaacccagaaagaaagcagatacttatcacaaagcacttatttgtataaagtatagatatagtgagccactcttatcagttacagaatggtggaaccctcctgaaaactaagttcccagataacagccaagggccaatcttgtaagcagacctttctagagatagcagtctcaagcctgccatgttaactatttctgcacaacccctaattgcaaattaagtatacacttcttcatatgtcaaagaaaaatgataaggaaaataaaatattttgaactggatcataatgtaaaaatagtgtattaaaatttgtgggaggcagctaaagcaacacttagagggaaattcatgactttcaatgcctatattataaaataaaaaagatgtaaaattaataatctaagtttccactccaagaaagactaagaacgaatgaaagagagacagaacccagaaagaaagcaggtacttatcacaaagcacttatctgtttagagatatagtgagccactcttatcagttacagaatggtggaaccctcctgaaaactaagttcccagataacagtcaagggccagtcttgtaagcagacctttccagagacagcagtctcaagcctgccatgttaactatttctgcacaacccctaattgcaaattaagtatacacttcttcatatgtcaaagaaaaatgataaggaaaataaaatattttgaactggatcataatgtaaaaatagtgtattaaaatttgtgggatgcagctaaagcaacacttagagtgaaattcatgactttcaatgcctatattataaaataaaaaagatgtaaaattaataatctaagtttccactccaagaaagactaagaatgagtgaaagagagacagaacccagaaagaaagcaggtacttatcacaaagcacttatctgtatagagatatagtgagccactcttatcagttacagaatggtggaaccctcctgaaaactaagttcccagataacagccaagggccaatcttgtaagcagacctttctagagatagcagtctcaagcctgccatgttacaagatacaaatatcaggaataaagagagtatcactggaaaccctaaagacattacaacataagagaatatcatgaacaactttatgccaatgaatttaataacttagacaaaaaggaaaaaattcatgaaagccatggattaacaaaactgacaaaaagtaaaatagaaaaaaatatgaattttcccatatttattttaaaagttgaattttattttaacctttattttaagttcaggggtacatgtgcagtgttgttacgtgggtaaagttgtgtcatgggggtttgttgtacagattatttcctcacccaggtattaagcctagtacccattagttatttttcctgcttctctccctcctctcatccttcaccctcccggggctccattgtgtgttgttcccctctatgtgtccacatgttctcatcgtttagctctcccttataagtgagaacatggagtatttgattttctgttcctgtgttagtttgctaaggataatggcctccagctccacccgtgtccctgcaaaggacacgatctcattaaaaagttgaatttctaataaaaaaatctttccacaaaaaaattatcagtccacattgtttcacttgtgaattctatcaagcatttaagaaagaataatactaaccttatgcatacagtcagaaaatagagaaagcacttcccaatacattttgtgtaattagcgtaacacggtattataataacaggacaataaaaattacaagccaatatttctcatgaacaaagatgcaaaaacccataatagtatattaataaattggtcccagcaatatataaaaaggacaatatatcatgaccaaaaaagagatttttccaggaatgtgaggtttgttttgtatttgaaaattaattaatgtaatttatcatattagcagaaaaaaagagaaatcttatctcattagattcaaaataagttattttacacaactcaacattgattcatgacaaaacttttggaaaactataatagaaggaatttcctcaatttgataaaagatatcttcaaaagatctataattaataccatacttaatggtgaaaccacaaatgttttctccttaagacagggaacaagcatgtccactctcactttaattcaatatgaaagtatttcaataaggcaagaaaaagaaataaaaggcatgcatattataaaggaaatgcagaacagttttttattctcagattacctgattgtgtgtgtagaaaactccatggaatctttttttttccttcaacttttattttaagttcaggggtacatgtgcagttttgttacataggtaaatgtgtgccatggtgatttgctgcacagatcatcccatcacctaggtattaagcccagcatccattagctattcttcatgatgctctccctctccccacagccccctaataggccccagtgtgtgttgtttccctccatgtgtccatgtgttctcatctttcagctcccacttacaagcaagaacatgtggtgtttggttttctgttcctgcattagtttgctgaagataatggcttccaactccatccatgtccctgcaaagaacatgaccacgttcgtttttatagctgcatagtattctgtgttgtatatctatcacattttctcttatccagtctatcactgatgggcatttaggttgattccatgtctttgctattgtgaatggaatatcaaaaaacaactgctagacctagtaagtgaatttagtgaggtcacagagtacagggtaaatttacaaaaatctatagtgtttctatatactcacgatgattaattgaaaataaaatttaccaacaataccatctgcagtacaataaaacaagcaaatacagaattaatcgaatgagagatgtataaaatctctacccttaacactataaaacactgctgagagaaattaaggaagacctgaataaaagaaaaaatacaccatattcatggattagaacaatattgttaaaatatctattctcctaaatttgctgacagattcaatgaaatcccaatcaatatcctaacaagattttaagaagaaattgacaatttgattctataatttatatagaaatgcagaggatgtggaataattgaaacaattttgaaaaagaagaataaagttggaggactaacataataaactgatttcaagatgtattgtaaacttacaggaataaaggtagtgtagttttggcatagggataagcacataggtcaaccgaacagaatagagtcatgaaataaacccatggtcaactaattttgaaccaaatcactaagtcaactcaataggaaagtaaatcctttttaataaatggtgctggaaaaactggaatctgtgtggaaaaaagcaaatccaaaataaaaaccaaaacttcaattccctccttacctcatacataaaaataatataagatagggcatggccctaaatgtaatagacagaatcataaaaattcaagactacttaggagaatatcttcatgccttttggatagaaaaagatttcttagctgggacacaaaagaactaattgtaagcttcatcatgatacattagacttcatcaaaattaaaaatgtatgttcattgagtagatggatggttaccagaggctgggaagggtagtggggggtgagaggggaggtaaggataattaatgggtacaaaaaaatagaaagaatgaataagacctattatttaatagtacaatagtcagactacagtcaataataacttaattgtgcattttaaaataatttaaagagtgtaattggattatttgtaactcaaaggataaatgctgaggggatgaataccccattccccatgatgtgcttatttcacattgcatgcctgtgcaaaaaaaatctcatgtaccccataaatatatacacctactatgtatccataaaatttttttaaattaaaaaaaatctgctcattaaaagagactattaagaagataaaggcaactaatggcattggaaattttttaaaaaaagaaagtacacaaaccacttgtatccagaacatataaagaacacctacagtttaacaataaaaagacaaacaacccaataaaaaaagggcaaaaaataatgatttttgacctaaatatcactccttatataaaagttaagtcaaaatgggtcacaaacctaaatgtaaaatgtaaaagtacaaaacttttagaaaaatatagaagaaaatatttaagatacaaggctgtgcaaagagttcttaggcttcacaccaaaagtgcaatccccaaaaagaaaaactgataaactagatctcatcaaaattaaaaagttttgctctatgaaagacctttttaagaggaagaaaagacatgctatgaactgaaagaaaatatctgaagacccacatacccaacaaaagacaaataactagaacatactaaagagttttcatacaacgtggatgacccttgaggaaccttgaggacattatgttaagtgaaataagtcagtcacaaaaaaggaaatactgtatgagtccactaatgtgaaatatctagaatagttagattcatagaaacagcaagtagaatgttggttgtcagggactgggggaaggagcaaatgaagaattgtttaatgtatatagaatttcagttttgcaagaagaaaaaattctggagattggttacataacaatgtgaatatacttaacactactgaactttacacttagaaatggttaacatgttaaattttatattatgtgtttttaccacaataaaaattatttatttactatttatttatttatttattttttgagacagactctcactctgtcgcccaggctggagtgcagtggcaccatcttggctcattgcaacctccgcctcctgggttcaagcaattctcatgccttggtctcccaagtgagccagttaactttgtatttttagtagggatgggatttcaccatgttagccaggctggtctcaaactcctggtctctcaagcaatccatccccgcttggcctcccaaagtgctgggactacaggcatgagccatggctcctggccattttttattttttattttaattttttactggtttattttcatgatgttttctgacagagggttgatatgatcttgttttaaaaatgtattatttatgttaagttccagggtacatgtgcaggatgtgcaggtttgttacataggtaaatgtgtgtcttggtggtttgttgcacctatcaacccatcatgtaggtattaagcctagcatgcattagctcttttccctaatgctctcctacctccccatactcccccaacaggccccagtgagtgttgttcccctccctgtgtttatgcattctcattgttcagctcccacttataagtgataatatgcggtatttggttttctgttcctgcattagtttgctgaggataatggcttccaacttcatccatgttcctgcaaaggacatgatttcattagtttttatggctgcataccattccatggtgtatatgtatcacattttctttatccagtctatcattgatgggcatttgagttgattccacttctttgctattgtgaatagtgctgcaatgaacatatgagtgcatgtatctttataatagtatgatttatattcctttgggtatatactcagtaatggaattgctgggtcaaatggtatttccagttctaaatctttgaggaatctccatactgtcttccccatggttgatctagtttgctttcccaccaacagtgtaaaatcgttcctatttctctgcaacctcgccagaatagagaactcagaaataaaaccgtgcatccacaacaatctgttctttgacaaacctgaaaaaaccaagcaatggggaaaggattccctatttaataaatggtgctgggaaaactggctagccatatgcacaaaattgaaactggaccccttccttacaccatatacaaaaattaactcaagatggattaaagactaaaatgtaaaactcaaaattgtaaaaacctcagaagaaaatctaggcaataccaattaggaaataggcacaggcaaagattttatgatgaagatgccaaaatcaattgcaacaaaagcaaaaattgacaaatgggatctaattaaactaaagagcttctgcacagcaaaagaaactatcatcagagtaaacagacaacctatagaaagggagaaaatttttgcaatctatccttctgacaaaggtctaatatccagaatctacaaggaacttaagcaaatttacaagaaaaaaaaacccattaagaagtagacaaagaatatgaacagacatttctcaaaaaaagacatacatgtggccaagaaacatgaaacaaagctcaacatcactgatcattagagaaatgcaaatcaaaaccacaatgagataccatatctcaccagtcagaatggcgattattaaagagtcattttttattttttttgaagacagggtctcactctgtcacccaggctggagggaggtggtgcaatcatagttcactgtgctctcattctcctggcctcaagtaatcctcccagctcagcctcccaaagcactggtattataggactgagccattgccttcagctgaaaacaattttaaaaataaaataataaagaacttccaaatcttacagcaaaaagccaattaatacctccaattagaacaggagcaaattcgacccctaattagaatatgggcaaaagaaacagagattttaccaaagagatgtacaaaaggcaaataaaaacattaaaagacagtcaacattattacccatttgggaaatggaaattaaaactccaatgagatatcaatgcatatctatcagaataactaaaacggtaacaccaaatgttggtgagtatgcagagaaactggatcactcatatattgctggtagaaatgtaaaatggtacacctactctggaaaacagtttggcagtttcttatgactcagcaattgcactcttgggcattttatcccaaagaaatgagaaaccaatgttcacacaaaacccaaatgatcatagtacttttattcataatagtgaaaaactggaaacaatccagatgttcttcagtggatgaatggttaaacaaactaaggtacatccacaccacggaatgctgctcagcaataagaaggaacaaactactgatacacgcaactatttgaatgaatctccagggaattatgctgaggaaaaatagccaatcccaaaaggtgacatagtttatgattccatttatgtaactatttaaaaattgtggtttaaaaatgtgtaacataaaatttaacatcttaattatttctaaatgtacaattccatactgttacatatactaatttttttattttttatttttattttatttatttatttatttatttatttatttattgagacaaattcttgctctgtcacccaggctggagtgcagtggtgcaatctcagctcactgcaacctccgcctcctgagttcaagtgattctcctacttcagcctcccaagttgctgggaccacaggcacatgccactatgcctgactaattttgggggtttttttgtttgtttgttttgagacagagtttcgctcttgttgcccaggctggagtgcaatggcactatctgggctcaccacaacctccgcctcccaggttcaagcgattctcctgcctcagcctcccgagtagctgggattacaggcatgtgccaccacacccagctgatgtatttttagtagagacagggtttctccatgttggtcaggctggtctcgaactcccaacctcaggtgatccaccctcctcggcctcccaaagtgctaggattacaggcatgagccactgagcctggcctaatttttgtattttttgtagagacagggtttcaccatgttgcccagactggtctcaaactcctggcctcaactgatccacccacctcagcctcccacagtgctgggattacaggcataagccaccatgccctgcccctatattcacatttttatacgaccaatctccagaactttttcttgcaaaatcgacattccacatccattaaacaactcatcatttttccccagcctctggcaaccaccatcctattttctgttctatgaattttctattctagatacttcacataaatgaaatcatacagtgtttatatttttgtgactggcttatttcgctcagcatagtagcctcaagttgcatccatgttgtcacaaatgacagcatgttcttcccttttaaggctgaaaaatatgtcattgtatgtatatgccacatttttgtatccactcatctactttaatagccttttttaaatgacaaaattttagaaatggagaatagatttgtggttgaagagtttatgagaagggtcagaaggtagtagatatggtaataaaagagcaacatgaggggtcctcgtggtgatggaactgtcctgtattttgactgtggtgatggatacggaaacctgcatgtgttataaaattgtataaaactaaacacgagtttacataaacgaagaaaatctaaatgagttgtggactgtatcatggtcaacatcctggttgtgatattgtactacatagttttgcaagatgttattgtcaaggtaaactaagtgttcatagatgtctttttaaaaaattttcttacaattacattagaatctacaattatctgaaattttttttttttttttttttgagaaggagtcttgctctgtcgcccaggctggagtgcagtggcgcgatcttggctcactgcaagctctgcctcccggattcacgccattctcctgcctcagcctcccgagtagctgggactacaggcgcccaccaccatgcctggctaattttttgtttttttttagtagagacagggtttcaccatgttagccaggatggtctcgatctcctgaccttgtgatctgcccgcctcggcctccaaaagtgctgggattacaggcatgagccaccgcacccagcctatctgaaacattttttaaagtttataggcaataggcttggacaggcacttcaccaaagaagatatctaaattggctataaaaatgagaaaagatgccaaatatttaattttataaatgggctataaaacaagaaaacatgcccaatatttcattttacccactcttttagactggctaaaattaaatgtcctgatatcactgataaagaggacactgttagagcataaaattacagataatagtcccttcttttttctctttattttcgttttaatttttttctaaaccatttcacatttctgaagtagttctcctcttattcacagtttcagttacccatggtcaaccttggtctaaaaatattaaatggaaaatttcagatataaacaatttgtaagttttaaattgtacaccattctgagtaatgtggtgaaatctcctgccaccctgcccaggatgtgactcattcctttgtccagcatgtccatgctgtagatgcttcttgcctgttaatcacttagtagccctcagggttatcagactgttgcagtatctcagtgcttgtgttcaagtcatccttacattagtaaataatggccccagagtgcaagagtagagatgctggcaatttgggtatgacacagagaagccataaaattcttcctttaagtgaaaagatgaaagttcttaagttaataaggaaagaaataaggttgctaagatctatgatgaaaacgaatgttctgcctgtaaattgtgaagaaggaaaaagaaattcatgcgtagtatatatagggcctggtactatccttggtttcagctatctcctggggctcttaaaacatgtgtccccccttggatactgtactgtaatcattttagagaactatttgacagtctgttataaatacacattcttaaaaaaaattctttttaagagatagtgtctcactctgtcacccaggctggagtgcaatgactcaatcacatctctctgcagtgtccaactcctgtcctcaagcaatcctcccatcttggcctcccaaagtgctggcattacaggcataaaacaccacactcagcctgaaacatacattcttataaacagctgagtcatggctcagctctttccctcctagatattcatgcaagagaaataaaaaaaaatattttcatgaaagacttgcacacaaatgtacatagcagcttttttcataattaccaaaaacttaacaacccagatgttcattaataagagaataaatgaacaactttgtatttttaaaaaggctttgtacttttctaaatggtttccctgggaaggtacatacttattctaacaataagatctcctggttcagaaaaattttggagctgattttggaacctgtagcatattttcttgatgtacattttcaaaggtattaaatttccgccttttgataataggtttaaattttggaaacaggccaaaattattcaaagaggaccaggctcagtggctcacacttgtaatcccagtaatttaggaggccaaggcaggaggatcacctgagatcaggagtttgagactagcttgagcaacatagcaagaccttgtctctacaaaaaatttttaaaagttagtcagatgtggtggagtgcacctgtagtcccagctactcaagatgctgaaatgggaggatatcttgagcccaggagttggagactgcagtgagctatgattgcacaactatactccagccttggtgaagagcaagactttgtctcaaaaaaaaaaaaatattcaatgagaaattgggtgtatctattggttaaagaaagaggtgtggttctcaatctttgccacacattagtatgacctgaaaaacctgaaaaattagaatgcccaggtattgtgacttaactggtttagggtgggccagttgttggtattttgttaaagctccccaaatgattccaataaaaccaagtcctaatctttttagttgctcacttcttgttaattttttttaacccacacagctgaaagcgatactacactaccatgtactgtaacttagccttcactagcttccttatagctaacacctctgatgtatatattaccgtggtaataaatgcctaagttgtttttcaggatcttggggtcagcccttgtccagtttgagtgcagttgagatcactgacccttaaactgagcctgtgcagatgccgaagaggtgaccttttggcatcagaggaccataaactcctctctcagatcatgctaatgccattatttcctgaatacatatcctatgaaaagccatgaaccctgactatgcttgtgcaaatcatcaattacgtcatttttccccactgccaatcacctttccccatgccttagatcaccccacttctttaccccataaatatcactgagccctaactttctggcagtagattggagaactgttctcccatctcctcactgggctgccctgtgaaaaaatctttctctactgcaaaactcatcacctcagtgattggcttcggcaccacaggcagaacaagcctggttcagtattgctaatatgcagccaaggttgaaaaccatggctgggagctgacgttaattttcttctatggtttataaactgacttctaaaggcaggtcctaaaaaggggtctcctcacattctctgagactacggcattgtaggaacaaatgtacagtctcccaagacagctgttttgaagaacaattcccatttggatgtataaattctagtgtgttttcaaacaaacgtttgcctctttatcttacagatgtgctaaagggacaataaatgtaaaagatctagttgactctcctacttcccttcaaatacattcagatgattaaatatataattttcaaaaatacatttatatctttctaaggcaaacttactaaaattattctttattatttcagtttgtggtgatgaataaggtacaaagatatatatattaaatagttataaaggatatacatattaaaggtatagtttgctaatgaaaaaatataaaagacagatatagatatacagattaaaaggtatagttatgaagaacatatatataagatgtagttataaagaaaaaatatgtatatatgtgtaaaagataaagttgtaaagaataactattaataataacacaatttagtcatgaagtctttgcccatgcctatgtcctgaatggtattgcctaggttttcttctagggtttttatggttttaggtcttacatttaagtctttaatccatcttgagttaatttttgtgtatggtgtaaggaagtggtgcagttttagttttctgcatatggctagccagttttcccaataccacttattaaatagggaattctttccccattgcttgtttttgtcaggtttgtcaaagaccaaatggttgtagatgtgtggtgttatttctgatgcatctgttctgttctcttggtctatatatctgttttggtaccaggaccatgttgttttggttactgtagccttgtagtatagtttgaagtcaggtagcatgatgcctccagctttgttctttttgcttaggattgtcttggtaatgcgggctctttttttgttccatatgaaatttaaagtcgttttttctaattctgagaagaaagtcaatagtagcttcatggggatagcactgaatctataaattactatgggcagaatggccattttcacgatattgattcttcctatccatgagcatggaatgtttttccatttgtttgtgtcctctcttatttccctgaacagtggtaaaagtcaaaattgacaaatgggttctaattaaactgcagcgcttctgcacagcaaaagaaactatcattagagtgaacaggcaacctacagaatgggagaaaatttttgcaatctatccatctgacaaagggctaatatccacaatctacaaagagcttaaacaaatttacaagaaaaaaacaaccccatcaaaaagtgggcaaaggatataaacagacacttctcaaaagaagacatttatgcagccaacaaagatatgaaagaaagctcatcatcactggtcattagggaaatgcaaatcaaaaccgcaatgagataccatctcatgccagttagaatggtgatcattaaaaagtcaggaaacaacagatgctggagaggatgtggagaaatgggaacactttcacactgttggtgggggtataaactagttcaaccattgtggaagacagtgtggcaactcctcaaggatctagaaccacaaataccatttgagccagcaatcccaatactgggtatatacccaaaggattataaatcattctactataaagacacatgcacaaatatgtttattgtggtactgttcacaatagcaaagacttggaaccaacccaaatgcccatcgatgatagactgattaaagaaaatgtggtacatatacaccatggaatactatgcagccataaaaaaggatcagttcatgtcctttgcatggacatggatgaagctggaaaccatcattctgagcaaactattgcaagaacagaaaaccaaacaccgcatttgctcactcataagtgggagttgaccaaagagaacacgtggacacagggaggggaacatcacacaccagggcctgttggggattggggggcaaggggatggatagcattaggagaaatacctaatgtagatgacaggttgatgggtgcagcaaaccaccatggcacgtgtatacctatgtaacaaacctgcatgttctgcacatgtatccctgaacttaaagtataataaaaaatttttttaataaaaataaaaatcacattattaatcataaaataataataataatacaattatctgttttgtctctttagaaaattccatactgacaaattgcagtcagatctgaagcactttcatagtgcatcagtacaatttctttcatgataataagttgcaagcttggaaattgatgagctacttgaaatgcccttgggtcaggccaaaatgtgcatgctggctgacccccctgaagctaggtcaaaaaagggcctggggaaatgaagcagtctttgatgacctacttcaggcagccagtgtgcagagccaaacaacaggccagatttgagagatcaattttcaacagctgctgcaggaatgcagtgctgatctgcccacgccaagtcagctgccacatctgcctcacctgtgctcagtaccatgcatggtatttggcatggagaaggatgagtcacatatgtttctgccctccaagctgctcccagtcctctgggaagggacttgaaaagcagggagaaaaccttcctttttgaggctttcttactagatccctgactattttggtctccagccacgtccatgggagacagaggcagtaatgatggcagtgatcatgaggaagaagaggaggaggaccacatgatagccacaaggttatttatcattgattgagtgcctggtgtgggttgggccctgtaaagtgctttaaagctgaggactaagctctgattttttttttatcttgcccaaatttctatctaagtggtctggggagtcatgccccacaaactgtaagttctcatcagatggtttttatttaaccatatgtattgtgacttactttccaatctgactctggcataacagtacatgacaaaaaagaaaatcaaaatactttaccctaaatacatgtttctttgccatattttgaaatggtcctgcaaagctgtcctttgtgggggaaaatgtgcatctgtaaagaatctctattaacatagctagatcttttgcttccaggctctcccaatcacgaagaagagattaagtaagagtctagcgccttttaaaggtctaaagaggaaatatttgtcatctattgtctctaagggcagccactacaagacttcaaaagagccttggtctccacaatcttttatcttaacctaatcatttcttttctattgatcccaggtctttagatgaactcaaccaattgtcaatcagaaaatgtttaaatttacctatagcctggaagtccccactttgagttgtcctgcctttctggaccaaaccaatgtatttcttaaatgtagttgatatctcatggctccctaaaatgtataaaaccaagctgcaccccgaccaccttgggcacatgctctcaggacctcctgagtgctgtgtcgcaggctatggtcacccatatttggctcagaataaatctctttaattattttacagagttcgactcttttcttgacaaagccattactacctttattgtttccatgggttagttattagtaccaccattttacacatgaagaaacagaagctcaagttaagtaacttggctacatttatacatggatccaacctgagttcacatgggagaatctagggctaactccaagtctcagttttcacatctctattagtccgttgtcaagctgctgataaagacatacctgagactgggtaatttataaagaaaaagaggtttaacggactcacagttccacatggctggggaggtctcacaatcatggtggaaggtgaagggcacgtcttacatggtggacgagagaatgagaaccaagtgaaaggggtttcctcttaaaaaaacatcagatctcataagacttatttactaccataagaacagcatggaggaaaccatccccatgattcaattatctcccactgggtccctcccacaacatgtgggaactctgggagctaaaattcaaggtgagatttgggtggggacacagccaaatcatatcaacatctataaaacaaaaatcacatctgcccaccactgcaaaattggtatgaggcttcaagatacccttaactttgctatattattgaataagagtatctcaggggggctctatactcccaggaaccccctaatcaggggttaattgctctttaacagctgaagttgctcaatgtttttctaactgcacatcgaagttaaaaaaaaaaaaaaaacccagaaccttcttaatgtttgaccaagttgcaatcaccaaatcaagttctgagcagccatcaccccatcaactgagcctccacacttgttgatgatgaatacattctaaaggctttacaatacagaaggaaaattaatctttttttgtactatacccttatcaggccaggaaaattgatcttaatatggacataaaaattccccaacccttgtgtttctttggctatttatttcccttagtataaatttcaaattgcatcattttcttctccatcctgtgaagaaaaattatagcccaattctgggctagtgcaacccagtaagtatggaagtagccacagtacgtatgcaccaagcatgttcatgtgaacaaagctccccacctgggccaggagaaggaaacagatgagatccatgaccactgcaaagatgcctggcaggcagggctttctgacagcagtttgggattaaaggcttcagtgagccatgcatccttgcaaaacacttgctgttttccctcagctaaaatggcagatttactaaggtaaccagatacttttgggaatgaaagatggctctgttagtcatgtaagaacaataggtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcggagcttgcagtgagccgagatcgcgccactgcactccagcctgggcgacagagcgagactccgtctcaaaaaaaaaaaaaaaaaagaacaataggtgcaaactagactgtcccagtgccataatttttctgtgtccccacccaaatctcaacttgaattatatctcccagaattcccacatgctgtgggaggaattggactataagtccaattaaacctctttttcttcccagtctcaggtatgtctttatcagcagcgtgaaaacagattaatatacccagataaactggacatgtggtctccttaggtttaggaaaataccactgatacaaggtgcaatggactgaaattttgcatcaactcaaaattcatatgttgaaaccctaatcccaatgtgatcatatgcgaaggtagagtttttgggaagtaattagttcatgaagttagggtcctcattaatggaattagtgcccttttaaaaagagatcagagagtgaactagctctccattggccatatggagggtatagtgagaagacagccatatggaaaccaggaattgggccctcaccagacactgtatctgccagcaccttgatcttgaacatcctatcttgcagaaccctgcgagatttacgttgtttaagccacctacttcatggtcttttgttttagctgactaagacacaagagaaggctgcaagaaaatgttgagatggcagatctggcagaaccaggaacaaatatgctagcttctgtttatatgaagacaaattcttgcaaaaaaaaaaaaaatggaagaattcaactaacagtttaaactaaaatacttttctaaatgcctccaccctccaccctcacaaggcatgctgagaggacctgtaataatgtttatagagcactgagatgtgcccgaccagagagtgtactcattaacattagccaaaaatattattagagggaggagtgagaacagtatcagtagtagcataagtcatggcaagaataatagcagtagtcatagtggcatcacactgtgggagaggggtataagcggaaggcctttccgagagatcacagctggtcaacatgagcaacccagtcacctggggaaggagcaggaatgcgagggcgggagcaggctgcaacagagtggaggtgggatgcagtgggggatcctttgcagtttgggtttgcaaacttagccttcaagaggcaacatgaaatgggcatccaacagatctggaattaaagactgacctgtcaccaactagcagtgagaacttggccttgttatctgaattccctgacccctgggctcctcatccatgaaatgtgaaggataatgggcacttcctatggttgcagagaggattaaatgactgcatgtagtcaagtgcctggcacaaaggaattgttcagcaaagtactgtcccatccctggaattttatatataacgaggagaaaactgtgggaggcacaattgagagaaaactcatgtactgtgcactcttttttgaaaccatggtattttttttaactacactgagcacacagcttagaaagccacttttaaagaaaacaaaatctaaagtacattaaaccatagacatcatacattaatttctactttagtcttaatcaaaggctttggtagggtttgcctttgtaaatccaacacttcctcctcacttggaggccaaaccctgcccatagcatcctctcagctctgcacgctccccatgtgttaaggcctgatcagacctcagggtacaaggcacagctggttctcatggacacacaggatagtatgggggctggaaatgggtggggagagctagaatctagtagaaggcttactgatcaacaatgtttggggacccaagttagatgctggcaagattaatctgagagcagcaggtaggatgggtggaagggagagagaccagagggtagggagacacataggagattccaattccagtaaaagtacagagaaaaatctacctggagtggtagctctgtgaatagaaagcaggtggcaaagctagtaacactgcagtgataaaatctacagatttcaaataggttatagcaagctattgattcattccgttacctggcacttcagtcactgtggcttagaacaacccaccctcaggcttcatctctcctcacctcccaacctatcctaagtgccaacctgagaactgagaactccagcaccctcactgcttaactatcaaaacagaaatgagaccacttgtatcaatatgacttagttatttgttccatgaaaatttttgccgaagaagttaaggttttatgccaataactaatttcactttttgtttcaggaaatctttataaaccaataggttctgacaaagagtttgttcatctaggcaaacagctctgctattagaataatagatattgttcacctgggaaaacagcttcttagtagacaagtttatttatcaagactcactaatgctagattattatgtcacaaaccttgcccaataccaattagttacccatagtggaagacctgccttaaaccatttgagcccagaccccaaatatccacaccccttccaagatatgtggtgtcatcccttactgcagaggtttaataaacttaactttgatcagaaggctttctggtgaatttctgcagagttgacaagcatcagtgcaaacctgacaactgaatgtacaaacatgaactattccaacagttttgcccatgcacaggaagcccattcttgcttgaaccctgatgttctgagagaccatgatgactgacacaacaccttcctctgggaacattttttgtttccctcactctgtggggcctcttccttctctgaactcaccatacacactcttggtgttgtttcctttttttttgcttcatattagagctctctatgcatttgtattattgttgtttctggactatgagctcccaggggtagagattgcggtggtcaattgtatttcatgtgacgatcccaacactgtgccttgcccatcactggggcataacaagcttactctaaagatgctcttaaagattcccaaagcatttaaggagaacaaatcaaaggaaatgttttattattattattattataatttaagttttagggtacatttgcacaatgtgcaggtttgttacatatgtatacatgtgccatgttggtgtgctgcacccattaactcgtcatttaacattaggcatatctcctaatgctacccctccccctgccccccaccccacaacaggccccggtgtgtgatgttccccttcctgtgtccatgtgttctcattgttcaattcccacctatgagtgagaacatgcggtatttggttttttgtccttgtgatagttttgtcctttgtagggacatggatgaagctggaaaccatcattctcagcaaactattgcaaggaaatgttaaattcttatttttttctctttaaggcaaaattttaaaaataagatctctctgttataatcaagaattgtatttggcttttcaaaataggctctttccaaaaaggatcttcctttaaagtgcttgatgatcatttttgtctctttacaaacatgcacacgtgagttccacacgtccatgcacaccagtttaggaatccggggatagtccttccctagtgttacacctgacttctttctcagttctgtcttttgtacctttggtttggtgttctgaaatatctacctactcctctccctctctgtggattctgtaaaatataggaacttgcttagcactgtggtagaaatttaaaatttggtaaagaccatcagaagaggctggcggaaatgctacagaagtttatgttcccaataactaaagtgatgactaacctaggaaaacatttttcttgatgagaaaaaaattgacatggtgtgtacttctctcttcctttgcttttaggtttcaaatctcatttcattctggtattagtacgtaagattcaaaaagccccttctcttccacattgctgtttccaatctgctacaacttaggaaacaatttcccaatatcaggataggttctatattaagtaagagctaacctgccaggctcccttgtcactgggggtggacatgaactcaattctgcccaaaaataagtaagcgaaagtggctgggtagggtttccagaaaaatttttgaaggtagcccagttggctggtatgtgctgctttgcttttactagttgctcttccttgtctatttcctctttgtctggaacatgtttgtgaggccggaagtagagaaaccatcttgcatccctgaggtgaaaagtgctaagaacggcagagagaaaaatagaaggacattcttgaggacatctttgagagctggcctgccgaaactgccttcatgtggacttcacattagctgaggaaaataaacccttacttaaaccaatgttaactgaattttgtggctgtaattagagtgatcaaccctcccagtctgcctaggactcaagtgtttctggggactcaggactttcagtgttaaaactgggaaagtccagaaaacaaacgggaactcttggtctccctagatgttgatattaatgatgacattgggcttttttaaaacttttaagttccgaggtacaaatgcagatttgttacatagctaaacttgagtcgctggggttttctttcctcactcaggtattaagcctagtacccattagttatttttcctgatcttctccctcctcccatctgttacagctggatcacaataccaactgatacacttccaattagctgggtaaacttcagaaggctaaatattcctgagacacattgcttgtttgaaattccaatttttgacttcctttcaaccatcagttaccactcttttttaaatttttaattgatacggaataattgaacctatttatggagtacagtgtgacgtttccatacatgtatgcattttgtaacaatcatatcagggtaattagcatatttgtcacctcaaacatttgtctttcatgataaaaacttcaaaatcttctagctattttgaaatacacattattactaactgtactccctctactgtgcacaccaaagttattcttcccaactgtaactttgtaccatcagttaccattcttgaaaagttgaatgtttagctt

SEQ ID NO: 1147 - DNA, 52021 bp, Homo sapiens
acaaaaggtctctaaagagcaaaatattttcatttagcagataactatgacaaaatacttaaaaataacatttattcattgaattcctttacagcacatgatcaattgtttgatgtacaaaaagtatctatgacactagtattaaattaaaattaattttaaattttaccacaataaatgtatacatagtataaggaaaactacagatgctttcagatcaccagtctagaacatattctgcaaagtggctaattcacattatatttttcttttaatactgagttccataaaaatgcaagttcttccattgtttgagttctgaagtcagtattcattcttgcaaccaatgaacagtgttttgagaaaacagttttctttgtaaatattccaccaattcacgtcttgattttagcatcccaatctcatgataggggatctgtaaaggtagaaaagtaaaactggtcaagatccttcaaaatctgaggttcctctggctattggttactttgtttgtttcttacacgcttccccacagcggaatgtaagctcctggaaggcaaatatcccaaccagcttcttcatcctgtatccccaatgtctagaacagtgcctggcactgagaaggggcttggtaaatatttgatgaattaatatgtagaatatgcaaataagaattaaacatgatctcttgttctccaggagttcacaacttgggtggcaagttaaattacacaataaatataaaaaacaagctgtaggttggtgatctagtgctaagagggagtgagcatttcattagatgagggtggggatgccgacaaactgctggaaggtaggtattcagagagctggaggacgcagcagggacaaagagggaatgaagagggagagagcaggaggcgcagcaaaggagagagtctgctcagctgggagcagaggggccaggtagtaatcatgtgcctgcagcctggctgcaggccaaccattggagggtcttgaatgttaagatgtagagaagtttttactttattctgtaagcagtaaagaaacattgaagcttctgagtagacactggcatgattagttttaggaatattcagctggggatgtgcaagatggagaaaaaagtcagcagatatgaaaccacagtgctgcctagtactgacagcttagagaattagggcagcgctcattctcacgcactgctgagccctcacataagaccttcttacattatctacagtgaaatatttaaaaggtcttaaatattaagtgttggtgaagctccttattttaatggattatcttgttcatttttatttattaaatcaaggagaaattaaaacagaacatatattccaacaattgagtaattctaaaagcagggttaagcatagcttataatgaatataggtaggccccacttttgaaaaatcaaagctctgaaaattctgtatttcaaaatataagtcaagagatttaagccgaattaacaacgttgggatttaaactagacgtaagatcggtggtccactgggctggcaaaccagttagtactgtaaaagcaaattaaaatggagcctgtgcctgaaaaatccctgagcagaccaagccagttgggccttgaaaataaccttaactttgcttaaagtgcaaatgttaagcaaaatttaacttgggctatttcttgtagaagcttctactacagaaaaacagaacttaagctcaaccaatcagaagcatctcacaaactaataattatataactaggaactttccacagaatagttcaaacaaggcagcaagaatatgtaactgtaaccagtcaagtagattctttgtgtacttgtgttcttcctataaaagcctccctcttgggttcccaagccatttcgagttttgtgctgtccagttcaataattgctgcctgatcaaattctttaaaattttactgtgcctcagattactttttaaaagtaacctggaaaaataattttgaaataggatttgcttttgggaaacaaaaaaaataggtgaaaccgtacctgaacaacttgataaccgagtaactgtaggtgtctttgtttaatagcttctttccccagtaagtgtttgctattggagcaaaacctttttggaccatcaatacacagtgctatcctgaaaaataaaaaaggagaaaaatacttaattttttaaataatccaaaatatttattatatattttagttgccaaagtttatttgggatttggctattactatgtgccaatattattttcaaatgaatcatgaatttgatcttattaatattaatgtttataaaatattacaaggaatttcccaacatggtattctgaaatgtagtattttaatttccagaatcatatctatttttttcaccttcttgagaaaaagataccgctgcttattagcctcaacgagtcttgtaatgtgaaaaacacaacattttcctgtaccttttatggatatcttcattagctgtggatggcaatacaaatccttcttcatctaatttaatttcaacatctggtgagagaagaaaggaaaaattcctcgtgtgataccctcacaaacactatcttcctgtattcattcctttgctttgctttgattccttccaccttgcattgatcaattggactgaaggctgcaaagtaatgaccacaaccaaacaatggtgagaattttaattcaattggctttatgatcaatcaagtcagccttaaattaagaaagctcaataacgctaaaccacagaatgggttctgaagttatctggggtatgacaagaaccatgcatgctttctctttccccttatgataggtggcagagatccttcaatccagactgtgaagaaaacccttgagttaagacattagacatctgtgcaactcataacttccatcattccaacttgcagtgcctccatggtaagtaaagaaagcatgccacacccagacacctggtctgcgagcacggaaggcttccgaactgtccttcccctctggtaaactgcagttcccttcgtaaagagaagagaagtgaccatctgaagcctatgaactgctgtcctttacgagaaggctttcttctgctcatcaagttagaagaactgtaaggacggaggacttggagtctcttgtcagtgctgtccaggagaaatttctgtgatgtggaaatctttataatggtgctgtccaatttggcagccatgagccacatgtggctactgagcacttacaatgtgactgaggaattgaattttcttaaacttttaataatttaaatttaaatagccacatggtctagtggctactatatttggacagtacaagcctaggttatagtagtagctaacaattagtgagcatttcctacgttccaggtactattttatttagaccttaagtaagtctttgaggtcaatattactatcattttacagaggaagaagcaagcagaaaaaggttaaatattctgcccaggatattctgctactacgtggctaatatttgagacttaaacccagacagtcttgactcaacggctctgctgctaaccccaacttgccttcagggaagggaccattccattttgcatttccagagaacttctattgcttctaagtcccatatatctccaaaatcgaacaggatgcttaggtttaaaacaacaaaactccttatactacttacctattgtataacaatagggtgtcaacacttttggagcaaaatataatcttgctcctaaaaggttagtcagcccaatcttcacatatctataaagctgagaatccacaggggtctccagggaacagcatggggtaagaaatgacttcacttgatatttaggaaggagttttggaccctaaaaaatcataagtgcaaatgtgagaaagaaaaataagatataacaacagagaataaattgaaggttacctaggtagaaaagtttgatataacattactttataggcatgatacttttccaggaattgggacaggcatctctctcaaaatgataatgcaaacttctcttcttacagtgcaagtctaatagttcaaaatgtcttttatatgtgtttttacagtagtcactggttaccataaacagaaagaaaagtaaagaaggaaggtaaaaaggagtgaggagagagtgagaagaaacataataatgctaacagttcaagaaacatttttagaactgagaattgtcccaagggtcttaagtacacacaactaaagttttcaacacaggtttaatttctctaatctgaaaatccaaaatccaaaatgctccaaaatccgaaaccttttaagcacagacaggctgcttaaagaaaatgctcatgaagcattctggatttcaaatttttgaattagggatgctgaactggtaaatataatgagaatattttaaaatatgaaaaaatctgaaagctgaaacacttctggtcctgagcattttggataagggatactcaatctgtaatggaaaatgtgatataaatgacattccagtttaggaagaaaaggatagcaatataataaacgatgctggagaaaatggttatttatttggaaaataactaaattaaacttctgtcatccatgacagatgctaataaattccaggtgtacaacatgctgactatagttaataagaatgattgcgtgcttgaaaatggctgagagtacttttttacctttttttttgtttgtttttgtttttgtttctgagacagagtttcactcttgttgcccaggctggagtacaatgacgcgacctcggctcactgcaacctccgcctcctgggttgagcgattctcctaactcagagtccagagtagctgggactacaggcgtgtgccatcatgcccggctaattttttgtatttttagtagagacagggtttcaccatgttagcaaggctggtctcgaactcctgacctcaggtgatccacccgccttggcctccaaaagtgctgcgattacaggcatgagccactgcgcacggcaagagtacattttaaatattcttaccacaaaataaaatgatagatatggaggtaatacacatgttaattggtttgatttagccattctacaatgtatacatatttcaaaacaacatgaacataataagtatatacaatttttgttaattagaatacataaataaaaattcaattttacttttagatcaaagatctaaataaaatttaaaagatattatttttaaaaatgtaaaatattcatgctcttgagataggaacctcggaagtcataaaagacagattcgactacagaacatttaaaaatacatcataagtaatattaaaaagtaataaaagagtacaaatcgggaaaatatgtacaacattcataatagttaatatctgttttacaatgagtccttaaagacaaaccatccaacagaaataaattaaggtgtagaaaggcaattcaaaagaaatgtaaatggccaacacatatttgaaaatatgctaaacttcattaatgctcattaaaatgcaacttaaatatatgatatgatatcctctttcatgtagttgagtaacacaaattaaagagactactaacacactgcaatagaagtggaggagacatggccaccttcattcattgctggggaaatgtgacatctgtaactattagggaaaaaaaatctgccagtatccatcaaaaattaatccactaatcacatttttgggaatctagtttatatatgaaaaaaaccaaaaaggctctagtatgacaggatttgcaagaatgtttattatagcattcccgatagagacaaaagttgcaaaaacctccaagtgcatcaatagtagaataaacaccatgaaatatcatgcctttctaaaaagaatgcatgtgatctgtatgcactggcctcgagggatggccatgatatactgcgcataaaagcaaattgtactttgattagtgagtctcattccttgaaaagagaaaaaaaatagacagtgtttatgtatctgtatacatttgggcgtagaaactgcttttaatactgttcctttagaaatggtaagagatcggggttaactattatttatctttatataacttagtactgtctaagctgttttaaaaaaggggtatttttccattcttattaccttatttcaaaaatcagatactctaaactatgattcagagtcaagtagagagaagcagagagagaatgtcatagtctggtgtgctatttctgattctacataaggaatgtgataggtaataggataaatctttataggtctttatgggaagagcgaactctagataaactaaactctattagataaaagtgaaatttctggcttggcttaaaaatatactgtacttgcaaataatttaggtatttgttcagtccagacattcacactttgataacaaacagctatgggaaacctagtagtaaacctagtactaaaaccctgtaaaaccttcagagagaatggagaaatactgtaactcacatgcctgcagcacttgataaaacctcctaagaaatcttaaacagcaggaaattgttccttcaagaacaagaacacaaaaatggggtccatttatcaaagaaaagcctatctggtggcaactgactccaagtaaatgaaattctgctttttcaggttattgagacagatcagaagtaaaggaacttaaaaggaaactgcacccatggggaaataaagccacatatagttcatgcttttaccttatagaaagggcattccaggactgaggctaagaaaagttgggtcagttgtgcccgactcaatgtgtccaaatgagattctttacctgaaacagaaagcatcccagtcatagttacgtctgaattgaggtatgtatgagagaacatcatgaacattcaacatcaatttacacactccagacagaagtattctatttttaaatgacactatgaaatgaacttgttagaattaattatgccctcctcttgccaccaatgaaattgacttccaagaacccaagctcctagctacagaatacaattaaaagagataaaatatgttcacagaattagtggaaatttcctttaactatggagttccggaaatttgacatatttgggtggccttgaattaagatgaataataccatcctctcaaaaaaaaaaaaaaagatacagttgctcactcatcaaaagttctaacatgttaatgtggctatttccactgccattaccatatctcctaagaatgctgcaatttctcagataaggcaaaagtcagtttatctgagacagctttcttccctctacatgatttcctagcatgctttaactgtgtttatgccagcatctgttaacttcaggtctcatcttcggatcactatggaagaaaaactaaaggcaacatattgcctttatatgtgacttgaaaccactgccagttcaaaggttacttttttccaactgtcagaatttataaccaactcaccttgcagccgttgaaggaaaagaggcttgaatatttttgccagaaagttgactggatggcattcattaagtgaacatgaatgaagaagtttcaataatgatttgggtggaaaataattgaaatgagtgaatagcacgttttccagctttctaaataaagcagaggcatttggtggcaaataattgagtttcccaaatggttccattaaggcagaaatctgacgaggtgaaaatttttctgtttggcaaacaaaagtttctgccactgcattgaggatgggttttgaaagaatcagttctctactgcagtactccatgaccctgcagacaacttcaggatccaacgtgaggcacaccgcagctacacgatgctctagggcttttgtaaaaaatgtgtcatggtgcccaaaatatatgaacgcctccaagactctcctaagctcctcgttagtgaaatgtgggacatgcctcacgacatatttgcccaattttataatcagaggaaatgcttgactttgatcaagaaccaccagggcagtgagcatttggctaatcaatttaggactcaggttggaaactattgatagggaaaagttgtttatcttatttaaaaatgtttggtgttcatccactttttcagtacatgcctgcaagattctataaagggccacaatatcctccggggtaaatgtttccaatttttcaccttgaagttgatttataatgagttctagtgtcacacaacctgaactgtgcagtgtaatcagactttccccaagaatacaaagattgcgaacttccatgccaccttttctgagacgattttggcattctgccaccaggttcagcaacaggctactttgaggatccacatgcaacagaatcagagcttgcaaagcagtcactaaactagtgtttgacagctgtgagggctccttttcaaactgaaagcataaagcttgaaagatgctattctccagtatttcttttggcagcccttgatcaccatcctttttttccacttcacaaattcgttgtaaagctcctgctgccatagtgtcaggcagggtttccatcgtgcttataaaacttagcacttcttctgatgaagtcaagttgctcagtctcctgtaaaacatctgactctcctcatttttaacattttgttcaagcctgtcgcagtcagatacttgagagaacactggtccaccgagtggatgaaggtcatttccatttttcgaatgaaactttttacaatgggcatgatggaatttgaccccgaaaggctcaggttgtcgtgaacacaaccaagggcacagacgctccttgactaccttgtgaacatgatttagaggtttattttttaaagcagccagagctctatgcatctgaaaatcagataaacgataaaggttcttcctcaaggtgattaatgccataccatcagattctcaatttgataactaaattaaaaaatttaaaaacacatggttaaatacattgagaacatgattgacccaacatcaatgtttatgaaactacaaacgagtatctggaaaaaaaaaaaaaaaaaaaaaaaggatggttaacatataaacaccagaggggcaaagtctctgcatcctagagttagaagagtggctgacattgaacaataacaatcgctattacttgctaaacactgttgtaggtattctattaacttacacagattcagtacttttactatcattttacacgaggaagaagttgaagcacaaagttactttgcccagtttatgcaggtggttaagtggcagagctagggttcaaactcaggcaatgtagctcttaagggtggcccttaaatgttggttgaaggaagaaattgcatttggatagaaatcaaagaacaggtaaagtgggcaaaattaggcgaggttagagcaaggcaagggtaaaaacgcgctggaaaggccctaagctgttggtttcccctcggtgtcgggagaaggttagtgttgaaggaaagggtctactttgtcaatggaaacaaggtaggaaaagaaaaagcaaaacatagatcaatgaagggagaaggtggggcggccagtccagatctaaagacggtgcggggggatttggcaacacgtgtgtgcaagacagacagacgggaggccccgcggcgcgttttcctaggaatgaaagggacccgcggggcgagcacccccaaactcggcgccccggggacctgcgctgagacacgggccgggcggcgcagcctgaggagaaagccggccaggtctttgacacccagccggaccaactgcgcggagaccccgcgttgacacctaccgcgctctgccgggcaatcactccgggtggtcgcggaagcgcctgggcgtcgtgggcctccgtagcaaacgcggggcgggagcacgactcagggcggcgcaatgtgattggcccaggtccccttcggagctttctattggtcctgggtaccgagcatgggcgctgcgtcagtgcgcgctggcgcaaggttggtggaagtcgcgttgtgcaggttcgtgcccggctggcgcggcgtgggtaagctgcctgtcggctacggttcccggattccggccgctcgccctgcactaatctcctgggagaggcggcccggggcgggggtgggcagccggcttgcgcccgtggttcccacgcccttcggcctccgggggtcgccgcgggcgcgggctggggctcggacttggcctttggcctttggctttggtgtccccgggagcgtgtccttgggctcggcgtcggcctctgccgcgggaggcccctgggcggcgtggggtctctcctcatgttctgcctttggttctaggcgctttccaggcctagggaaaccgcactcggggacgcggggaactggggaacatgccgggttggggcggcgcgctccggggaacccgggacgttccgagcgcccacccggcgggacgcggccgtgagttctgcccgcggccgtgagctctgcccaccgcctccgcgccgcttccggggctgctggggcccgggcctccgctgagagtcgtgggaaggtggtgccggattgtggggcagtagcagggatgaggggttgattgatcctgggaagccctcaggatgtgtgtttcatgggaagtgatagaaattttagctgtagtaaggttttcattatcgtttccaccgttttctgtgagctgtcaatgtgtagtgttttcatattgtttattcactcattcagataacttatcgagtaccagtttcatgccaggtgccgttctgggcggttcattcaccgaaagccaagcttttggtttgggtttcagtttaaatctgtctctgcaaattgacagcccaccaattttagccgttagatgagtatggaaaaaaatctgtgagtgtcgtttgttttactactgcttatctcttgcggaaaaacgtgttagtaaaatgtttaagtggattggaaatattttttcgttatatgcacccgtttgtatatatgcccatacactcacatatttttgatttgcattaaataatgaaggagagtatgtgcttcagttacctttagtactatgattagtttgtttagcgttaggatcaaataagaaccaagaatcctatcattttaatatagtttttacttttatctttttttaaaaagaggaaaccaaaagctatttaagactgttgtgaatgatactgtggctcaagttttgttcaggttcttggcttgtgccacatcgtttttcaggtaggtggtaatactctcatttttaggataaaggagctgtggtacggatcatttggggagcttgtctacagggttgcacttaggaaacacagattcaagcccaagtagtttcgagccgatcatctgatttctgagccatggaattagagtttcattcgtacactctccttaatttgatgaattcttatttaggctcatttgagattagtgctgaaaacaaatttagaaaaggccatttcatattatgtgtgggtattgttgcattgtttcttaaagattgagggagaattaatatctttaggttgttactgcttcattaaaaagaggatcttttttcccccatttttcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataaggttagagccgttacagtggattttaccgttttgtgctttgaagaattttggttgggaagtgatatttatgaaacaaaaggacactaataccaccacatagtctttgttttttaacagaaatgtgtttgttcaatggtatagtaagatatcaccagcatttttttaatatagaagtgtgtagttgaattagactaaatggtctcaaaaattgaaacaagtaacaactccttaactgtaaatgacagaagtagcatatgctgtgtctgtttcacagggtggctgtgagaacaagtgagatgtgtgtttgcctgctcaggtgtgctttccacctcttgaatctcagtgtcccacttttttccccaaaagaaaggccttgccgtgcgtgttagagttcctcctgatgaaggaccgcctagattcttttgtgaaatagaatttaaagtagtagtgtaaggatctggaaaaaactcggctgcttcttcagggactagttgtttatgttcagtctctgcagaagttcctaccttagggtatatgcaactttaccatcttgtgttcttttatttagtttgctgcctccagattatactatttcagacaattcaggcgataacagttggcaggggctttataccacaagatgatttgccagccgctaagcagttaaaattcacttcaacatttcagagactgtcctgccagtgctctctcacccaagtgcacaaccctctctggcctttcctaaaactccagttcagaacactagactgtgtgcagctcaagtgaattataaacccagctcacggaaggagactcacctagttcctttatgcagccctgccacggtaactctggacaccagagaaaagggagcttcctggaggagactgccagtcagcagactctgtcattctacagtaacttaagttcagattgcagtgccacatgatgaagtatctgaatctgttactttggacaaaaccaaagccatcagtatcataaaactagtcctgatttggccccttgtggttgacctcagtaagttgatcagcaggtgttttggcagtcagatgaatggtgaatttttttttttaacaccaagatagtcatgctatttatcctccctggctgatggtttcgtctagctgttcataatctaatatccttcctatttcacatagtccttttcaaggtactgacattacttatacaaactctgtatgtagagtttaacacacaacttacatagagtcttggaagcattaaatacttcggtaaaaagttaagttgttacctcttttatcagtgtgaaaaataaggtgaattatttggagccaaattcgatggtgttcatgggcagtaaagcttgtggagtcttacaagtaagacaaggaagtgttctatttgaaatacttaaatttacacgagagtaagaataaagaaacttgatttgtaagagtttatagctcagcttatagctaatgatattctcagagttaagacagtgaaatgctctatatgaaatatttaaacttacatgagaataagaataaacttgatttgtaagagtttgtagctcgcttatagctaatgatattctcagctctctggaaacctgagggaatgagcggttcttgatagccaggtccctgatttagaaggggtaacacttttaatttcccagttttaaaatgccctgttatccctctgccttagtgtcacatgcagtacacatggctggttttatattttgctgaagatttcagagctgttgtgtttttattgctgtttttctttaccacagtattctacttgttgcttccttgtcttggcattctaatcctgagtgcttatgtatcagttctctttatttctgagtctccccatccccattttaacacctctttccttgcttttttttactttcttatgaaaagacgtttccacccagttagctgctgttcctccttggcagctcatcacagtgcctaggtgcctcatcttggctcttagcagtgctgatttgccttgcagatttgagctcatgttaatgtttggcccatgactcagtggcaaagagttgactatatcctatttcctctgatttttctaaaaatgaaagactgggactagatggaaacctgggatgggtactgtctgtgcctgtccctgcctttcgtacacaacatgaagagaaagacgtgttaatcccccccaacctcttgatgagcatcaacaaaacagacgcatggtttccttgaatgacatcctgcattaggcaaattgattaagctgagagcgcctagtcactggactggtcgtctcaaaaaaactggcaaggaagaagattgaaatacaagacaggaaactaagctgattgctttgctgctgagttaaatcaaaaatgcatgtagtgttaggtccctgacttgatatccttgttttgtagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtaatggactctctcttctgatcttactatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgcacctcagatgcagccatgaaacattttcagaatagcagtggctgggcctcatcctaaacctactgaaacagtccttgaagaagcaacccctcatgccattcctccatttagaaaagcagaacaaaacaaaacactcccaatgattttgataacttctctaagaacgattctcccagaatgaatgattttcatttcccagctacacatcaggattagctaggggagtttttactaaattatatgacttaggcccacctccagtgattctgatgtaattattccaaggtagggccctggcatcgttatttttaaaagctcccaggtgattctaacatatgtatcccaggttaagaaaaactgacttaggactctgtgaaccatagtttaaaaatgttaaaggatcaaaagaaccagatcagcacaatatgataccagaggggaattgagggtctgcattcctgacttgtgacctatgttgttttatctttgaggattattttttggagagggtatctagcaaggatgggttgagtataataaataactgattagaaatttgagattgtaaccctggcaatgatctgtcatatataacatgttcaagagagtatttcacagtatttataattttttttttaccttaagtttttatactttctgtattttcaaagagagaacacatacttgtttgaaaatccagaaaagacagaaacagaagcctgtcccactgttcgagtcaatgttaggcctaagcgtggaaccactcatttctcacccttttgtagagaaagaacatggagatgcctgcacaactgagggatttaagcttttttttttttttttttttttacaccatgagacatagaagcaattcttgatttccccaacacagaaacataccacattgttaattgtggttatttatatggctggtgtacctttctttctatatcaggagtcagtaaactctatgaaggtccagatagtaaatattttaggctttgcaggcctactcaacgctgctgttatgaataatatgtacacaagtggacttgactgtcttttaataaaactttatttacaaagaaaggcagtgcatggtatttgtcccagaagctatggttggctgacccctgctcagtatcagaaaaaatgtacagatgacagatattgtggttttgcaacctgtctgatccttgttttaagatttctatatttttacacatagtcatggagatgaaaatgtgaagtcttttctttcaacagcggccaataagtattttgtttcattatatctgctacttttatattgtaaaatagaagaaaactgcctacatgcatagaattactcaaggaaaataaaatgtgaagctctgcattattactccatccataagagcatgaaatagtattattttagatattttatttacctagtctttgtgtccttaaatttaaactttattgtgcattaattatgtatttgggttctctaggtctcggtgattcagaatacacctacttttgcaatggggggaagataattgataaacgacttcaagagcttggagcccggcatttctatgacactggacatgcagatgactgtgtagggtaagggcagtgttctctgtttactccaataagccctctatacatgatggaagttgatttgtaaaacatgtcagcttttcacttaacactgaaattttcctcatgttttacttttgttcgcttttttagctttaggatccaagagggtcagccagagattgatttacctattttgctgattttcttttgtgtccatctcatccttgtcagtatatgctaacggcaagagttagaaaaggtgctccagtacagttatctttattttaaacagtgtaggtatttgcagaaatcagcttgttctttaggaactttaatcgtgcatgtgcttctctctgccatgcacgtggagcctttggattgggctctttacatggagggagcctggtgagccacacttcgctgttagagaacacaggtctgtgggccttcgctgcaggctgcattgcttggcgtgctcttaccgtctgaacggccatttgccaccatgccaatcagacgtttacagacgcatactttatcttttcattacttttatttttgtttttacaagtcagtatttcacccattgtgccacctttcaaatcatcctgatgtgtttattcagtggtcctacagatattgtcctataacttacttagccttcaactattttagccagataacagcacacacccttaatttttttctagtaggtccatgtgttaatttaattttcactcactatgttactgaataatctgtttatgagaaaattacaaattcagcaaatgtcttgcttttcggcatactgtatttctgctgaactcaccctgtgcccacttcttccgtctttcccttcagctctgatgccatgggttttttccatatcgccagcacacatattcttcctgattgtgacaaagctttgtgacatttccttgggaattcactttagctctgtacctttatattgagcttttttcttttgccagaagctcattgacattaaatgctcagtcttgtatgagctgtgtttaactgttaatgtaatgcttgtgtcatccattaggcccatcactcatccatatttcacttctcttcaaaggctttcattttctctgttgatttattggtgtaagtattgaaatgcttgactgtatatttcagtagactatagtgcttagattttcaacctaactaccttacttgaatttttcctttttctgaaatgaagatattttcaagacattcttgcttgatgtgccaccacactaaatggggttacgaatgcacacttgagtccaatacctgggttcaaatccttgatcccccacttactgactgagatcttggttgaattagttaagctttttgttccttggtttttgcctctgtgcaatagataacagtaatctatttactgtgtaagcttcgtaggagggtcaaacggattaatacatgtcgtcctcttagaagagtgcctgtcgtcatgtagtaaacactcagtgaacgttagttctcctcctggttgtgcacactatcaccttaatatttctgagttgtgagagtgatattttacatgtagctgttattgttgaactgtagttttataaacttgttttcacaaaggctcctcagggcagctctaatgtgtaaccacattttgagtagtgtaccacatgagcacctcccgagcacagtgaaatgacaacctgagtcataatgacacacgggcctgaaatctgcctcctcttggtattcatttcgctttaggaattagaatttaattgatcctcctttgagctgtgattaaaagtggtgttatttccacagccctgccacagtcttatccactgactctacttaaacttctctgttcagggaatggctgttgttatgataatttgttagtagtaggtggactgccacatttaaaaaatctatttatgatgaattcaactttcccaaaggagggttgctttttttttctcctgttgtcagcctccctgggaattttactaaaataaaaaaataaataaaggctttaactatttatttagtccaaggacttggcattaatccatagtgatttcttggtgatattttaatctgtaggaaacagatcagtagatcagtaaattggctaggcaaaaaaaaaaaaaaaaaaaggtgcatttgatggatggaatgagcatttgcagcattatggtagccttggattttggttaagttctgttagcattagtatgcctatttaaaattatatcttcttaaaataaagtttaccaattctggaatattaggaggaattctattcctgtcatcctattactagaatatcttcctatccctcttcatttcttctacctttatacatactcatgttttcagctacggtgctaatgaacacataatatatcctgcttgttaaaacttaatcatgaagtattttttgtattccgaatggtcttcatagtgtttctaacaagtgcatactttgccaaatggacagactgtcattatcctgttctgtgttcagatggagaacttaggcatttgttttgtttttcgtttgtttttactgtccagtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggtaaggaagtttttctttatgctatagatgctatttaatcatggatgtttgctttgggcttttaaattattattacattagaagagaggtcaacaaactatggcttactggcccaatgtggcccagagcctttcttttgtaaatagattttactggaacacagccatgcctattcatttaggtagtgtctatgacagcttttgagctgcaatagcagagttagtggttaccacaggggcctgcaatgcctaaggcatttggccccttccagtaaaagttttcccacccaggtattacaaaaggtcttgtattattacttctgtatttgaagaagtagataagaactcagtttcatcattattttggagaactaacaacttggtttctcattttagatgagtcaaacagagatgagttgtgtgggcagtgagttgagtatcacattgcataatagctaatttctccccacaggcagtgtatggtaccctgaagtttttctaacctgcttaaaataagtttccagagcaggcagtctttgaatgcagggctaagccctctttctgttgagtggctgtttggagttccacatggacttttcttacaaaaaccacacccttactgcagctattaccagttttaatttcttgttttttttaatgaagacagatttagacatttaagaaataatttggatgcagcatctttcttgtatattagcactgtttgtaaacacctggtatgatagcaattttttttagcatcttttataatgtctttctaaagctttcatgtaagtatgattttgtgtataaacaactatgggctattgtttttgcacttgtacttcattattttgtgaattgtttaagtgagataattgcagtaagtgtatctcagtctggtttgggaacagacacaacttatgcctggactggtgggagcagagtgcagtgttgcaccacagacaggatcagttcatggcagcggggatagagattaatcattaatctgactaggagttttaaattagccggaagatctgttaagagtttatgggttttttccgggaggcggaggttgcagtgagccaagattgcgccactgcactccagcctgagcgacagagtaagactccgtctcaaaaaaaaaaaaaaaaaaaaaaagtttctgggttttttcttaatagaaagtgtcattaaataggcttgagttgttaataatgtagttaaaagatttaacaaatctgaagtacttaagagagacaatataaatatgaaataatatactgagagagtaaagaattgggaaaaaaagaatgttttgtagggcatcctcttgggaccattgccttgaggcacagaggggttggaagcaggattgggcacagtgagaagctgagctgcgatgcagtctcaacaaaggcctcagtcagctcctctccatatggtacctttctgccatgtggaagtattacctctaataaccagagggtcttctgggttgtgtggtagagcggcaggacctgttaacgagcactgtcacttggatctgctgtagagccctctcctgctctgggccccacgcaaagctggtggccttttctgtcacctggtatttgggtctcagcagtcctcccaggtatggaatgtgctacccacagatcctgaagagacttagcagtggttctgcttctctctagaagtgaggtacaaggtgcactagtgtggccttcacttgggaggggatgtcctgacgtgcaccaaactgttagaaccctaaaaattgtgctggcactgcaggccctttaattgcatagggcatgggtcttaccaaagaccgcactgtcctggctactcctcgttgctcattcagtctgatagcacgatgcccctgatagagtaggctagtgtggtgctttgcaggtgttccacatttattcagactcttataacagcaggcaggacttatgatagccctggggcataattgtaaatttatacattgttccagcgcaaagtgaactgtttctgatcctctttagtgatagggttgggaaggagcactttgactaaatcattgtccgtgtacctgaggccatgctagtctactttgttaaggaaaaccagcttgcacggaggttacagtggacctgtttcttgtttgagtttccagtagttcagtgtcatcccccaggatttatgtggtttttgcagtggtcaaactggtgaattaaatggagatacgatagagaccatcccctgtgtcctccagctttttaaggatgtcatttctctcaggatgctattttgtttctcttgttctatcttggtgtttagggaggaggatggcgtcaaattcagagacttcttcttggccctccccatgatgatagatcttaacgtcataggccaataattcggtgttgccctgtgccagctgctgagtggccactggaggtcctgggccaggacgccatttaccgcctggcccccatgtgccttgctgtcatagatgagctatgctgatgctttgggtccctgggtaacaacattcatttgaaccccctcttaacagaccctggaatgtttgcacattccccttagcccagtgtacatttcccctttgggagaaggactgcagaagccattgtcaagtacagtttctatagtgtctcacagtccctcctcctagggacctcttctctcctacagtcagtgggttgcaggtctggaaacagggcaaaggatcgtttttattggagcagcggcctacagctccttttacatgcctccttgatttcttttcattgtaaggattgatccagtgcctttgtgggctgcccattttttacatctgtgttctgccctcctcaatttaggacctcagctgtgttgtgtgcattctctcctagctcctgtgggggcatagtgctctgtcgtatactttcttaggggttagtcccttaccttccttagctagcccagtgctttagtggccgagtgtgtcgcaacaaccccagttattggtctagcaaccagaagaggggatggggtgtggtagtgggggtacaggcatgtgctgtgggcagaggtccttacaccatccagatgcgagaagggagttcttactcttcatgggagggactggccacatctgcaggctcaaagagttcaagggaatctgggtaggaagatttttaagggaatctgggtagtcaagatttttaaggcgttctgggtagtcaagatttttaagggaatctgagtattcaagattttttttcccagttagtccttggctttctctgccttcactgtcatgggctgcatgagatgactgtgtctttctaagctcctgaggatgtcccctggcttagttctattttagttttacttagttcttaattggtgatttgtcctttaagctttttgcattttttttcaagtgcgagtgaattttagcagtagccccccaagtcccaccagtcttctcttctgctgtttctctctagttctcaagcacctgatggatcttgcaaggtgatgcatttgcttccactggcactccctgctacttacggttgcattgttgctgtgtgccagtgccgtctgtctgctctctcactggtgtggtgttctcattgtcaaacaggcagatgatccagctctagactccattttagcatctttcccaggctaccctggcactgactgtcacaggctggttcccaggagtcaaacaatgagatgtttttagggcatcctcttgacagcatcatctttgggcatggagggatggaagcaggattgggcacagtgagaagctgagctgctgtgcagtctcagcaaaggcctcagccaatcccacagggttctctggagctggtgggtcttcagagttgtcctgagttggaacgaagaggctggacctttgtagtctttgatgagacattggatgtgggttgcctctgaaaggaggtgtgggcaggggtaaggtgtgacctaagaatgctgaagtgtttctttcaggtggcagaggtagtcattgtcagcactgccatagcctttgcagaaggcagtcttcttaggggtacatctcagtacccccacattatggctcccagacacccagaactgaccttcatcccagctttcccatatagccacttatccacagttaattgactagtactgttaaaatattttgtttttaaacttaggaatatagaaaaggagtagggagtattataaagaactgggattttttgcagttttccaagacctactgtgtccagtacaggagctgctggccacatatagctactcaaatttaaattaatgaacatttgttaagattaataattagtttcttagtgacactacctgtatttcaccagccatatttcagcagccatatgaacagcattgccccacactagggggttcctgtgaccatctacacacatgttgcattcttaaacatctgtcacattcttcaagatctctccttcctgaaacatttgcagacattctgtttcccttgacgtagtttattaggaaaactactagatctttacatgaacatgccagtatttttattttctatttgtatttcagaaattctaatgtctaatagataaagcgtttgagatagaattgagcttctcttctgaaaagctagctccatatatctgccctcattcatttaccttggaaatgaatactgagtagccaggaagttttgtaagcccctgtggatcttgcgtagtcactaattgaaagaagggtataattgaaaattgcacttacgttttgtcacatttgtttttcaaggaggaaagccaagtatctgtgacttcagcagatccagtttttcaagtgccaatttcaaaggcagttcaacttactacgaatgatgccataaaaaccactctgctggtagaattggacatttcagtaagttgcaaaatttatttctcagcacagtaatattgtcaggatgtgcagaaagagttgtgtggtgcttggttatatatgctgagtggtgtgctgcttggttacatatgctgagttgtgtgcggcttggttacatgtgctgagttgtgtggtgcttggttacatatgctgagttgtgtggtgcttggttacatatgctgagttgtgtggtgcttggttacatatgctgagttgtgtggtgcttggttacatatgctgagttgtgtggtgcttggttacatatgctgagttgtgtggtgcttggttatgtatgctgagttgtgtggtgcttggttatacatgctcagaagaatgagaggtctctgacaggacatcttgccattttattcctgacccatcatttttttctctcttctattttcacacctattttctttccacttcagggaaggactagggaagaatggctggaggagattcagcctgagaggaagatgctggcttactcaataagccatgaaagaataatgggatcagaacagcattttatatataagaggcccaggaaaggaagctgtccactaaggtcagccaggaagttagaaatagagcctaaggtcaaacgaggtggctctcgcctataatcccagcactttgggaggctgaaggcggtcacttgaacccaggagttcctgggtaacatggcaagaccttgtctctacaaaaaaatacaataagtagctgggcatggtggtgtgtaccgatggtcccagctacttgggaggctgaggtgggaggactgcttgagcctgggaggttgagactacagtgggctgtaattgtgccactgcactccagcctgggtgacagagtgagaccctgcctcaatttttttaaaaaaagaaaagaaatagaacccagacaggcaggttagggttaattcctcagagcagtggttttgatttcttgagaatctggaaaaaattatggactctcccaaaaaatgattacacttgtcccttagtatcttcgaaggatttgtcccaggacccctttcagatacccaaatcctcaaagctcaagtcccttatgtaaaatgttacagtatttgtatataatctatgcacatcctcccctacactttaagtcatctgtagattacttacagtatctaacaccacgtaagtagttgctatactgtatttttaagtttacattatttttattgttattttttattgtttttttccgtcccaaatattttccattcaggtttggttgattctgagggtggagaacctgaggatatggagggccaactgtatatagaaacatttacgtacagttttagtctgagatgtgcctcgatgcaccccctccatgggcccccttcctaccctccacaccctgctggaatccattgaccttaggttaagaaactgactgataatcctaaaataagtgtttgagtacctcttcaaagtcatttagctcaaccgtttattttatgaaagtcttgagaggttaagtgggttattctttcagaaaagcaagggcacattaaggctgttggtgtagatttaatcaaacttcctaacagaaaaaaatacaatgtgtcaaaactagatggttttgcatccataaatattaatactatgtacaccaaaatattttttattctggtattttacatttttgtcataaagaggcaagggttggtctgtgcttagtccagtctctctcccttgctggcaagaaatgtgagcttgtgtcattgtgagaggctcctccccagagccctggcctgcatctgtatcactctggggcttagaggcaatgggcctagtaatagacttgacttgggaagtggtgactttttcagcccatgtttgctcacaaccagtatcgagccagatagtgtaatgttttatacttaaggaaataaagtaccctttcctgtcccctaaaggaaaagagtaaagtaaggagaagaaaattgaaaaccaatgcatttgaccataattagtttcttttggtcataatgtatgttttcgtgtgtgtgtgcatgtatgtttttgtaagagggatttttatatttacatgggttattgaaaacaccataggaccttactttgtagagaacaaggaaggtctgacttccattctttaagtatgataaaaggcaaaacactgggtaactaccagatttcgttttaatagtaactgctaataatgaaagtatgtttatttggttagttgggcttattttttaaaacaattgtgtgtttttttttttgaaattctattttctgagttcacatattaaaatcataatattgaaaactatatttttgttaccctacagcttaaactatgtaacacgtataatgtattttttttttttcattttggctcttctctagaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggtaacagccctgatgctgtgacgttggggtgttgtgggccagtggactggagctgatggtgagagtgtggctctaaggttcagggtcctgtgtgttggccgcacagatgcctggggctcagctgcgcatcaaggtctgggaacacaggcatacgctggtattggtagtttcttaactttcatgttaattgcactgaataagaagataatggatgttctaattattggacatttgtggacatgaaaactgagtgtaaatgtagtttttgagaagcattggcctaggttatttttaaaaattcttttcctattatgtttacttctcatagtatgtttgtttttgctcatttattatataaaataattgctttttccataattaagagaagttatttatttttcaaaatataaatatattatttacttagaatcttgaagtagtcctaaattgattttttgagaagaataatgctaatggagtactgctgtctttttagctttcatttccttaattttaaataattttcctttcttttatttggcctatcttgaatttatagtcttcttatgtttttgtaaggtggagttttttactgtattcattttggggaatttttttggctgaataaacattgccacaagtcatgttgcactttgatgcgctgtaaagtactacagtaattgtgttttggggagtgtgtaaaacattttattcttcatcttctatgtcatgaacccctttcccgtctttacctgaaaaggagctaccttaccccagcatatacctgcgggatgttctctccagttcatttttacctggtgtcttgaaatccgagcaattcctaaaaaggtatttttttctgtcttcttcaggtaactattttaaaatatgcttagctttatttaggattgattaaacaaatttagaatatgccctttgcagtcttaaaaaatgtgatcttgatagcatgtttttaatattagttcccaagggtgtgtgctatcatcgtaactatcatctatgaatctttttatgttgtatttgcatttaaatttttgttttctattgaaatgagggcttaaatagggctttttcttagtctaaatagggctttttctttgtcttacttttactagttattaactacgtagcacattccacagtgatggaggtgactgcagttgaccttgtgttacccagctacacattgctgctccttctttaattggtgacagaaagctaatgagagcgtaggattccccccaaccaccacttgccacttcctacagttgttaagatctactttgtgtaatactacataactatttattgctgtaacagaaagcttcaggaaaaatggaagggttttggtaggtaataatcaattattatgtgaacttggaggtagaataatccactagatgtcagtattgtaccaggaactgtttttttaaaactacttgtaactgatttcttctaaccagctcccggaagtggccattaatggatacaatttttcaaatgtgccttgccacacttgtattgtcagtgagcataaagagtgttgtaattaggccgccatctccccagtgtggttttcgtgtcgttttattaatgtgtttattgcatttctagtcttgggtgagtaaagtactttagagagaggctcagctctctaaataaatatatgtatatttatatatatatagatttatatatatatatattccatcttcctttcctggtaatcagctcgagatgtaatttgagtatttagaattaatttactgtaatgaaagcttaccgattaagtcacaattttggttcagctctacccttttaaaatttgtgtaaagtgtgtgtgtatgtctgtatatgtgtatatatatgtgtgtgtatatatgtgtgtgtatgtatatatttgtgtgtgtgtgtgtgcatatatatatatatatatatatatatatatatatatatgggttttttcaaaaatagtatgctcattggaaaaattctggatacagaaataacccaggaaaccaaagtattttataatcaaaccctctgagttaacacttgaattttgttttcctgaggaaaatatgggtatccatattatatgtgctgttccataacttgcctttttaacttaaatcaagaatctgtatatttcaggatggaaagagttttaatggatactatggatacaccattatttgttgatgtaattatgggcaattgagtcatttttgctttttcactattaaaaaaggcaaactttcttgtactgtattaatttttgaacacttacttgaagtatatttgtaaaacaaattccttggagtagaattgctgttttaaaaatatttacattttaaattgtagtaatgtttgtcaggtttgtcatcttgttctccaaaaacagtgcagtatttcctgttgtagtaccataaagtttttgtagttctaaagtgaaaaaagtatgttaaaggaaaaattgtcactgttttagcttttaatttaggagattgtattggctttagaatttacaaactgttattggtagatgtttttattatcttgccaaagtctttgcagagatttggggcgtccattcagcagtgtttcctgagtcgttgtttttggtcaatgctgagtttggcacttggaggaacacgtgtaatttgttagtgtccaggtattttagacagagattcttcagccaaacctttggaaacctgtgactcctttgggaacagtgattttgtcctccctgttaaggaagtccaggacacaatcatcttgagccatggaatttaaagtagcagtacccattagcatttcacataacatttgatgcagataattactgaagtgctttgttcctaaagagcccttgagaaataagctatgtctgcctgtaattaataacttgtaattgcattgaaataaaaaattcttactagcaagtttgatgttttgttcaggaatttagactttgagaattgagattcagaattttattagttttatttatttatttatattgtggaatttttctaacaggtcaacattaaagcaaatggtaaattaaattccctcctcctgacaatagctcctagtggctttctcattttttcttgggtaattgggtgcatccctaggcagacatttaactgaatattctaatagctctacccacaaattgtgtcacaatttaaggcgggctcctttttgtaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcggtgagtagtcgctttcacaagcaccttggtggctgttcgtgcactggtaggcgggccacctttctgtagtaaagaaaatttgctgctcttgtcttaccctttgtatcctatgcctaaagaatatatctaaatgaatggtggtgattggtaagtaaacatcttatatcttgtcttcagggtgctgtgacatctgtgtgcccttccagaagtcacagaattccccttccagacttttggttttcttttttttccttccagcagtgtcactatcattttctctcttaatagagtcagttgttactctctttttggctcagaattgagcatcttttctaatttaacttttttcagaaaggttgtttagctaaatgtctaaaaatgagcttcctataaaattttctttttcaaagctaacgaacatcatatttaattgaaagaggctgatgcagtctgtgctgtgtgcagaatgcagaaatgcccccatctgagcaagtccagatcgagggtccttcaagagcaaaaggggactgtgtcgtaccagtgcaaatcaacatactcatggtactgccaggcagagaaccatcatcccatttcagatgaagagtaacccatttttttgcccagagtgactcttctagtcctcatactccaacagaagagacctcagcattgtccctgagcagtcgatgtcctaggacctctctgtggctctcaggaagggattgaaaatgcttgctaggggtgaagactaagcgctttataggacttcaaagcctttattactttcttgtgcttgtaactttgtcatctcctttcccatagtggtaagtagttatgcctttaacatttgcatttttctttggtgacaccaaaatgtatattgtcctttttactcttgggccagcaagatccttttcgatgcccagtacaattaaaggcacccttctttgcaagtcagggcctgatttctcctcctttttcttagtgttttttccacttaggacctccccaaaatgctaagaccgtgttgctgaatgaggctgctcttctcaccatcctgtcctcaggctggccctctcaccctcttcagtgaagtcttcgagaaccatcagcaggaataggatgacagaacacagggtggggagttctaagtagtattagaaagttctcttatcgcatactaatttatttcaattcttttcgtagattttttgttaccttttagaatgttagaatgtttgtaacaataccacattacgtagttatataaaaaaattaaagtcattgggacttataaaaaattatattattttctaattaagaacaattaaaatatctaaagcttgatattaagttgaacaccctactaaaccttattttgatgtttaaaactctacgccattatacatagaccttttcatattttcaattaagtaactgctaaaaataaaacataccaaaacataaaacatttcaaagtttattagtggatagttcaatatttaaatacagattatttaacctgcttttgaaagaatacctacgtattttgaaatcactgattttttttgataaatttttaaaaaccaaacactttaattattttaaatgtaagatggaaaatatttcaagcctaagcattttcagtaattcttgaaagagtagcctttaatctttttgggatcatgactttattttaaatctgaaaactgggcacctccctgcagaaaactgcgcacctccctgcagaaaactgcacatatacctagtaagggtttgctgagctcctcacctctgaagccaacttatggacccattcctagaagcctttgcttttaaaattcgcctttgggtagaaatactgatttaagagtaagaaaatgcatcttatctggtttttaactttaggagttgaaagaaaaaatagtaatattttacttgaacacaaagttcaagtgcttaactatgatttaaaactagaacatgatttgagtattctaaataagacatggaatttttttttttttttttttttttaggtaaggttattttcagtagtagtgaattaataattgcttgtttttatttttttctagaacatcttcctaaacttcaacccagaccatattcgtgtgcaaggtactactatttattcacgtaatatatagcattgtttctccaaaatcttagactcaggcttccagatcattagagtttactaatttattcagtgaaaacttacctgctttatggaagacagtaccaggcataataaagcagaagaagaatcatagagctcctgtcctctgggacttcatagaatttaacatcttgggtggcttcccatggcccagtactatgtttccccacttaggagtctcaggctcctccacatgcttcctgtgtccgtgtgcccagccaccttcactgagtggcagccggaggcaggggagacagaaaagttccactataaaacatttgatgagtccgggcgtggtgactcactcctgtaatcccagcactttgggaggccgaggcgggcggatcatgaggtcaggagatcaagaccatcctggctaacacggtgaaaccccgtctctactaaaaatacaaaaaattagccgggcgtggtggcaggcgcctgtagtcccagctacttgggaggctgaggtgggagaatggcgtgaacccgggaggcggagcttgcagtgagccaagatcgagccactgcactccagcctgggcgacagtgataccctgtctcaaaaaaataaaaaaaaagaatatttgatgagcactggcttataggattctccctgtggccttcattccattgcacagcctctaccgttttcccgtctggctctctgttttgcctttcagtaataatacaagaaggtgcaccattcttttggttgaaaggggaattaagaatgaactcaagttctttcgcattatttaccgtgtaatgtgaaaagaaatctacttttgtagggatgtcttttaaagatgtttttactttgaatttttagttttctcctttctgggtgtatacttcagtcactttcaagttttatgatcttaccagtagataatgtatggatatttgttagaatttatccccatttcttcacatctttataataaatattgagtgaatgaatcctttacatgaagatccttagggcatattagattttataaatatcatctagtcctagtgcaagcaaataaaattggaaactttcttgaataacaaaatgtagggtgtgagagtgtgaaggttgggggcagtttttaattacgtaataatggctttcctctgtgaggatttggaaggtagattagagcctataaggaaatatttctaaactgaataaaaggattggtttgacccatatgtgtagtagtactgatatcgagttcaaaacttgtctgtgtatctttgcagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaaggtaagaaattagtaccttaacctcagcattgttaactcatactctttgtttcattagaaaaaacagtgttgtctcacccacatcattcattactgtcataagaaaatttatgctgttcttgaattttaaaatctctattgcaagagcagaaaactgtttacttccatgtactctttaactagtgtgtgtattttctgaatgtataaagcatgaattttatatagtacggtctttgcttgtcctattcatggaaaagaagaccttttatgttgatattcttggtacattggcctggggaggggtggagaactgtctaggaagtatttaaggggggtgatgagagacagtctcattttatgtttaagatgtatactgcctctcaaataagtagttttacattgggagtctgagggcaactaaagattaattttatattgtccaattttggctagtagggtccccgcatccctgtttttctgcttttgttatctgtggtgtctgacatctgaacttgtgccattattgagaagacatatggctgtaaatacttttacaacacctaggagtaaaaggttatgtgattttctcaacagattgtggacactttacacttggactcagtgacatctttttatgttttgatacggcactcagcagaatttcgagaccacgtgtgtaggcaacagtttaaagttgtccacaagaatggttgaaataaagcaacatttcaggctttatcatgaagtcctctttcttcatagtaatgaagaaatcagtgattcacttggagtgttgtcttaggagaagtttggtttctttattagagttgaaaggttcatagacctcaatagtggggattaggacttcttgggatatacttgagaggataagggatgattgctgcttgaaattgccgtttaacttgatgtttttccagtctgctgcctggaacagagagatgctttattgtgttctctatacatcatgtattcattatacatcaaaatattaggaaccttacagaaactttcttttttgagaagaaatattatagtactgatatacaagtatatgtcacttggtgattgtataaagatagcagatgatctccagaacattaaaaacaatgtgtgtccatcatgtatcgtaaacactaaacatgggtgcctttcacctactcctcctttcctccctccctctcttcgtccttccttccccattttaacagatttttattaactatccaatctatatgcagtagaagtgcagatatgaaggatataatttaaaactatctgaaattacctgtgcttgtgttgtgttttattacaaattatacagaatgttgacttttgcaagacctatcacccaccctgccctactatggcggatagtacagttattcacagattaaccctgccactgatgttcagcctggctgtgtgaacagaaggacatctgccacatctaagcaggagcactaagcctgtgggcgtggtgtagcttggctctcttcttcctatctgccatgatattctctccacatagaccctcaagtgaagcagtcccacagccttcgaggaagagagccccagaacgtagaaagtgtgctgttgtcacaggatctttgtacatgtgtttttcttttctgccaggaatatgctctggcatggctaactcccttgattcagatcgtggtcaaaggtctcattgtagacatgggccttctttgacattggtgtttgaattagcagctcactgccacacccatcatttccttatcctgtgtaattttgcttcctaagacattgggaagtcattacccatcattctgtggatatatgtgataatgtgtatgtttattttcttttccttccactagaatgtaagttccgtaaagacaggggcgttgttttgttcatttctgtatccttaatgcctgtcatggtgaatactttcagtaaatctgttaaatgaatgaagcaaagaaggctaatgtaatgttaactagtttcattcccaagtaagagcagtaatgagacacagctttgccattccttcatttaaaaggtatggtgttcaggctcgtcattacttcctacagtcgtccttgagttaaaagttaaaatgtatacagttacaccaccatgcaaggtggaggggaatcctgtcattcttaaatcttggtatcagtatgacttttgcatatgacagtgaaactggaagtgaaacatactcagattgattcagaaatatcttttgaaattttaacaaaaagattttgataattatatgatttgtttagttataacaaaaataattctgggtaatattggacccagaatagcaaatacagcaccattatctggaatatttggagcagcccctcaatttctttttaaggtgcctgacttttatttaaaatttttcaacctcatcgtgatgctaatctttattgtcttcatatttagggtacatttctccataatatatgctattgtctgcccaccagaaagcagatcttatccatagaccaagaaacatgatttgattatctatttagagttctacctcaaagacaccatgcctatcattttttacaacattttttatttgaatagaaaagaaaaatttgcaagacaaacttctttctgtagtgacaaatgtgctcatggtttcaataaaatctgatgccactatttagtgatgtttctttgatgggaattttccctttctgatttgtttagcaaagatcatcttgattatatactcttgcctaggttttctttcatacttaccacatttgatgtaatatttcagatatccatctctcctcgaacaacaaattctttccacttaccagatgacccctcaatccccatcataatggtgggtccaggaaccggcatagccccgtttattgggttcctacaacataggtatgttctttttttggctaatgggaaaatgtattcctgagtaaccgtttttgtttctttagtcattttgaggataattggactttgtaaaatttttatttaaaaaattattattcaatgtgcgataacataatttgtcaccatgggaaaagtaaacacaatgttgtagagattgtgctttgtactagaacttccttttttactgtggcacttttagttttttcttttctcagctacactggtttgtagcatatgtggttggggacaaatattgggcataccttcgtactgtgatgatatacagctgttgtatctatcccttaattggatacaattggtagtgacagagatccaattttagtaaaagtttcaacattaaactcaaacatcagtaattttcaacagaatgttaataagtttaacttcatatcagaacagaagtatttgatatgaaataagtaaaataaaattgtacttctgtttatatttgtgaagtaatgagcaagtcttagatactatttgtcagatagtagagtcctgtccttcggacagttattttatttcgttttaattttttccttaagcaaaagcataatcacagatgtctctgtctcatcagtgtgttcaccatttcgtagacactttacacattctgcctttaacagccctgagccacttttccatagtacaagttcatttattcataaaattgctattaatgttattgaatgtagagctctctctagatctcacagtgtgatactttgaattgtcctcattttgtgtatgtcggatgtagctgcctctccacacacttgcctagtgtggcatctgctcgagtggccatgacagcctgtggagagtaaaatgctaattaaatgactgaatgttcaaatgcagagatggattttacaaatccgtctgagtttgttggtggtagttcctaatgaaagagattggttttacatattctttatatcacacacctaaactttttttttttccacttagagagaaactccaagaacaacacccagatggaaattttggagcaatgtggttgttttttggctgcaggcataaggatagggattatctattcaggtattgtacaattccagtattgtactcaaccactgagtgtacaattctaattctcagactttttcagcttgacaaccttttagtgatccattatatattatatttcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtgggtgagtcattatcgtgcctaagtcgggtaggagagggccatcagtgatgtctgtagaagaaaaaaaggaccgagaagccaataatctagatatgtagggataagacatttgattcttaagtacaggaatagaaataacagttctgaaatgattttgacatatttaatagcccagaggttgttattatcagggaaatagtggtgaaagttaatgcttgcattgtacattcttggtaccatttacttacctgtttttagcctctgaaaattacactcatgttactacattaatcatgtgacttgaaatctccagattgattttgttatatataagaataggtgatttgtgctgttgtgaactattgataagtaagaaagaaaaagtatgatttttgatgctgagaatgtggatactaggattctttttctgctaggcataattcttggtgataaagttgaaacgttctgtgttactgaatttgatctactttctgaggcaagatctgttacaggaacccataattgccatagaaaaattgtttaacgcttatttgcttattttgataagactcaaaaaatttctgctagttaaaaaggagttttgaagtaagaaattcactttttcatccaaacacattcctaggatttaacacattctctaagtcaggttcttttttttttcaactgtaatgtagaagacaaaatactggcatcgtgacccagaacatatggataaagataattgaaacaagtttcatgaaacaaagcaacgttttctgtttagtttttataacacattctgatcatttctcttccattttatttagtttgctttaaaagctagctttggctactaagttaatttcatgtcctttcaatagattttgactcctaattgaaaaacattgctttaggtcaataaagggcagaaattctagacattgttttggtttacattttccttcgcttttaatgaagtatttaatctgcattttgtttggcgaggacagtgtcatcggtggtcaaatacaggctggagttttagagatgcacctctaaatagtagaggcagagttcattgtacagatcacagatatctggtcattgagaacttggagaatatcttaaatgtccagactcctaaaacattattccagaaatagctcctcccaatcactggtgctttactttgtcacatttgtgaaatgcacttggaagcattaatagcagtggtcagagggctcagaaggaaaccctggggcacttgaacattgatcgtccgtcagggaagcaggaacaaagtagacagaaggaacagccactgaagaagcaaaattgtcccaaagccaagagggtgctgtttcagagagggagcctgtactgctgatgagtcaaatgagaagacagcggagcaggatcttggggtataagttccctgagaatagtggagaggagagcctcttgagacaggtgagacagacacctctcaagaaatttcactgtgaggggccaggacatgttcagttcctaacatagtagagtcttgtctgacacttcgcttcattcagcaaacacctgagtgctggctaagtgcttggggcatattcagatgtcgatagatacgaggatatattagtttttctgttgaggaatacctgagactaaagaaaagagatttaatgggctcacggtttaggctgtagaggaaacatggtgccggcacctgcttctggtgaagaccccaggaagcttccactctgacagaaggcaaagggggagcaggcacctcacacggcaagagagggagcaagaggcagggggaggtgccacacactcaaatagccagatctctcaggaactcagagggagaactcactcattacagcgagcataacatcaagccattcatgaggcatctgcccccatgacccagacgcctcccaccaagccccacttctaacactgggaaccacattttaacataaagatttggagagggcacacatccaaactggatcagaggataagtgagttacacttcctaccctcaaacaacttactccctggtgagaaagctacatataaacagacgtttctaacgtcggaagtgttccagagaggactgcaagagcacccaggaggggtaccgcccccttcttgtaaattgaagagttaagatgtagaagcacttcaaaaggacctggcacatagtaagtcctcaataaaggtgtctgttactaactgtatgtgtataaagacctagaagtgtgcgagagatctggttcccttcaggagcacgagtctactgtgtgctttgagagtggagggcagggaatgaggggtgagccagcaggtgggtcggagccaggcaggacctcagatgcttctctgacacctaggaaatccttggcctactgtcgggacctggagcctgtggaggattgggagctgtagaaccgtgtggtcagctctgtctcctagaacagtcactgtaggcaaaggcctggcctgggcatgagtgaggctgggagatctgtgtgagatgttctgagaagacggagggaagaactatggtggtacagtcaaaaggaattagacttgtgaattaaggaggatttactaaaaatgcctgtttgtaagcagtcatcttattattttcttttctagagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttatatgatgtatacccataaagaatgctcatattaatgtacttaaattacacatgtagagcatatctgttatatgtttatgtaactatcaaatggttatttgttactaaagctatatttctgataaaaaatattttaggataattgcctacagagggatttatttttatgatgctggaaatatgaaatgtattttaaaatttcactctggcatatgatttatctatcaccattacttttttttaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaacttggtaagtttttgtggctgtgtaatctcttcattattatatattttataatagaaaccaatctaaaaatatgggataggaaaatatactaagcaagtactatgtaacatacataattacatgtgtaagttgtatgtatcagccaagatacacttaaggtgaaaacattaaaagagacaaaaatattccttattaataagatacaacaatcaagaacttgtgtccacctaccaatactgtctataattacatgacccaaaacttttatctataaaaagaaactgacaaatagtcaatcataacttggtgttggaaactgacctaagccaatttgcttatacacagcatccaagttatgtctagaaactgctggattatctaagttttaggtgggtatcgttcagctgctccccgcagacttacgagctagtgatagtgaaaatacatttcatgataaatgctgctgtacatacagatatgtatttattatctatttactagttatttttattatttattattatctatgatttattagtaatcaggcacaaaacagctctactatcctagtttctaagcctaatgaagttccagctgtctctttaggcactccaccacatctcgcaggaagagtttactcaaggtgcgtcacaacgtggatgtgactgctccaggggcaaaattttgtccttactgtgaaccatcctctaacctagtgactggacatgctatttcagagttaagcctcaggcatcaccctagggccttgctagataaagtctttcaccttgcttatgtaggagtagggagtagttagcagtgagggaccttttctaacctgctattctaacaagccactgtagcgctcattatttttaatagccagtcttcatactgatcagtgataaaattaacaaaagagcttgtagtaggcagttctgcaatgtgacatttctgattagaatgctcactgcatctagagggttcctttctgtgcttcagacttatacagtgtttgtggattattctaaagtgagttacactgttgtactgaaacaatcattctattgagtcataaactaccggaaaaaaaaagaatttggatttcactgcaaactatatgacatatatgctacacccaacaaactgggcacccatgttgatttcaaatacacttgaaccattttaaaacattgaccatgaactaagccataaaggaaaactcagcaaattacatgaaataaagcgttgttcactgactctaataaaaaaccaactgcaaaaaaacccacaaaggccacagtgaaacattttaaacacatgcagatgattcatagcttaaattattaaatgtgcacatggaattcaggcgaaacaatacccagggggaggattcatctatttcacaaagtactgtgcacccagtgaccaaaatagttaaaacaccattgttttcagggagctttacattgaggagagacataaaataaaaaatccgtgaattgcatggggtctgagaaggtgataaaggctatggaggatgacaagtcagagtaaatgggatgtgtggcctgcagtcttgtagggttggtgtgacttcatactcagggagtctctgaaggtaaacacttgaaaaagacaaaagagccagccatcatgagtatcttgtggagggaagagtcagaacgaaggccctgagatagaatggttacaggaaatgtgtcttaatccagaccccaggagagagtttttggatctcacacaagaaagagtttgggacgaatccataaagtgaaaacaagtttattagagaagtaaagaaacaaaagaatggcaactacagagggcagctccaagggctgctggttggctatttttgcggctatttcttgataatatgctagggtggattattcatgagttttcccaagaagacggggggatttccccagaactgagggttcctcccacttgtagaccttatagggtaacttctggatgttgccatggcatttgtaaactgtcatggtgctgctaatccattataattagcgtatgatgagcagtaaggactaccagaggtcacttgttgccatcttgactttggcaggttttggctggcttatttacagcgtcctgttttatcagcagagtctttacaacctgtatcttgtgataccagtcctgctgccctcctatcatcctgtgattaagaatgcctaacctcctgggaatgcagcccagtaggcctcagcctcattttgccttgccccattcaagatggagtcactctagttcaaacgcctgtgagagaactgccagacaagttggaacagcaagaagggcattggatattgagcagtgacaaagggggaaactagtaagtgatgacgacaggagagaaatggggaggtctgataatggtttcagatcgtcataggattttggcttttactgtgaatacaaatccatttggtcagtgttaacagtggaaggtatttgagttaccagcagtgaatctgtatgggtctgcagcaacctcaattcttgcctctaaagaaagaattcaactgaggggcataaggcagaaaaagaccaaggcaagtttcagagcaggagtggaagtttatttaaaaggctgtagagcagggaagaaaggaaaggagagaatgcttggaagagacccaagctggcaccaagatcaagtgccctgtttaacagtgatgctaggactttataggatggcacttttcccacgattctttccttagggtgggctgcccgcacactcagtgcctcccttacccttgggaagtgagcacccgctgtgtgcttaggaagctgtgcacatgcccatttttaaaacttaaaccacaggctttattccgacttgacttttcccaccaacatttttccattccagaatttcatccaggacatcacattgcatttcgttttttgcctcctgagtcttctccagtctgtgacagtttctcatcttttgttgtttttcatgaccttgaaggcccctggtcaggtattttgtaggaggttcctcaatttgggtttgtctgaggtttaaacgcacaattacactgggtttctgggttttgaggagagcacactagcagttttttttttttctcatcgtttcatatcatggagtatatggtataatatgattaatcactagggatctcaaccctgatctctttggtaagatggtatgtgccagtttctctactataaggttactctttttcccttttcatatgacattgtttggaaatgagtcactaagttcagcctacattcaaaggaagagaaattaagctccacctcctggaggggttactatctacatgtataatttgtaattcttttgcaaggaaaagctgttccttctcccaatttagttacttattttatcatgtatttctggaagtatggactcatggatatttatttaatactttgggttataatataatactgtattacttattttattgctcaaatgatcatatgtgacgtctctcagggtgactgttgtgttcctttgccatgctctccttttttgttggggaggagggccaagccattttactaaggagaatggaaagggagacaaagaagcgctgatgacagtgagatctgacatccttggctgggccagaatcttaaaggctttgcagttgcagaactattcctgttttttaaagtttcacgtatgtatgagtgctgtttatacatgatgtcttggaatatgtatcatttgtttcactgtttcagcacttcgttttttttggtagtctaaaatgctccaggttgcccttgatttttacctatcccagtgttaagaatgaaccatttctccagtaagtcacaattccttttatcagagaacccctgacaaccacttagctattttccatgcttatagttttgccttttccagactgtgtgatacaactggaattacacaacattgagctttttgggtcagacttatttcacttagtgaaatatatttaaggttaacccatgttgttgtgtgaattgatatctggttcctttttattgctcagtactattctgttgtatggatgtacagtggtttatttatccattcgtttattgagggaaatcttggttgcctccagtttatgacaattatgattaagctgctgtaaacatttgcatacatatttctgcatgaatataagtttttaatttacttggataaatacatcagagtgggatttttgggtcgtatgctaagtttttcttttaatttctaagaaactgtcaaactgttttctaaagtagctgtctcattttacattcccatgaacaaggaatgagagttcatggatttgtttttgagagacctttttgaagagttcagcattgttagagtttgctttggtgcagtccatgtctccagtccctgtgcatttaaacagtagattcaaaattaaaatgatagcatagaaattataaacaacacgaagaaatacaaatggagttactttagttctgttattgtgtgtgtgaccacttgaatttttcctcatgatgacttttgtttaaacatttggaaaacatttatttctttcagtctcacctcatagatgaaaaatgcttcagaatatagttataactgtgaaaagactgttcctgatgttatgatttgctcactgtgaagcttttcatgcactacagacaaatgttggaaagtctgtctcaacttcaagggcagtgaattctgaaagttaatgtggacacaagagtttcttctcagatttcctcctctgctgcattttttttttgagttatcttcttttctggtatgaaattgtaaatcaagtaagtcagatataaaaatatttgcaaacagtcaaaatcaactctaaaagtgatgtagtgaaactcaagctttaaaattgttccttgaagagcagcacacaaaaattgtgtagaaaattattaactatgtaacaacaacaaaaaggtcaatgacatttagacagaaaaaaaaaagaaatttctgggaagaatattagggaaaagaacaacaactgctggccttgcagcagcagaaggaattgcagggtgtgttgaatattttgattatttccaccaggaactagatacttgtaaagcggtggattaagcattctcaagttccttaatgtttagcccattttctcatattcttttagcagagaagaaaaactttagaagctttcacccagtgtaatagaaacttatgatgaattttctggtgaaaatatcttaggggaatttcttctattgcagagatgtttgaaaactattataatccatcctgaagaaagaaaaacatgaacagtatttcaatttctggagcttattgtaaaatgtgatttttatgaatctctgaaaaactcatcctcgtacttaagactttttccaagtcttcatacatctatgactccacatgaaaaaaacttttcaaaattaaaatttaagaagtttttcaattcgagtgaagaaagctgataaattctcttaaatatccatagaatgtgaatatacaaaaattaatttttgtaaatatgcagaagttacagatcaaaagcagatactataatataattcgcagtggtttaagaccaatatgtaggtgtaagtttcccttgttttcccaaaaaacacattagtgcaattaaaaagaatttatcgctttttgtctttaaaattttttaaatttatcccaataaatataaattttgagggtatatctgctaatttaatacctttatataatttgtaaagataaaatcactgtaactagaatacccatcaccttaaatattggtcttttctttatgctagaaacattcaaattattcccttctgactattttgaaatatttaatagatgattgtaaactatgctaaccctactgatctatcaatcactaggttttatttattctaacaaattgtatatttgtccccattagtcaaacctttcttcatcctccccttccctctacccttcccagcctccagtaatcaccaatctactctatatcttcatgagatccacttttttttagctcccacatatgagtgaggctatgcaatatttttttaatttccttcttaatttcttcatagacccattggtcattcagaaccgtgttgtttaatttccatgcgtttgtgtgctttccaaagtttcttttgctattaatttttagttttatcctattgtggtctgaaaagatacttggtatgatttatacatttttgaatttgttgatactttttttgtggctattctggacttttggggtctattctggacctctacatgccagtgtttttatttttatgaatctattatagattttgcattgtagttactatgtggcttacaaaaaccaacttatacatgtaaaaatttatttcaaagaggtgaaaacttatcttagatcacacagaaaagaatagaaaaaatgaaaaaagcctatatacttcatcccccagttttgactttatattgtctcaattttcatatttttatactgcctatttcttaacaggttgctgtatctattattgttttgatagacttgtctttctttcttcatactagaattatgaatggattgctcaccataattgcagtgttagcatattcttggttttccgtgtacttaattctatcagtgtgtgttatacttccaaatgttttcttttttcactgaagtgtttttatttattttagattgaagaacaccttttagcatttcttgtaagatgggtctcttggtgaattctctcagcttttgtttgagatatctcattcatatttgaaggattgctttgctggatacagtattcttgaatggaagcgttttttctttcagaactttgaaaatgtcaccccactgtttcctggtctgtatagctttcattaagaagtctgttgcccaatgaattggagtttctttgtacattgttgattttgtcttgctgcttttaggatcctctctttttctttggcttatgataatttgattgttatatgccttggagtagttgtatttggattgaatctgttttgcgtttgctgacctttctaaagctggatatttatccctttcttaagttttggaaagttttctgttattatttttttgaataagctttctatcccttgctcttgctcaactccctcttgaataccactaattattagttttgatcttttcaggtaattttctatatcttgtagccaatcttcatttgttttcattattttttctcttctgactatttattttcaaatggtctgtcatagagctcattgattatttcttctccttgacctgatctgctgagagcctctaatgaattttccatttcggcaaatgaatttctcagttccaagatttctgtttgactttttattatgattatttcaatcatttagttaaatttctctgataagtttctgaattgcttttctgtgttatcctgaatatcactgagtttccttaaaactgccattttgaattcttggtcagagagttcacatatcaccatttcattagggtcagttgccagttccttgctttgtccatttaggagagatcatggttctctgctattgtttctgttggatgtacatctgtgtcttttcattgaagaattagttatttattctagtcttctctgacatttttgttttttattggatatgttttcttagagatcctttataatttaccttttgatattttttctttttttcccctactaggttgctgctcccttttcagcagtagatgacaccttaagaccaagtttgccttggttctagtaagcaatcagagtaccacctatctcaaatcagaaggtttcaaaggggatatcccagtagtatgagaaggctgggggttcatgcccagaggacctgtgaaacaaacctcttacagcatcatgctactgaagagccactctgatttagtgttttagttggccaaattacagagcaaaattttcaggcctagggatggtagttccaccttccctctttgtctctggctgttctcagggatatttctcccttcagacactactgatagtttctgtgggcaaaagggaaaggtctcctactagggtgccctgaatggtggggaagctgattgtccaccttgatgtcacttttttcagtgtagagactgtatgttgagggaaaattttccacatgctttgtgatgggcagattgggtggaggggcattatgaatatggaagtctgattcccttactgtctgcttaaaatttgttcaattctctgtgattccaggaactgtctcattctcatctgagtcctggaatactactggtgataatcttggcactgtgtatttgtttctgggtttctgtggggaggaggtaatgaggccaacttgtttctacaccaccattttggaatgggaagctttcatttaagttgtaatacttattttactttttatttttaactggaatgatatatacatagatgaggttcagtaaaacttttttttaactgactgtaaacatttttactgaccgtgttttactgactgtgctttttaatgactgtgaacatttttactgtgtttattttccaccatcattaatatatgtttcattacataattactactgaaaagaattttgtcacataagggatgtgataaaccattatctgcttgggtttcaaatgtgttatggataacactgctgaaccaaagcataacttttgaaagaggaagtacatgggatcatcataataaataatacagtgtcctgagtgatgagctttctattatgctacaggaagaatttcattaaaaataataatagaaaaacatttaaaaattttaccattttattaacattctatatttttctactccgttaaaatgcagaagtcagaaaatggaacatttccctttcactatttctgccattaaaaaaatagtacattttcttgattgtttgtcatcttaaactacctttatccttttgcaaggtagactcttcagtatcttttttaatcacaacagattagaatatatacgatggtacttcggaatatatgaattacattttaatttctgaatgtttatcttatttaatgtcaaatatatatatgtgtgtgtgtgtgggtgtgtatgtatagtacttgtatggcttaaggcttcaaatgctactcaaaatagtatccacactaaatcattttctctgaaaacactccttcctgtgttttgagctgggctctgggtaaacaaaaaaaggagtaaagcttaataatgtttcctgtatctccagtctgctggccttctcgttcaaccaagaactttgatttgcagatttggtgttaacagcctttgtaacattgtcctcgttttgaggaaattattaaatctttatcaacctttgtaattgggtaggcatgttaacctaaatggataggaattttgatagtggctcattagtttatttaataaaagtgtttaaagctatatctgacacaaaataagtatttaaaatgtatgagtatttatgctactgttactgctattactattactactatcacttctacaaatgttcctggagaaacaccaggttgatgggtgtgctctgaattttggagaaggatttaatgtacaacaaggtcattttgatgtgtttttagttctcctggcaagtgcccagctcatcacatggttccagagcagacatctgtctccatggtcctttattcagtagcagttaactcagcacctttcacagctttaattcattttctaaaggttaacaggcaaagaacaggttcagaaaaggtctaaatcatgtttttatttttccaggtggatgactttaacaaaagatcatgactccattgtgtataagagcagttaaattctgcctttgtttcagaaca

SEQ ID NO: 1148 - DNA, 41280 bp, Homo sapiens
cttgtgtgttccttactcactcacctaatatttgtggagcacgtattatatgctaggtactttgttgggtgttgggattatagcagtgaataagacagacgtgatttctattgcccttagcattgacaagctattggggaaatcagataattaaagagtattataaaatatggtgagcattatgaaagaagctcagggggggcagaataaataccagagggcctaggagctgtggacaactcctttgagaagttgacctttgagcttagacttgaagaaagagtaagagttaatggttggggagtggaagagcagtcagggatatttgagctagaaccaatgggactcagtgatggagtgtagttagttagagggaagaggaaggagtcgggcatcaattcttcatttcaggctggggcagctgggtggatggtggtgccatttcctcaaatagcagacttaaaaggaggatctgcccaggaggagatgttgagttcagatttggacacaatgagtttgaggtgctacatgtgaagcatccagacactgagaagctcaggagctcaggaagagaggtctaagatggagaaaggtaagaaccatcaacatggtaataatcattagtatcatagttctgatatctagtagctaattagggtactttctgtgtgcctggctttgtgtgcaccttaaatactttatgcacattaactcatttagtcttcatagtaactgtaggaagttattactgttactatccccatcttacctgtgaggaattgtggacacagatgaacttgctcagggtggcacagctcagtaatggcagagctggaatctaaactcaggctgactttagacctgtgcccttcaccattgtgctgtaatgtctcccgtaacatttgaagccttaagaacggataactggctgcgcatggtggctcacgtctgtaatcccagcactttgggaggccgaggcgggcggatcatgaagtcaggagatcaagactatccttgctaacacggtgaaaccccgtctctacttaaaaaaatatataaaaaattagccgggcatggtggtgggtgcctgtagtcccagctactcgagaggctgaggcaggagaatggcgtgaacctgggaggcggagcttgcagtgagacgggattgcgccactgcactccagcctgggcgacagagcgagatccgtctcaaaaagaagaacagataacttcacctgaaagagaatgttgaacaagaaggtgtcaaagatatttgctttttaatttatatcatcctgtattgtatcatttttatgtaataagcattgttcatgtgtcacttgtgtaattaatttttaaaaatatttttatagaaaaagggtagacccaggattagaaagtgcatcagctccatttttctccttggttaagtctgtcatgatctcctacctttgtgtttgtcaacaaagatgattcctgagcttgtaagatggaggcatgagatctcctccaaatactttaagtccgtagagcacataagaggtaataaataactgggccgggcgcggtggctcacgcctgtaatcccagcactttgggaggccaagacgggtgtatcacttgaggtcaggagttcgagaccagcctggccaacatggtgaaaccctgtctctactaaaaatacaaaaattagctgagcatggtgatgtgtgcctgtaatctcagctactcgggaggctgaggcaggagaatcattttaacccacaaggcagaggttgcagtgagtcgagattgcaccactgcactccagcctgggcaacagagtgggactccatctcaaaaaaaaaaaaaaaaaattatagccaatgtgatggtgtgcacctgtagtccctgctactttgggggctgaggcaggaagaacctggctggtcgaggctgcagtgagctgagatggcgccactgcagtcaagcctggggtacaaagtgagaccctgtctcaaaaaaaaaaaaaagaggtaataaataactgattgatttgtgcctcctcccttatacatcggttccttctaatgactccatctcttccaacaatccttgtagcaggcagcatgtcagtagttctgttttgtgtcttcacctagggaaaccatgagcgtaaggcagaaaacctgaccatggggatgccccaggaccacctttccctgtaggaaacagtctagggagaggctgtcagagacaggaaccactgagccgctttgtgcacttctccaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaaggtacgcaggatctgtgtttgggttggggctagtaggcattgaagaccaaatagtgaatttctctttgggaagttaaaattccaaaacacacatctggagccacacttctgtctccagctgttgggtggagtacctaaagctgtctctgtcaagccaactaggcctaatagtagtcacaatcggtattaaccaaccatatctagcattcctacacatctgtacccatgccttctttaaagccatactattcatatgctccggatctatcattcataacctcaacaatgaataagacatccgaaaaataggaggactacttaaaattttacccctcacttcaacctccagccttcagtggccattatagagcagtgggtggggaaccctggacagccctcatgatgggaccactctccccctgtgccacagtgtcgggagctgtactactgtgtgaaggacagcatggagcgcgctgccgcccgacagcaaagcatcaaacccggtgaggagagtttttcctgagagtgtcttccctgtttctaccagtccttctgagtgtcaggggcctggcagggaagtcaggggtgggattccccacctcaccagtgagctgatagccccctccctcaccacaggacctgaattgggtggcgagttccctgtgcaggacctgaagactggtgagggtggcctgctgcaggtgaccctggaagggatcaacctcaaattcatgcacaatcaggtaggtgcgagcggcagcacgaggctccctgtcgttccatctgtaagaaggaccaatgtccaagcccccagtacttccccagcaagcatgagagagggccctctggagctagagggagaactggagcagctggacccaggaaagaaaccccaggggagggcacagtgacgttggcgaccacctggcgctgtgaaggtgcaccagggagcccgtgggggaggctgggcaggagcgaggccaggtggccacgctgccccatccgttggactccacacagtgtgagtgggagcgtctcacttggcccttcccctgcagtgtctctgccttcctctattcccaggatatgcttctgcttggtggttttgctttgagagtctagactggccgatctccttgtgtctttctggtgtgcgtgcagcttgcgtgtgcgtgcgtgcgtgcctgcgtgcttgtgtgtaagtagcttgtatctgtcctctctggagtgtgtttatttgcctttttcttctgcggattcttcttcctgttcttttccttcctctgagtgttcccactctgtcccctgctccacaggccccattccctttcttttgattggggagcacttgtggatacatctttccctcattgtaattccaccataggagctgacttttttttttctctcttggtcttttaacacagtgttacctttttctctcagtggacattccttaagctaattcctttctgaggccagcgcatcatcccaggtccgttcacagctctgactcctcacacaagtgccttccctcctctttccctgatgtccgggttcctctccctgaggctctgagccagacccaaatgtgtgaagccccacagaccctggccaggccgcagaccctcaggggaggtggatgcctgactgacgtggctgtctccctccctccgctagccgttgtagctctctttcaggaacgtagctgggcagctttggtttaacaggaaatggctgcgcaggctgccagcagccccttagtatattttcaatttaggacttagggcagtagccaaccccaaagaccttaggaccatcccagagaggggtctacctaagtgcttttctggaccacaaaggtgtcagtacttcttggggagcagacttctgaccacattttagcgccgtggcctctgaagatgagatcttgctgagcaacgcccaggtgctctgccctgttcctcgtcctgcccttggcatagccccactgggcagccatccaagccagtctgtggttgaaggcttggcccctagaagatagactgcagagaaggggaggaaagcccgggttctcaatctcacctcacagttagtaatgagatagcgacctgccccctattctgccacacagtgttcagttggagtggaggaggcagcagacctcctggtggagctgtgcagtctggggtaaatgggaaaagcacaggcttcggtgtgaggacatgcttggatttgaagcccagcttccacgttcatgggcaaagaaactttctgatccatagtttcctcatgtagaaaatgggggtaatactatttactgtgtcacgtagtaggtgcagagattagaaatcgtatttgtaaaaccccaagtaggtgctcagcaagtggtagctgatattattatcaccacatacctcttgggagatcctggatcctgtttcaaggaggataccaacacctcccaccctgaggacagtctgaggggagctttgcgcccgtgccagccctctgcgccggaggaggatgcatggaagggtagagacctaatgggctgagtggggacccctggggcactgtgtcttacaagcactgccctgggcagagggtacgggcgggcagcccaggccagcagcagggccttcgggttgggtttgaccattcaaactaacgccttcatttctctcccatgctttctcctccggccaggagcggaaggtacatgccctttctgctatcttcgcttcttagcgcttttgagttgtgtgcgtgtggattcttctgtcctctctttgggaaatagactttctttgtgtgggtggggctgtagctgggagagtgtgctgtgtggggcaggggtggagcctgtgggccttaccccggcctccctccctctcttgcaggttttcatagagctgaatcacattaaaaagtgcaatacagttcgaggcgtctttgtcctggaggaatttggtaattacactattttgctcttaggtctggactcacatggcagtaactcaaacctcggagctccagaggagggtctaggggcagggagaagaagaacctctgtagagaagtcaggaggagcaggagtgacaaggaagaaaagggacccctgagatgagagccgggatgtggaagggaaagatagataatggatcgcagaagagcaaatggggcctcaggtgggtttcgagtttagaggtggtcctgaagcagctcagtgaagtagcaccacctccccgtgctgggccagccagtggtcagaaagtttgggacacagcagactggcgacccccaagctccactatgtccatgtcacctgctgcaatctctctagcagcccagtgcgctagccagcctccctggcgccgctctggtctccacctggcctctgtgccagacaaaggggcaccgggcgtcgcaggcagactcacttgagggacagaggagtctagcgggacagctgtagccggaagctgggagccagcgctagggagtggtgtagtgggttctcaccctggggctttgagttcctgctgtgtttgtgcttcattcttttgtgcccctcatcgctgctatgaaaaccttcgttctccagcaggtaaagtgacctcggctcgtgctgcctctccccaggtctctgccttgggccctgccctgggtgggtagctcccatcgaaccagctcctcacactgccagctcgtctcttcctttctcccctaccctctttcttcctaccttgcctcccccttctcaccggctcactggactttcctccccgtgtgttcccttctctcttctgtcagagagatacttgggggaatcttccaactcgggagaatggcctggggcttcttgctctacctttgatgagtttattccctgctgaccctgggttcccccaaattctacctcccagggtcagaagaaggtacggccaattctcctcctgccttttctggcccccagggagatgccaggcccctctgctcccagtctcaaggggccatgatggtggctgagcctggggggcctactccttcctctggccaagcagaacccctgcatggctggagcggggggactctcactcttgccttctgggctgtggacatgtgtgtattttgcctgatgctccctgtcacctccctccctgggtgctgtactcgcctgtcttctgctgggtgtgttgctccagagccctcagacgctctccctcacacaggcaggtctgggcttctcctgccactcagggaaggacactgccacatcctgtgggtttatatcatgttacctcttcatccagcctcaagaccctctgtgtagggggctgggaataacgggaactgtgtttaacatgacccaattttcaggctggtgacgagttcacgggtgtctcagcaaagttggacacaagctagagagagctctctcctcccagccaaaacctgggaattccccactgcagctcctcaggggccctggacagtagctgtgaccaggctggtgaaaggcccgtccctcccatccagggctttcaaagaagtgggtagaatcacggccatcaagtaaacgccactgcggatgacagaggcctagctgaggaggctagggccatgtcctcccagctggcagagtctggacagagcctctggtggcctctgccctgtcatagcctaagctgctgcagccactgtgagaggccacagaggggaaggggaccctgacgccgggcgctgccgcctgggggagcatggcacgattgctcttagtgttgaactttctgttttgtctcttgcccgtccggttttagttcctgaaattaaagaagtggtgagccacaagtacaagacaccaatggtgagtgtgccgctcaaccctgatgggccacggtgcgcagggctccctgggggaccttcggacaggaggaggggagggccctctgagcgcacaggggtgagtggggacctcgttttgttgccaaaggttcaactcaggctgaaacaggtcttgagccctgagagacagacacacacacacggatcccctctcccatggggacagcttccttgcttggagctcacgtttagcccagaggcccatgcccagtgttagggcaggagttgcccattggcagatccttcacatatggagatggaggagtctcagtatcgtgatccgcctggttttctctcctctaggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccatgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactcccttcaggctccctggctgccttgtgttaaatgacacctcctcttggctcaggcctgaggaaagctatccctggactctaaaaagtcacctcaggctggaaggaaggaaggagatgaggtcatccatgtccaagctttggcacacggaggccccagctcccctgttctgggctcctagagcaaggctgcgggaggagctttccttcctgggcacctgagggccctgcagagagctgggctgccatgaatgaacaggctgctagagggagcagccagactgggcgtcctcacctgaactgagattaagtgaaagaaagccaaggccctggccctctccgttcccttacaggtgggtatggtcgagagaggtgtggtgattcagccagggcctcccacagggccccggactcctggccaggagtgtcttccactgcatagaactcccagaagctcccctaggagctgccttcatggaattctgtcctggaaaaacctggctgcactctcagggaatttgagacctgctggcttcccgcgcccaaaaggaaacagatgctcggatttaggctccccatgggggaagtgagagcagagtggggccctggccctgacacctttctggtgcccagcgtcctggactggattgggttgctgtctcccaccggggatatgggtctgaacccgctgctggcttattgctggctgggactccaaagccacctagtgcagctccaccccagcacaatcacaacactgagattctgcctcaccccacctccaggcggttgtgaccacggcccctggcacaaggatcacgctgagcacctgggaccagttaaatgcactttccgctgtcacagctcagtttcatcatctgaagagtgaatgctgtaggggaagacaggttccttctagcgttaatgttttatgaactcagaaaccactctgggcctggtttaatcatcgggaaaacaaaacaaaaaacagtatctgctctcactttgctgtgaagatcaatgtccctgggcttttttctttttttttttttgagacatggtctcactccatcacccaggctgaagtgcagtggcatgatctcggcccacctcaaactctacctcctgggttcaggtgattctcctgcctcagccttccaaatagctgggattataggcgcgccaccttgcccagctaatttttgtatttttagtagagacggggtttcaccatgttggccaggctggtcttgatctcctgacctcaggtgatcggcccgcctccgcctcccaaagtgctgggataacaggcatgagccaccgcacctggccatcccctgtgcatttttatgaaaacaggcacaccgaaattgagaagagtgagttctctgtgactgcacttatcttttattgcccaataaacattgggaagacatagcaggccagaaaggcctgtccccagacattgtttcttgaggccaccctccttttaccccaaagatccaggggcttccttcaggagccctgtggaccagtctgtgcaacacccactcaggactgcccgacaactgccctgctgatcccccatcgcagcacaggagacacacttgtcacacatacatccaacagtagggaggggtttccccaacttccctccaggctcctggcacggggctggcatccggttgtacctgcaacacaggttatcttacgagtgaatggagggcccctacagcctcccatttactgatggctgccccaggaccaagggccagggctcagccactgacttgtgccctgggtgtcgggtggtacatacctggccatccccaggagccagcctggtcactgaggcactgcagaagaggaggccatgtcactgtgtcctcccagccttctggaagctattgcccatctgggcgtggcagggtccgtgcccttgcagccagggcaggtgcttggccgaggacaacggagcaaagcccagggtccccactgccgcccgctcttcccatctcccaggccctggccccgagggctcctcacctcgcacctccaggcggcactcacaccgtgcctcgccctgtaagttggtggccctgcagacatagatgcccccgtcaaaggggcagggctttctaatctccagagtcaacactccctgcttgctgaacatgcggaagcgggcgtcttctcccaggtccaggccattcttgaaccaggaaatcttgggctataaataaggtaaagagagggagggaagccatccaggctgagaggggacctggcagggacccagggagacacatctgtgtttctactcggggggtcccacgagagtccctgactatgcccaaggctggaaacaaacatggaaccaagagtgagtaccatggccctgcccagggggaggaacccggtccatacaccccaaggtggagagaaagcaggggagacaggctggggagaggactgctcaacgtcggggcctgtgagccctgcctcctggtcggcctggaccagcgcctaaagttccctaccttggggctaccccggacagcacagcagagcatagcagtgtagcccgcgatgaccgagcggttcaccaggggctgggtgaagcttggggcctcggagaagtccagggccttatagttgggtggctcataggtgatgcctgttggtgacaggacttggtaccgagagggccacacaaagctaggcccctctccctgttcccacagcctccctgccccagcccctggttggaagaatgagggtacagcacctggtctggggataaagacgggctccttggtggtggccgctctgtcactaaagccaaccatattctggctgaagacgcggaagtagtagccattgccaatgatgagctctggcaccacgcagtgggtgcggcggtaatgctccaagacggtgaaccactcctgggggcagggagggaggggaggcatctctgggccaggcccttcctgatgccgagagcctctcctgggtgcccttggcatctccacccctactatggagggattcagatcagcagagggagggtgaggggtccacggtgaggacagtgaagggtagctgcggcctgggtctgccgggcctaggcagggtgcacgtggggaccccagaccctgggctcaccatggtcttcttgtcggctttctgcactgtgtacccccagagctccgtgttgccgacatcctggggtggcttccactccagagccacattaagaccccaggcgtcagtcacccggagatcctggggaggacttggcttgtctgcgggagacagacccagttgggtcaccacgcctcctgacagtgagcagggggtcactggctccagggaccaccccacccctgccaaccagggccaggcctgctggggcagtggactggaaaatgtgagctgtgggttgggtcccctggccccacccttggccccagcagcccagcccagggaagggaaacaagggggctcaaggaggccttggccacgcaccaacaacctgcagcaccagcgtggccttgtcctccatgttctcaatgcgcaccgtcacctggtaagtgcctgaatgcacgcggcgagcggcccggatgaacaggatggtgtctgtggggctgttgcggatgctcacctcctcgcctgccaggggctgcccctctttggtccaggtcacctgaggccggggcttgccctgaggggaggaaaagcttaaccctgaacctggatcactccaagggccggccgccaccccagcctctggtacctcagatcaggccagccctgagacatcagtccactggatgggaacaacacactatagcctctctcccctgggggacagggaagggggccagtcccacctggaaagggatgagaaggttcacaggctccccgaccttcttctgaatggtctggcgcaggtgcctgggcagctgaagccgtggccgttctgtgggtatagagtgggtagctaagtgagggcccgccacagctctgaggggctccacagctccaacctcccttgagacaaggcccagagagctgcagctaagaaaaaagctgcctgctgggccctgcgcctcctttagctcctgctaacacagcaactccaggctgcccaagcccagctggcttccccgagcctcaccacttcaaaaggcagggatcagagagggtaagcaacttgactgaagtcacacagctagtaagtcatagaccagggtgtaagcctgggctttgacaccctatgccctgtgttgttaccacctgagtttgctgcctcgttccagctttgagaaccaatccttacaaaagatggaccctttgttgggacaaggaacaaaggaatgggaagtggatcccagagggaccaatctgactacatagacaatatttacctgttggagctgagacactcctggaagagagcttgggtactgtggcttttactttccctgttccagaactaagggactgacatacaccaagagagccctttctgcactttttttttttttgagacgttgtctcactctgtcacccagactggagtgcaatagtgtgatctcagctcattgcaactgccacctcccgggtccaagcgattcttctgcctcagcctcccaagtagttgagggactacaggcacgcgccaccacacctggctagtttttgtatttttagtagagacagggtttcactatgttggccaggctggtctcaaactcctgacctcaagtgatctgcctgccttggcctcctaaagtgctgggattacaggcttgagccactgtgcctggccaccctctctgcactttttccctaggcctagcgcatggacgatggctccaacccctcctgtctctgcccagcgttctgggcagagcattctgggcctccccaactgtccccacctccactggacaccaagggcctggggtgtcaatggcgggtcttgtgactgcacaaaggggcactcacgcaggatctcctgcactgtcaccggctccgtggtggtaacaggggctccaggccctgccatattgtgtgcccgcactcggaaaagcagccgggcccccgtgggcaggtccttcaccagtatcgatgtgtgctctgtcagcccctgcagggcagccacccactctgagcctgggggtggggagggggaggcaaggccacaggctgtgtcaccactgacaccccactcccactgcccactcctctgataggaatctccaggatttaaatatgtttttttaaatttttatttgtttatttatttttgagatggagtttcgctcttgtctcccaggctggagtgcaatggcatgatcttggctcaccgcaacttctgcctcccgagttcaagtgattctcctgcctcagcctcccgcgtagctgggatcacaggtgcccaccaccacacccggctaattttgtatttttagtagagacggggtttctccacgttggtcagactggtctcgaactcccgacctcaggtgatccgcccaccttggcctcccaaagtgctgggattacaggcgtaagccatcgcgcctggccttaaatatgtttttaaaatgtagttgctgatttcgcactgctcaaagaagtgttacagtcagctttactctgcatttgtttttcactaggcaagcttttttacttctgaaaacaggacagatatttctctgggtgtcctcaactttcggcaaaagtgggcctaaaaaacttgactacaggtgaatctgctcaatggcaaggtgagcatgttcttcctttggggaggggggttgggggcggggacactcacagccctctgggcagtactccacgctgtagccatccaggcctcctgctcccacgcgctctgggggccgccacttgagggagaccgtggtgtcagagacgtcctctactgccaggtgggtgggttcgctggggggacctgggcagaggagaggtcagagaggggtctgagcaagcctggggaagctggagatccatgccctagactctgaactgcccactggtcacatagggggcacttcctgttcagctggcttttggccactttaaggaatattttgtccctgttacaagacatgtctgtagattggcttaaaaacaaacagcaacagcagccaggcacggtggctcacgcctgtaatcccagcactttgggaggccgaggtgggaggatcacctgaggtcaggagttcaagaccagcctggccaacatggtgaaactccgtctctacaaaaatacaaaaattagctgggcatggtggtggatgcctgtaatcccagctactcagaaggctgaggtgggagaattgcttgaacctgggaggtgaaggttacagtgaccccagatcgcgccaggactgcactccagtctgggtgacagagcgagactccatctcaaaaaaaaaaaaaaaaaaaaaaaactaaaactaaaactacagaaaacatgggaatttcctggcacgtatgattaggtgagttgactaagaactgaacaaaccaggaatcagtccctaaaacgagaggcctggacccttctccccacaggccccgattcctgccatcttcccaagctgtgccccatccctgggcccaggggtccttggcctgcccttgccacaggcagctgcccccggactcacccaccctagtgggaacaggtgtcctcctgagccctgccacagtctcaacacctgttctgcccactcagaccccattatacagatgaggaagctgaggcttcagggagggatgactccagttggccccccggggaccatggagctgcctctgccatctctgagtcttggtccaggactctttccacagacagatgcccctgagacccctccactaactacagcccttgccccatcccataggtgaaaaccctgggttgaagggtgtggagaacaggggacaatgaacatttattgagcacctgttagatgccagatggcctgcctggtcatcccatatcatcctaacagctctctgagataggcagtgtcattattcccattttgtagacatggaaagagaggcttgaaacgtgaactaggggtcggcgtagtgtgagagtcagctccaccccaaccagctgggagatctcaagcaggtcatttaactgcttggagcctgtttcctcatctgtaaaatgcggctgagtatccccagtcgaggatgaaaggagactgtggatgtgagtgtctagcatggctgcctgcagagcacctgctattattggaggtttttaactggggagggggcggggggcaggaccaggccaggcaggctcaccgataggcatgaagggctgggaggcagggctgggcctggacatgccgatggcgttgaccgcgtagacgcgcatctcgtacaccacgccctcgatcatgcgccgcgcttcatgactcagctcctgaatcaggtcgaagttcagccgcatccaccggtagctcttcttcttcttgcgctccaggatgtagcctggctcaggggaggtggcagctctggtctggaacccaggcatccccacaccaccttccctcggatctgtttggcgccctcacacctccatccggtgcccttgcactcacccaggatgggctgcccgccatcgtaggcaggcggctcccactgtactgtgcaggagtcctctcccacgttgctgatcttgggggccgcaggtgcgtctggcacgtctggatggggtgggatggacccacatcagccctgccccgctcagggccttgagtaacgttgctcgtccccttcccactccaactaaccgccacaggctgcccccaccacccccagatccaaagagatctttctagaatgcatttctttcttcttttcctttttttttttttttttttagtgatatggagtctcactgtgttgtccaggctgggtctcaacaggatgcatttctgatcatgtcgccagccctccgtcaaccctttaaggcttctcactgcccatattcacccctgtcctggctctgatcctcccaaccccacccagtcctctcctgacatgtttcattcattctccacacccaaaaggccctttccctcctccacccctttgtacacagtttcctctgcctgggatgcctttcctcaccatcttctcagcctcctaaaggcatcacccccaggcacagggatggctctctgctcagtgctcccacggcactctggacatggctcatgtacagcagtgtcgcaggaaatctgctggatgcatctgcctccatctcccccagagcggggctccttttgggcagaaaaacctgtcctgttgccgctcggctcagggagcatgcccgtgatgtttgtcgagtggctgaatgagcgaacggatgggccctccttggggctgcccctctgtgttctccagcttggaccccggccggcctcaccgatgaccttgactgtgaggttgacctggtcctcgcccacagggttcttcactgtgaccgtgtagacgccctcatcttccttctctgccccctcgaccgtgaagatgctgcggtccttggtggtctccacgcggacccggccctcggtctcacacagcagctgggggggtgcagagttggggtgagatccaagtcagaccccagaggcccttgcagcctccgccaacagccagatgtcccgggggtccatggggggaacacagcctgtgggaagactgcatccacgtcagcatctagttcaaaatcatctctgtggcaccgactgagggcaggggctcgggttctagctttgtcacgggacctggggcaaccacctgtcctctcagatgagctatcatgaggacccctcaagaccccagccttcagaagaaccaacagtgccaggcaggagcaagaccccggcagctacactggcagaaaagtgtctcagaaactactcctgagttgagagggagcacaaggtcaaggtcaaggtcagcttaggatgaagggagccagggagcagcccagtcatgagggcttcctggcaatgagagggtgtccacatccttgtgatggccatcagcacacttcacagagaccctctgcctgaggtgtgagggccccacagggaccctgctgggggcagcaacacacccggccaagtgtggcacctccatggagacctcgccaagggctcggcaccacgtaggtagaaagtgatgaaagacaaacgagcctcctcctgacctcagtctcactcaccttcttgtcaaacacccactcatcgctgtcacctgtgtcctctggggcatctggggctggcctggctggggccttattcccctgggaacagggcaggagggaagtagggagcagaggagctgactcagcctggaagcgcccctctgctgcttcttccaccccctgacccacactgcccaccttgcctgccccctgaccagtctctcccatggggtagccaacagcagggcgtgcacatgtgggtggggtgtgcagcaggtcctagcacttggctggttccacacacccatcttatagatggggagactgaggagggacccacagtacctgcgtgatagccttctgccagatcacagtgggagcagggtccccagagatagggacgtccagacgtagcttatttccagctacaaccacaatggtgtctggtatgcggcctgggcagtccaggtggatcttgggaggttctgcagaagacacaatgtagttcagagaaacgggagagccaggaggagcacaggtcactggggcggggctgctcaagagcctgggcccctggttattggttttttagatttgtattgaggtatagtttatgctcagatctgacagtaggctgagttctgacagatgaatacacccatgcaattattaatccaaccaagatctggaacattcccatcaccccaggacgttggctgggaggcttgtaatattcaggtcaggtcacctagcatagcattttgaaaactgggggaacatcagtgtcttgccacacacatacacacacacacaatacacacacacacacgcatatacacatacacacagacacacatacacatacacacatgcacacacagacacacacatgcacacagacacaaatacacatacatacacgcacacacacagacacagacacacatatatacatacacacacagacacatgcacacacacacacgcgcgcacacatgcacgcacacatgcacacattaaaaaggttccctggccaaataaatcaggaatctgccctcagttaaacaaagcaaagcagtctggacgcagtggctcacgcctgtaatcccagcactttgggaggccgaggcaggcagatcatgagatcaggagatcgaaaccatcctggctaacatggtgaaaccccgtctctactaaaaatacaaaaaataattagctgggcatggtggcgggcgcctgtagtcccagctactcaggaggctgaggcaggagagtggtgtgaacctgggaggcggagcttgcagtgagccgagatcgcgccacttctctccagcgtgggcgacagagggagactccgtctcaaaaaaaataaaaataaaaaaaaaggaagaagaagaaaagatgtaataataacagtcacacatgtgacagcacttgacaggtctgatacatcatgtcacctcatctttataactatcctatgaggtggcactatcagggttcccattttagagaagaggaaactgaggctcacagagattataattgacccatggtcatgagtggcaaagctgaagctgggccccaggacccccacttttgatccttgctcttccctctgtgagtggaggggaggcctgcgtgggtgggttgcgggaaagtgagcagaaccaagactcaggggccccaagacttaccctgcctgggtacgaagtcaatcttgacctctgcaagagaaggaagagcaagtagcacgggggcaaaggcagggcccagtgacaggggctcctggccccactgccccgacccaccctaccctggagcaggctcacccatgaagtggagcttggctgacaggttgcaggcgaagccctcgggcacaaagctgtagtcagcctcgtcggcaggtgtgacgtcgtcaatggtcagtttgtggaccctgcaggggagcagtggctcaggggaccccactgggccacacacccctggccttgccagataccccagccagggtcccaggaggccctcaccttgtcctggcttgttggtattctgatttttaaaaatgcctttttttttctatattatctaattttccagctttttaatgtgccttcagaggtaggcagcgtaaaagtgatttctacatcaaagcatctccttggctgggcccttggagactgggcaggggctgggtctcattaatctctgtgaacttgggcccagcacggccagcccagttgctccagggatgagcaagagggcgggagaggcagtgagggcctctggccagagccggcctccttggtggcctcctgccctgccctggtcacaagctgggggagggtgctggggagcgctcgaccccgtccgtgtctctccctgctgcctctttgtctctgtccctctgttcttctctgtctctgacgaactctcctatgtgtgtgcctccctgtgcatatctttctgtctctatagaactatttctgtctttctgtctctttgtctttttgggtctgtctgtttctccctctctgtgggtctctgtctcagtctctgtcctgtctctgtgcatctgcctctctgtccacctgtctttatctctctctctctgtttctccctgtgtctctctctgtctccatctcagtctccacctgtcccatccacctgccctgcacactcaccgcccgatgtgggacacctttatgcggctgtcgggcaccagctccttcccattcttcagccacacaccccgaacattctcatctgagacctcacatttgaacaccgcctggtcctttgcgcccaccatcaggtctgcgatgctctggtacacctccagcttcttttctgcagggcagggcagagccattgagctcgggagggtgtgtgggtgtggcgtgaatccctgtggagggcgtgtgggcccatgggcgctggtgcgcacgtgtctgggtgcatgtgggcatgtgaaaacacgtgtgcctgtgtgtgccatgtttgcctgtgatggtgcagtgcacataaggaacctcaagtgtctgaggggtggtgatgctcaccaggcccgtatgaccctctcagtaccctctggagcggtcacctcagcatcgtcattttagagatgagaaggatgaggtttaggctgtcaaaggcccaaggtcacagaggccttgagcccaggtttgcctgctcccctacagggctaggtggggtgggggctgaggggtccaagccctaaagcctcatgtgcccccccagccaggctcaccctgcacaatgagctcagccagcgcctggcccccgctagtgcacagtgcatagtgccccgcgtcctccagcatggcctcgttgatgatcaggtggtgtctctgcccgtccttcttgaaccggtatttgaaggtctcctcccgggtcagctccaccccgtccttcagcctagccgggtgggtgggtggcaagtgctgtggcctcttctgggcagatgcccccaacacccatgccccgtgcttctggaactcaccatttgacttgcgccccctcctccgatacttcacactcaaactccacccgctgccccaccatcaccagctggtcctccaaggggcgcgtgatgagcacagggggctctgtccaggcagggtgagcatgagggttggctcccctgaggccatctcctccccaggttcccacatcctcaggtcccaggcccacctttcacaaagagctccgtgctacacttctcgccacccaccacgcactggtaggctgcgtcgtccgccaatgagcactggctgatggtcagggtacgcttggcaccgatggactcaaagatgtacctgggtgggggccgcagggaagtggcaggaaagctgcggacacccctccgggcccagtgcgccccatgataatccctgtgccccccaccccaagccatccagaggggaacttacttgctgtagaacagaaggggccgttgaagtgttcccgacgggaggaagtgagcccgagacaaaaggagagagagagagggaccggcaggagcaaaaggatgggaaattaggcccagagagatggggctgagagccacaccgagtcagagatacgcatgtggagaggggcaggaggcaaggctatgggggtccccacctccacccgagcccccctccccaccccaggctgcacctgccgctcatctggatctcctggccattcttgagccatttgacctcagcgtcatggtcagccagttccacggtcagccggatcttgtggcctttgctcacctggtaggccggctccagcttcttctgaaaggctgagcaccacccctcagccccggccaccccaccgcccgcaccctgctcccccaggccaagctactgtggctgtggctggggcccaggtccccccctccaatcccctctgtgccgccccgcttccacttctctgtgtctctatttctttttgttttgtttgtttgtctgtttgtttgttttttggacagagtcttgctctgttggccaggctggagtgcaatggcgccatcttggctcactgcaacctctgcctcccaggttcaagtgattctcctgcctcggcctcccgagtagctgggattacaggcatgtgccaccacgcccagctaatttttgtatttttagtagagacggggttttaccatgttggccgggctggtcttgaaatcctgacctcaggtgatgcgcccgcctcagcctcccaaagtgctgggattacaggcatggtgtcttcatttctttatctgtgtctatgtgtcaacccacctccttgtctctgtctgtctgaccttgtccttctgtcttccttggggtcctctccacctgctcagctcagggattgggttaggggcttccagaaagacagaagcttgtcaggagaactggggctgggacagctgtgccttctcttctctcagcaacccctgagttgtgtactcttcccaggcgctcccacctagcagccctctgtgcccagcactctcactcccatctcagcccccagggccagtgcggtggtccccatgctgctgcagtgggggaaatagggctcagagaggcgactggcccaatgccaccagcccagcaggtgtgtggcagagctgggtcttgagcccagccctgctccacaacaatgcctcctcttgcggccgtgtttgtaaaagcccatgttgctgctgctgagcccagggaggaagtgggggctccatccaccgagcagagaaggacccctgagtcctcaaatactctggctgggcctggagtcagctgcggaggggcagagatctactgctgggtgctctgtgaccttgcgctagttccttaaaccctctgtgcctcggtttcctcagtaacatggaaatggtaatagtccttccatcatagtgttgtttcgagaattaaatgagataattacataaagcacctagtggctggcttaggaaggaactcactcactttttttgagatggagtctcattctgtcacccaggttggagtgcaatggcacaatcctgactcactgcaacctctgcctcccgggttcaagtgattctcctgcctcagcctccggagtagctgggattacaggcgcctgccaccatgcccaggtaattttgtatttttagtagagacggggtttcaccatgttggtcaggctggtcttgaacgcctaacctcaggtgatccacctgcctcggcctcccaaagtgctgggattacaggcgtgagccactgcacctggccagcaatttgctctttttactgttgttgctattcctggaagacacccctaccctcggaggtccccatctgccttgccagcctccatcttttcctccttgggcacctacagtcctttgcttggtgccctctgggctcagcagttcaggagttaacccagaggaacattggtggcattcaggggatccctggcttaaatggggccacggtgccggtaagggccaggccacctagcgatggggtgatgggaaacccagtgaggctgagacaacagggaggcagggcagagggataaggggcctgggggaggtcagcagggagggactaaccagctcctctccccgtccccatgatcgtgtgtgttttgtgtgtgtgctttgggaggggcttgtctcccatatcctgcatggaagctgacccctccattcagtcggtgtttatagagcgctcgaggtgtgtgccaggccctgtgctagacccagacatggtggggagaaggcatgtgagacccctgctttcccggctcacacccgcccttgtcaacccctcagtggagaagggctattcctgggctctcctctttccatctgcctgggggtgagggtagttaacccaagccctcctgctttgtttgcctgagagaaagattagccaggctcttttctttgcctgtgtgtggctctccaggcttagcgggcctcttcccttttcttttgggtgtggagagggttaaccgggcttcatttcttttcagaagagggtagagaaagaaagtgtagcctgatttttccttggtgaggagggttaacctgagctctgtccttttccttgtggctgtcctggcctaacttttgctcttctcttctatctctgtggtaaggggctaacctgggcattcttggctttttctacacaaggaggggttaacctgggctcttctttcctgtgagtctctgtgctaagccggactccgctctttccatgtatgtggacgaggtggggggctaacctgtgccctctcctctcccctgtggggaagggctaacctatgccctctcctctcctgtgtagggaagggctagcctgtgccctctcctctcccctctgaggaagggctaacctgtgctcttcttctcatcgcgcctcatgcccttgagcctctttagcatgccgcgcaggtcagtgacgccgtactggaaggcgatgcgctcgtactcagatgggggtgcctgccgtaggatctcccacacgtcctcctctgctggtgcctccagcttcgagtccctgtgtcccgcagtctaggctgtggccgggggcaagactgcagccccctgggcggggcttcctgggcccaggaccaaggagctgtagccacccctgtccctctgccccttcccttctggtggggcagctggagctgctctgggtcccaggccaggcaggactgggggccaagggagctgaagaggggctggggatctggaggggctcctggcagaattaggggtgatgagggtgctgtgctatgttgggcactcacctcggggtccggaaactgctgctccaggggtgggggtgggagaaagggtaggtggcacatgagaggtatggccaccttccctcaaagacctggaccccacccatgggcctttacttcctccctattttccgcacttgcactccctgtgttgtggggcacccatgctgctccggaggctctggcaggacctcctgtgtgcattactttttcttatccctcctaagctctgacagataggtgggtggcaggagaagcccaaggcacagagactcacccctgtccgtggggagccgcaccctgctctgagtctctcaccacagcctctcagagaggggacgggaatcccctctgcacccaccagcgccctgccgcccccaaacacccagaccccgattcttactctctgggccacagcagcagcagccataatggaggggccgggggagagggagagagagggcagagagaacataagtcagttgggccgacctggtagaccctgcagctctggggaccctctctctgttccttctgggtccccggagtttacggagggagcttttgcagcctcaagtgtggagtggccgtgggggacactgtgaggatgactgttgacgggacataatgtctgcagagccctttaactccttccacactgggatcatcccctcgacagacaaggaaaccaactcagagaggtgcagtgttgtgctcagggtcacacagctggcaaaccacagtgctgggatttggagccaggcctcaccagctgccccaggaactgccacccaggactcacctctttttcagcagtgagctgaagtccagaatcccagtgtcctcatggctatcactatggagagggacccccagtgaggctgcagtgagggactggaaagggattaggagcaggatgggagtggagtggggagggagaaagggacactagccagattgggctcccacccgtctcagacccctgggggtctgcggatggtgcaggtagggcctggggcaggggtacctgatccgccgaccacctccagccaggctcctgtgggggttagactcagtatcctcacctgcctgggaagcttgctctcccctgcagcccccactgacttcagctccgccccgcaaatcatccccagccctgacccccagtcgagaccctgaagggcctcagactccagcactggcctcccccaggccctgaggatggccactcacgtgcggcggaaggctgataggaggtccaggtctccggtgcccatggcctctgggttcaaagggtggagagatgggggaaggggcttcagagggggccgtttgagaagccctgccctgggggcggcctctgagtattcacagacttgcccattcatgaccccatgaggctgggcatctgccccaggatctcaccttcccagcctttcccagggtcaaggtaccaggcaggtgggacggtttattgtccccaattcccacccatctctcaactcaccttcacccatcgcccaaacattcagacagtgccaggccatgggccaggagccgtgacaccaagatgataaaacagagtcccacccagatgagacccggactcagccctaagcccccacgcctaccctgcaagccttggggtttctctcacaccctgtgtgtgcagcactgggcacgtggccagcactcatgtctggatgggacgaggcatcctccttagtgttgggaaaaggaggtaggagaccaggacccatggggagcccgagcccaggacagacaccagggccccctcaccgtggacagtgagattgaagttggagcagtcaaatttgtccttggtggacacctcacagcggtagctgccagtgaaggcaggctgggcatcggtgatgtgcagctcgaacagatagacctgtgtgcatggagggacggggcgtcaggggacaccaggggccgggagacaaggctccgcacccttaaaggagactgggagtggccgggcgcggtggctcaggcctgtaatccccactttgggaggctgaggcgggcggatcacataagaccaggagctccagaccagcctggccaacgtggtgaaattccgtctctactaaaaataacgaaaattagccaagtatggtggtgcacacctctagtttcagctactcgggaggctgaggtgggagaatcgcttgaacccaggaggtggaggttgcagtgagccgagattgagccactgcactccagcctgagcgacagagcgagaccctgtctcaaattatatatatatatatatatttaaaggaggctgggagtgacaaatgctcatcgatcttcgcaccctcaggctttagttaacccatacagagtttttgtacagagaaaggggactatctcgaaacccatgattgccatctgctggcacatggttgtggtgaaatacaggcttttgtgcaatgcacagccccgcacagcagaacatgttggcctctcttgctagaggcccccttgcctagcccaggactggggaaggttgggaaaagcagaggcttggagtgaacaaacaaggggacttaagccttaaggttctggtgggcagggcggaaaaaaacaaaacacaaaaaacgaaggcttaaggttctaggcctatgtctaagtgaccttggagcagccacttaacctctcaagctttggtttccgtgtctgtataatgaggaattgttctggttaatccctgagagtcccttgagcccttagccctgatactcacccatccaggggctttacaaccccactagctggtgcccccatgcttcacagtgtcctccaggcttcctgaccaccctgggcgaccccccacccccggccaaaccttattaggtgcccccttgaggtgatcatgtccaccaagtctcccaggtccccgacagtgctcccatgagcctcatcgcactccctggcccccaggcctccgggatctccctgtgggcccctggcccctccacctgcctcccagattccccacaccccttgcttgcagctcgtgtgtgcctctgggtctcatggtgccctctgtgtgccttgtgccttctagggctctccatgtcccctctctccgtgtctccacgaccccggtggacccaccttgctggcgcggtcgtagctgtcgtgcagctgcaggtgctggcccaccttgctgctcaggtccacccatttgcccttgaaccacttgaccacaggcggcttcaggaggctggcgccggccacgcgggctgagaaggtgatgctgccacctgcaaaggcaggggcgacaggcccggcttggggagtgtcctgctgcccccccttcccaccccaatgctgggcacagcagctcacactcacccacggtcacctcgccatcctgtggccgcatcacgaagaggccaatggggtcatcgggggctccaggggtaggaccattgagagctgctgagcttgaccctgtgagcaaaggctttttctgtttgtttgagatggagtcttgctctgtcacccaggctggagtgcagaggcacaatctcggctcactgcaagctccgcctcccaggttcacaccattctcctgcctcagcctcccaagttagctgggaccgcaggtgcccgccaccacgcccggctaatttttttgtatttttagtagagatggggtttcatcatgttagccaggatggtctcaatctcctgacctcatgatccgcccacctcggcctcccaaagtactggggattataggcctgagccaccgcacctggcccagcaaaggcttttgagacctgccctggacacgccctacccacggatcctgcccctccctgcccagcccctctcacctttgggacttggggcactttctcccagctcagcggctggggccggggcttctccaggggctccagtggcctcagcaggggcaggggcaggggccagcatgggctctgccttctctggaggggatcagatgggagtcgtggtgcagccactaaccagagacccctccaccctctctctcctgagcattggacccatgagcccgctgtggatgaggaaagtctgccatggctgtcctcccgctgcctgggcccctcagaggcagctcatgctgagctggagagccagcctgcctctcacattctcctccccgtcccaggccatcagttcccatgtcctctgcatctgccctgaacagctccaggtccatccctgctctgccccagccttagagcagcccctcagactgggctgcactcccctcatccacagctcctggggcttcccggccgtctgtgcagggtcatctccccagggaggtctgcagggggagagtggggttgtgtcttgttcatctctcccacctaccccatggctggaacaagccaggatggcacatgggggtactcagagaggtcatgtgcagaaaagggggaaagggcgttcctggcggggggcacagccacagcaaaggcaagaaagtgtgaaagcacctcctgttccctggatggatggagagtcgctgggctgcccctcccccagcagcccaaacctcagggaaggctgatcaggatcttacctgcctctatgaccttgaggtcgaacttgaccttggaggagccagcaatgactgcgtaagatccctggtcggcagggcccacttcccgcactgtcagcgtatgccgtgtgccctctgtggccaggccgtacttgttgctggcgctgatgtcactgcctccgcgctgccagcgcaccttcactcctgcccgctctgtctcggcctcgaacacggcagggctgcctgcggccacttccactgaccgtggcttcttgctaaaagctgagactgaagggccaggtggaggctacagcggcccctggttggagcgtgcaccccgcccctgcagcccctctcagtaaatactgtgctagcactttctatgcatcccctcacgtaatactctaccagttctctgaggtagttgcagttattctgttcatttctcagaggaggacactgaggctcagagaagctaagcggctcctccaagatcacacagctagcagtcgggagagccagggctgtggtcctgacctcccaacaagactttttctgcatgtgtccactttccctgcttggagacacccgtgatgaacccagctccctttcccccaaccatttcgggcccttggcagggggcggggaagtctgcctacttggaatgtggccaaatttgtcctccaaggacctcaggctgggtatcagcaactgagataaagctggcctgggagggcgctgggggatggggacctggatctctgccctggacaaccttcataagggcacagcccaggcccaggtccctgggctgtgattttccctgcccttggcctgggttcaggggctcctgactgtcctctctcagagaagaggggctgtgtcaccctcaacatgggggccacaccgtacaggctcatgaagcagataatgtcacagccaggaggaaccaacccaatgccaccaccacccccggcaccccaggttgggagactgagacccatagtgggtagagactggtctgaaggcatgccgtgagcctggctcagctccatactaaacgtgggctctgtccgcggggaaccttgctgtggaaggtgaaggcaatgggacagggaaggggtccctttgcattctcagaatgggttgaccccgggtgcttcctgtcttggctgtgtcccctctctgcgtccctgaccttgggtttaccttcacctctcatcagagggatgggaaaaagaaaccgagaatcaaaaaaggaccctggaggactggctgcccctgtcctggggctcagaggccacgtcctcgtcaaccccctcaagaactccctcctagccctgctccccaattgtagacacccccctgctcccacacttagacccaaccccagtcctaaagctacctggcttcttccccggctcaggcatcctgagagacgtcacaccaggcacgaagcaggcacaggtcacccaaagagggactgagtggggtcctgtccttcccactatatatggggacctcccccctccccaggctctgcttatctgcctcctgtccagccacctgctaaatatagatgaattccagagagctgaggtctctccagggagaaggtagggccacattgtccctggctggctcctgtcccttcccccctcaccccccgcagcacaattctgcctccccaacctttggcaagcctcaggggtactccaagccccgtgtgtgtccctcttacagcaaattgtacggtgggagcatgctgggcccataaccctaaggctaacgggtcaggagcatcctcgcaggcagttcaggcagtggtcatgtccacagaccctggggccagggtgtctctgagtcctagcactgccatctctttaatctcaaagcacctggtttcctcatctgtaaagcggggtgggtgaaagcagcacccactgcacaggattgtcacacgtatgaagtgggtttataattttaaaaatgttaggccgggtgtggtggctcatctgtaatcccagcactttgggaggccgaggcaggcagattatttgaggccaggagtttgagaccagcctgggcaacatggcaaaaccccatctctactaaaaaaataaaaaataaaataaatacacacacacacacaaattagccaggtgtggtggtgtggacctgtagtatcagctacccaggaggctgaggtgggaggatcgcttgagtccaaggagttccgggctgcagtgagccaaaatcgcaccactgcactgcagcctgggtgacagagtgataataataataaaaatattatttattattattttttattattaatatctcaaagaataataataaaaaaataaaaatgggctgggcgaagtggctcacacctgtaatcccagcactttgggaggctgaggcgggcagatcacttgagctcaggagttcgagaccagcctgggcaacatgatgaaaccccatctgtacaaaaaatacaaaaatcagtcaggcatgtgacgcacacctgtagtcccagatgctcgggaggctgaggcaggagaatcacttgagcccggggggtcagggctgcagtgagccatgttcgtgccactgcactccagcctgggcaacaaagtaagaccctgtctcaaaaaaaaaaaaataaaaatagaagaatgaagacacaacaccattttgccttctcttgtggccctgcagtaggactagggagctgcagggttgggctgcagtgagccctctggggttgaggaggtgtggggcgggtatttgtccctacgataatggccccagaatctgggttccctaaggtctttgacagcgttgggaagtccctcactcccaggctgtctactgccactacttgctaccgtctggaggaaaacacaggacttacaggcttctccgctcagcttggtctgtttctcccctgctgtggctaggagctagaaagcaaatagaacctgggggtcccaccagggattcacttgggtctaaagtcctgctgggcgtgcagctcgtgagaaccctttgcggcccacaggagctttggggcttaattcctgtcctcggaatgctgaagagtatcctcttccagataagcaaggcctcccactccatgttgacgtgtcgggacagacctggagtgtgatccaacttggccactcaacggctgtgaccttggggaaataatttgacctctacaagcctcagtttcccattctataaaatggagtgatattagactccacatctcaaggttggcagatactaattgaccagaatatcaaatgttgttgctggtcatggtcatcatcatcatcatcatcatcatcatgagttcaaacctcatcaaggcttaaaaacaacaactatcaggagtagagagcttttaaataggatctgctctcctaatcacaattgaggacttgttctttccaccaaactctaactcctgttcaggcgctctgtgtcattggtcctcatgttcccagggtccagcattgggtacagtcctcggtaaacacccgatggacaaatgacaaaaagagacgtcgcagcacacaggggccaaaagagatacacaacaaattttaaaagagactctgtgctgcaagaggatggattgagaataactttacttgttttttgggaggaggttaatgggtgggaggggtgagaggggagatctgatttacatacggacttgagactcccaaggcagtaccccgggtcgtcctctgcaaggttgccccggtggggtctgacgcccagctggcgtccgggagccggggtggagtcctggagggaggcgaagcgggatgtggagggggcctggagtggggggagggggcgggtgaggcgaggcccggcccgccacagtcctgcctctgggccccgggagcgtcctccctgtgtccgggccgggcgagggcttaatgctatggccagcggggaggcctggcggggcccggcgggggctgcgggctcagtggggcgggtggcgccgctcggccaggcccccgcggcccagcacttcgccgctgaactggtaggtgagcttcttcttcaccttcttgacctcgcccgtcttgccgtagttgcgcagcgcgcgcgccatcttctggtaggtcatcttcttgcggttgcccttctggatgccccagcggtgcgccagcgcctccttgtgcttggacgagaactggaaggtgcccttgtccttgtccacccaccagatgctgtccttcatgtcgccgctgcggagcaggtccaacaggaactggtacaggcggatcttcttcttgctgcctgcgggggggagggcccggtgggagggggcccggggcccacatgggagccgcccccaccgccttgcgtacgcacaggggcccggggacggggtggccgggaagggcaggggaacggctgccccagcccgcgccgggcgtgcatacacaacgcacccacactcacacacacacacatgcttgcgcacacacaggcgttcacacacacccactcacacccacgcactcaccccccccacgcgcacacactcgcacccacacagtgcaccaagtacacacacatgctcacatccacataacgcacccacacctccttacacatgctcacacatcacgcccacacccactcacacacgtgctcacacaacgcaccttctcacacccactcacactcatgcttaaacacaatgcaaccactcactcatgctcacacccacacacgctcacacgtacaatgtatctgatcacacacatgctgtcacacacatgcacacacaatgcacgtgctcacagactcacacccacatgctcacacacatgcttgtgcaatgcacccaaacgccagattgcacccacacccacccacttgcacattcacacccacatctgccctcacacactgtcactttctcacacacccacacaatgcaccagctcacactcacacacatgctcacacactcattcactaacatgcccccacacactggcacccacacgacacacccactcacatgcttgcacccacccacatgttcaaacccacactgcatctgcttacacattcacaacccactcacacacacctggtcacacccactcatgctcacacctcattcacacccactcacatgcacactcacacccacccaatgcacccactcacacacatgcacacacactcagacccacttactgcccccacacacggtcacacccaatgcaccttctcacactcatatgcccactcacacctgctcacacacacctcacaccaggttcacacactcatgttcacacacctgctcatacacctcacaccaggtctcataatcacacctgcttatacttgcttacacatgcttgcacaaacacacctgcttacacatcttacactgctcaccctcacaccttacattgctcacccttgcacacacatgcccctgctcacacacacatgcttacaccacaccattcactcacacatatccactcacatatgatcgcacctacccacacctcacacacacttgcacgcacacacctgcttacacacatctcacgttactcagccccacacgcacacacctgctcacacacatctcacattactcagctacacacacacgcccctgctcacacacttgtgctcacacacctcacaccattcactcacgcacacacccactcacacatgctcacgtctgctcacacacatgctcacctatccatacacacacttcctcacacacctcacaccaagtctcacacacacttatgcttacaaactcatgctcacacacatgctaacacttcacacatgctaacacctcacacattcacacccactcacatgctcacacctcacacatgctcacacctcatacctcacacacatgctcacatctcacacccactcacacacacctgcccacacatatctgcacacacacatgctcacacatatgctcacacatcacacatacctgctcacatacatgctcacacctcacagctgctcacttatcactcacacgctcacaccagctctttcacacctcattgacacctgctcactcatatttcacaccacttacacttgcacctcacacctgctcacgcatgcacatacattctgctcatgcatatccacttgcatgcttacacgcctgttcacacacaaccactcagacacctacttgcacactcaaatgctcacacacattctgctctcacatccactcacagcagctcacactcatgcatgctcacacacacctgctctcacactcacacatcacacccattctcttgtttttgagatggagttgctcttgttgcccaggctggagtgcaatggcacgatctcggctcactgcaacctccacctcccgggttcaagcaattctcctgtctcagccttccaagtagctgggattacaggcgttcaccaccacgcctgactaatttttgtatttttagtggagacggggtttcgccatgttggccaggctggtctcgaacacctgacctcaggtgatccgcctgcctcagcctcccaaagtgctgggatacaggcgtgagccaccacgcccggcccactcacacccattcatgctcacacactcattcacacacctgctttcacacatacacatacctgttcacacacatgcacacctgctcacacacgcaggtgcttaagcacgtcctcaccccccacacacacctgctcacacatgggaacacacacatgcttacacatgttaaaacacatatccactcacatacatgcacagacctgctcacatatacacatacatgctcacacaccccagctcacaccttcctgctcacacacacctgcttacatacaccctcaaacatgttcacacccactcacacatccactgacacacacctatgcccattcacacacacttatatcacacacatccctgcttacatacacattcacacatatacacttgctcacacacctgctgtcacacccccactcacacatatcactcacacatgcctgcttacagccactcacatataccatgctcacatccctgctcacacaggcacacccacacactgctgacacccactgacatcatacgtgcacagctgctcacacgcactgaaatacattcatgtgttgacagacacacaaacatggccacacccactctcagccacaccagctctcacattcaccttctcacacacccactcacacagccactcgcacacatgcacctgcccgtacctgtgcacacgcaccctctgcacacttgctcacacacacccagatgtacacacactcatggcacagagagacacacacacctggcacacttcatggagatgcccgtatgcactacacagcagatacacacacacagagacagccacagacagccccacaaaacacacacactggcaaacatgcacacacacacacacgcgactcggtggcgtggctgctgggtcagttggcctggctgggtgggggcagggcacagacacggccagggtcggggccagggtggagggccaggtgccccacctgtctccccaggcaggagcccaggcccgggctccaggccatccgcctcgccgtcagacacctccagtggggggctctgccgctcgccctcctcctcatctgagctgggctgggctggggacagggatgggtactggaggcacatccggggcaggtaggagacctggacggtgggggaaggagatcagagtcaggaagggccagcttacagctcaggggggctgggagggaggtcagctggggagagaaggagtgcagagggcaggggacaatggcaggcacaggagactggaggaagaagaccagggaaaaggggggccagttgaggtgctgcacatagggtgcaggctgtggggcgaggggtgctgacatccagcccacccagccctcccagctgggcctcctggtttaggactgtgggcaccggggaagtggtgccttgttctcctccctgcagcggtgctgtgtggacccgcattaggctggggtcagaagagggcatgctagggaccggtgcgttgggtctggaagggggtttcataggtgggatgatgagtgagtggagggaccctggaggtcagtaggggtggtagaggtcagcagaggtcactgatccgggttagggtcagtagggagggtcactggggagaggcagggtcagtagaggtgttcagtgacttggtgtgggatccatgagggctagtgaatgggggtggcagacagtgaggcccaggagggcccacaacaaggcgttgggatggggaggcttggtgagggtgcgagaattatctggggtctgtccatactcggggtgagatgagataaggggtgtggggtcatgaggtcacttggggggtcaggcggcagccgttggagctccagccgccgttggcactgtggggcaggaagctgagttgggtaagagcctgtgtcagcttcctgtgaagctcccgggccccaccacaggcctggcagtctcctgggggacggggcaggcggtggcatgcacctggtggccaagactgggatggggtggcaccatgggggtatcgaggacgtgcatctgctccagctccatgtggcggtagagctgctgcagctgcgggggctgcacgctctggagctccgtgaagttgttctcggcgaagctctcgaactcgctgtgcacgtggtgggggtggaagtcccagtaatggtctgtgggggacagccaggcagtatggggtgagctcagggttgggcagggcaggaaaaggttatagtaacattaaataatactgccaggccatatggggcctaaccatctcgtttaaccctcgccacctgcatggttactctaggcctgcattttatagatgaggacactgaggcttcgagcggctacatagcatgcccaaggtcaaaagcatccgggtcacagccaggactcagggctgaagcaaagctcgtgttctcagcaattccatcctgattcctgtgcagtcacacagaccgagcgtctaatcctggctctgccatttacttgctgtgtgacctcaggcacatatgtggcctctctaacctcagttgagttgcctgtaaaatggggatcacagttattgggaagatacgaatgagtacacatttgtaaaacacctcgcaccagagccggccctcagggaaagttgattcccctcctatcctgttaaaacctcccagccagggccgcgcgcggtggctcacgcctgtaaacccagcattttgggaggcggaggcgggcggatcatgaggtcaggagattgagaccatcctggccaacgtggtgaaatcccatctctactaaaatacaaaatattagctgggcgtggtggtaggtgccgtaatcccagctactcaggaggctgaggcaggagaatcgcttgaacccgagaggtggaggtagcagtgagccgagattgcgccactgcactccagcctggcgacagagtgagactctgcctcaaaaaaaaaaaaactcggccgggcgcagtggctcacgcctgtaatcccagcactttgggaggccgaggtgggtggataacgaggtcaggagatcaagaccatcctggctaacacagtgaaaccccgtctctagtaaaatacaaaaaaattagctgggcgtggtggcgggtgcctgtagtcccagctactcaggaggctgaggcaggagaatggtgtgaacccaggaggcggaggctgcagtgagccgagattgcgccactgcactccagcctgggcgacggagcgagactccgtctcaaaaagaaaaaaaaagaaaaaagaaaagaaaaaaacctcccacgggttcctgagctccctggctgcccacagtctctctctctgtctcacacacacacactcacacagccttgtcacatggccaaggtgtgacagcagagtcacagggctgacattcctcacacactagaacttgtccaggcacacggtggcccttcctcttcaaagccatgaccttaagcagtggcacctgtgttcccgtgaggttcctgggacctgagactttcctggaaaaccccctgtgggttccttgagtctgtggtggaggagactgaagtccggggaataaccccatgccaccaaaagccctgtcttggaactggggaagatcttcagcatgaacaccttttccaggaacaaaaactgccacacatctgcgggacttcctgggcgcaattcggggtccaaaatgaagcgtggtaataaagtgacaagatcggctgtctcatgtgggccaaagagggcgcctacgagactccaggtccaggcagtgtctctgggacaagtccaccaccagccatgcgtgcgtgtgtacgtgtgtacaaaggtgtacacatgtctgcctgcatctctctttctctctcacacaaacacctaatcacacatccctaatagataatcatgatttttggttctggactggatctcggagtactcgctttctaaacctgctttgcagtatgaccatggacaagacatttttttctcccggagcctctcattccccactctaaaagtcagaaatgcttttagacctgggtagttactgaggccttgtctacatgtataattatttggcctcacagtccagacaacccagactcccacctttaggaagccacatggcagagaggagagaaaggcagagctgggctcaagttctggctctgccatttaccactgtgtgacaatgggcaggtcattctatttctccaagcctgtgtcctcatctgttaaatggggctaacaattacacccatctcacaggcttgttttgagaagcaaatgacctattgcttgcaaagtgcttagactagaacttggcacaaagacagaccttgataaacattaacttcatcattatcattattattaataataataatagtttattctaaagagcctagattcccactgagtgtggttacacctataatcccagctacccaggaggctggagagggaggatcacttcagcccaggagtttgagaccggcctgggcaacatagtgagaccctatctctacaaaaaatgtttaaaaatttgccagacatggtggcacacacttctagtcccagctacttgggaggctgatacgaaaagatcgtttgaacccaggagtttgaggctgcagtgagctatgattacatcactgcctccagcctgggtgacagagtgagaccctgtctctttttttttttttttttttttctctgagatgaagtctcactcttgcccaagctggagtgcagtggcacgatatcggctcactgcaacctccacctcccgggttcaagtg

SEQ ID NO: 1149 - DNA, 356544 bp, Homo sapiens
ggcaggagaatagcttgaacccaggaggcagaggttgcagtgagctgggatcgtgccactgcactccagcctgggcgacagtgtgagactctgtctcgaaaaaaaaaaaaaaaaagaaaaaaagacagagaacaggttctaaagaaggaagaacatagatgcacaactgtgaaatagatggccttgggcgggactgggggaaagaacaaagtccagtatttggacttggcactgctggaatgtggggaataattatcttaacgatatccctaagatcatgaataaatctgcgcactcatgcgttgagttacctaatactcaggataggagcgtgagaaggtttggtccaaggaataatgagtcttttgcctattagtccttctactatgggccttaatttttttcttctggcttcaagggaattgtacaaggctgggtgaaggttgggacctggtcagtctgaaccttgatgtgctcagccccagtaatcctaaaatggtgatacatttttggctcattaggacttggtacctcacaaagatcttcaaattgtgtctggtttatgtatctgtatccaaattagctatgatttgattatgaatagagacaccctcatgagtttcaaggaagagctcccttctaggaaaatttaatctggtgattccattttcataataaagactcctcattaagtttatgctggtgtgatgtcacaagagaagggtgtttttagtaaaaagaccaagaataacagtggccaggatacagggagtggccaggcagatggagacatccacctcttggtttttgctgactccaaggacaagaagtgaacttagtggcagggttgttgttgaaaatgttgcacccctaaccctgagtgtggcccagaagagttaatgatatcttcttgcaagttttaagggaagactcagaagtggatgccatcttctctcttggaactgtctcattatctgtcagattcctttttgcccaaagtgagacaattggttttccatcgtctcttttgttcagagtagcagcaagtattcttatcactgggcattttgctgggggggattgtggaggttgtgaggtcatccagttgtttaatttgaaaaaccgttaagttgtttaggatcttactctacttttgttctaagagtttctcagaagatttggacacatgctatagggctgttagtggagttatttcttattctagcctttaagtaccaaacccctgaattttggctaaaggccgttcataagcaatgaggataatgtagcaaaacatctgcctattgatctatcccagactgttgtctgaaggtgatttctaaaaccttttcttttttttgagacgtagtctccctctgtcacccaggctggagtgcagtggtgcaatctcacctcactgcaacctccgcctgccgggttcaagaaattctcccacctcagcctcctgagtagctgggtaataggcacccaacaccctgaatacagttggggtttcaccatgttggccaggctggtcttgaacttctgacctcaagtgatccgcccgccttggcttcccaaagtgctgggattacaggtgtgagccatcatgcccagcaatttctaaaatttttaatgaatttgctttaaaaaaaaaataaaaaacaaacacaaaaaaactggattaatgaccagagaatctctactcaaaataaagtaggtattgccttcagtaaggattgcactacattttgtgcttcttaaaagtccctttctgtttgctggtcctcaggaatacatagattatttcccaggtccttccagtggactctttaaggtagggttagcatctagatacatgtactaggtgatgtacatcagggagattgggaccattgcttccaagcactattctagattctcaggttcttcatatcggtcataaaaggctgacaattaaatattaaacatttgctacttccccctttttttgctcttttgttttaagatgttcctaaaatggataattttggtcacatttaaagttcctcaaagtggtcatttggtaaattgtgtcactttgtaagatacgcataagaataacaagaatatgtttaaaggctgggcgcagtggctcatgcctgtaatcccagtattttgggaggccgaagtgggaggatggcttgagaccaagagtttaggctagcctgggaaacaggaaacccctgtctctataaaaaatttaaaaataagccaggcgtggtggcgcatgcttgtagtcccagttgcttgagaggctgaagtgggaggattgcttgagccgggaaggtcgaggctgcagtgagccatgattatgccatggcattccagcctgggcaacagagcaagactctgtttcaaacaaacaaacaaaaacaaagaatatgtttaaaaagtgagtatccaggccaggcatggtggctcatgcctataatcccagcattttgggaggcagaggcaggcggatcacctgaggttgggagttcaagacaagtctggccaacagagtgaaaccccatctctaccaaaaaatacaaaaatcagccaggtgtggtggcgcacacctgtaatcccagctactcagggggctgagggaggagaattgcttgaacctgggaggtggaggttgcagtgagccgagattgcaccagtgcactccagcctgggcaacagagtgagactctgtctccaaaaaaaaaaaaagaaaagaagtgagtatccaggaggcatggcatgggctttcttggactgagacaaccccttgagaattggtaaggaccaaacctgctgcttgtgtacttctgatctcagcccacaaccagaggttagctgcctttgaccaaagaactgataactgcagcccctgatgatcaaagtttttggagactttttttcccaaatcagttcttaaggatagctaggggaataatagacttcataaggtttttagatggttacccaaggcaaacttcatctaccgagggagactggtgtgacaagaccttacacttgtcagtccttttgtcatggacgcattgggactctgtggattgatcatttgttgctttttttccatgtcattacacaatataagaaaggacaagataaagataaggttaggcaaagagcatacttccaccaagaatcattagaaagataggtctactcagaaaagtggagtttcagtgggtaaaatatgattttcctgagaaaactagccacgtcaatgaaattggagctcacacttagtgtgcggctcccctctctgctgaggccagaaaatgcaagcggaagagagaccagccctcaccccacccccgccaccaccagatgcccagatgcagagtcctggcaatggcagagagtcacagttgagtctccatgggacctccaaattgtggaatcattcctccttaaataaacaacctgttatgagataaacaaaccgtaaaaacacccacatacaatcctgaaatgggaaatgggtgtgctttttttttttttccttcttcttacaggttgggttgggaagctcctgagatgggatatcaaacctggaatgactctttggttgattcctcaaggtcatggttgatataaccgaggtgaggttctacttgaagaaagaagtgatactcgaagcacaaaacattgtacaattataattccataaccaacagagctatcattctgcttctgtcttccacaactgatggggggtgtgtgttctgattcacagtagtgacagccaaagccataggtagaaaaaaaatcataaccataaatgattttaacatttttttttttctcaagacagagtcttgctctgtcacctgggctggagtgcaattgtgcgatctgggctcactgcaacctctgcctcctgggttcaagcgattctcctgcctcagcctccccagtagctgggattacagttgtgcaccaccacgccctgctaattttttgggtttttttagtagacacggggtttcaccatgttggccaggctggccttgaactctttacctcatgatccgcccgcctcggcctcccaaagtgctgggattataggcgtgagccaccatgcccagccaattttgacatttacatagaatagaaaataaacaaaatcagaattcaagataagaatctagagaaagaatgactaaatacacttaatgaaatcaggaggaaaggatttattttaaaaaaaaatcctaaacttgatggattaacaaactaaaaataaagaaattaataaataaaaccaagagctgctgctttggaaaaatcattggagctgatacacctttggcaaacataaccaaggaaggaaaaaaataaacaaaaaacaagaaatatacagcaatagtaatgagaaagaaaacatatccatagataaagataagattaaagtaatgattagagaagtctatgtaaacctcatgtccagtagagacagataaacatagagaactttatttttattttttccagacagagtctcactctgtctcacaggatggagtgcagtggcaaaatctcggctcactgccacctccacctcccaggttcaagtgattctcctgcctcagcctcccgagtagctgggattacaggtgtgtgccaccacgcctggctaatttttgtatttacagtagagacagggttctgctatgttagccaggctggtctcaaactcctggcttcaggtgatccacctggctcggcctcccaaaatgctgggattacaggtgttagccaccgcaccccaccaagatagaaaactttaaaaacgcaatctcacttttatgagaaagtgcaaaattgcaaataaaatgagacactgaaatctggcaatacattatgaatctatgatacaggattatctgtttgcctatgaaggatgaactgccagggaagttgacctcctgccataaacaatagaaaactagacaaaatatatgaatcagctgttcttagacggtgggcagcaggcagcacaggaactgtgacacccgagagaagggaaacaaatgagccaagtggtaggatgcctaagtttaccactgaggcagtttctatgacatagaacagaaagaggtccccaaattaaatcccctgggctggctgagttgaagacagagatctaagggttttttttgtttgtttgtttgtttgtttttgttttgttttttttcttttttgagttggaatctcactcttattgcccagactggagtgcagtgcagtggcatgatcttggctcattgcaacttttacctcctgggtttaagcgattctcctgcctcagcctcccaagtagctggaattacaggtgggagccaccacacccagcttattttgtatttttagtagagacagggtttcgccatgttggccaggctgaactcctgacctcaagtgatccacccgccttggattcccaaagtgctgggattccaggcgtgagtcaccgcgcctggccgagggcttattttttaatgatgtgaggcaaggtggttagaatttgtgcacaggatactagtgaaggggaaaccacacagaaagatgggtctggaaatttgcaaagggatctgagtcttcaggtgagcactgatctactcatgtatgagaggaaaccccacaaggccagggaaagccactagagagcagtgggccagacaattccaggatcttcccaagggctgagaagacttctcattccagtcacccggcacggagagaccacagtacatagggcattggggactgttacctaaagagtgggaaaaaaaaattgtcccacattaaaggctgctccggacctgccctcacaaagcttaaaagcaagcctcaaaagcaagtgtcaaacctatcttaagtaactacatgtcaggacaaagttcaacagtttttaatggaatagaacaaaatccagcactcaagaatgtaaaattcacaatttttggcatctagtaaaaaaaaaaaagaaaggcatgcaggaaggcagaaaatggaccccataaccaaaatacaaaacaatccataggaacagactcagaagtgatagcaattatgaaattagtagagaaatatgataaaatagttagtatagatatgctaggccaggtgcggctcacaccagtaatcccagcactttgggagaccaaggtgggtggatcatttgaggccaggagtttgagaccagcctggccaacacggtggtggatgcctgttaccccagctacttgggaggctgaggtagaaggatcacttgagcccaggaggtcgaggctgcagtaagctgagcttgtgccactgcactccaccctgggcaatagagtgagactctgtctcaaaaaaaaaaacaaaaaacaccaaagtgctgataacaaatatttaaaaccaaccagaaaaaaacaaaaaaaaagacattacctaaggatgaaaaaaggtaagaatgacagcaaactttccattacaatcaatgcaaactataaaaacaatatagagacatctttaaaatactgaatgaactgtcaacctgaattctgtgcccctgaaaaaatctttttttttttgagacagagtcaacctccaccccctgggttcaagtgattcttccacttcagtctccccagtagctgggattataggtgccaccacacccggctaattttttgtattgagttggggttttgccatgttggacaggctggtcttgaactctgacctcatgtgatccacccaccttggcctcccatagtgctggaattataggcatgagccaccatgcccgacctaccccccaaaatcttttttaaattatggtgaaataaatactttcccacaccaacgaaagcagagaaaatttataactaacagacctgcactccaagaaatgctaaaggaagctcttaactgggtgtagtagtctgtacctgtagtcccagctactcaggaggtggaggcaggaggatcccttgagaccaagagtccaagtccagcctgaacaacatagcaagattccatgtctataaaaataaataaataaaaataaaaatagctttaaaaaggaagttcttggggcagaaggaaaatgatgatagatttaagcccaggcatgtcaataattacattaaatgtgcatggtctaactatgccattaagaggcagagtttatcagattgaataaaaacaaactccaaaaaacagtacaagttctgactatagattgtctacaagaaacccattgtcaagatctgtgaaagatctgagatttcatccttacttgcaagttaccaaggcagcctgccatagcttcatggttgctggttgaagacatcagaatccagggccagagctgaagggcaatttatcactcacagcaacagcaacagccagactaccaacatttttgcacgagttctcaaagtcttaatcccacagggcaatgtggagggtcagatgactccagtgcacacagaaggctgcattataggtgtgtagggagttgggaatcttatcatttataatgggcagtgagcacacctgccctttgctctatcttccaagacaacgaacttactcttgtctctagagggagacactatattttccatgtggttggccattcaaacatcctatatgaaaacagtccagagccaggcgtggtggctcacacctgtaatcccagcactttgggggccaaggcgggtggatcacttggggccaggagttcgagaccagcttgcccaacatggtgaaatcccgtctctactaaaaatacaaaaatgagcctggcgtggtggcaggcgcctgtaatcccagttactcgggaggctgaggcaggagaatcacttgagcccgggaggcagaggttgcagtgagctgagattgcaccattgcactccagcctggatgacaagagcgaaactctatctcaaaaaaaaaaaaaaagagaaaacatagtgtagaatagagggtatttgttgcactcacaaaatgtacagaacaatggagaattgtctctgtttctcattaattgttgcagttttgataatttgcaacaaatactttttttttttttttttttttgagacgtggtcttgttctgttgccaaggctggatgcaatggcctgatcatggctcactgcagcctcaacctcctgggctcaagtgatcctcccacctcagcctcccaagcagctgggacaacaggtgtgcactactacatctggctaatttttgtattttttgtagagacagagtttctccatgttgcccaggctggtcttgaactcctgggctcaagcaatctgcccactttggcctcccaaagtgctgagattataggcgtgagccaccatgcttggccaacaaatacaatagattactcctatgtacaaaatttttgtcttcagaaacatgatctaccctacaccaccccccaacccatacccctgacagccccccacccccgcactgcacgcccccctgcaaatctgatgcagctacagtaggagccagctttgtttaaatgtctgtatccatctaggaccaatccagagagagaaaaaccatatagtaatttgaacaggaaaagcttactataaagaattattctctatagcaggagattggcatgattatgcaataatatatgtgttaccaactccatactccgtgggctgagatccatggctcagtcatggctactgaacggcggacaagttgctgtgatgccataatggtgaaacttgctagaaatcagtcctgtagggtgctggggaaagctgtttatgggaagatgtctcactaccgcgccttggctacaaaccaccttaggaggttgcaggggaaagccactggccactgagtgttgctggctgtgtatggcagcaggagggccctggagaacctgtgagccaaaggcgctgggggccagcgaaaccacgcgcccctgccaaccccgctgagactccaccgagccggaggcaaaactctttctcctgcaatgtttctcgagcgccctctactggcaaaacttcggtgccaacggcaaattcttgaaaaggttcagatttattttcgcaaagcagtcaaataaggtgaattcagaggtgagaggcaataaatcaataactggtatagagtccaacaggtaaataaacccaaaccttttattcttgcaaatctaggcttcgtttccttgtttttaaaatggtgggagaagtagggaaagaaaagacaaatttgaaatttctatcatatttcattagttttaaaccaaatgaatgctgaacttctcttttccattctttcctcttattacattaactctgacatctcgtgactgttgtcagtcttcggaaagcaagtatagataaaattttgttcacagttccttttgctcaagtttgttagaattgttccagaaaggtagggatgtgtttgtgtgtgtggggtgtgtgtgtgtgtgtgtgtgtgtgtatggtcagcctagagaggtgatatgtagctcatcttttttttttttttctttaagacagagtttctgtcttgttgcccaggctggagtgcaatggcgtgatcttggctcactgcaacctccgcctcccaggttcaagtgattcttctgtctcagcctctcgcgtagctgggattacaggcatatgccaccatgcccagctaatttttgtagttttagtagagatggggtttcatcatattggtcaggctggtctcgaactcctgacctcaggtgatccgcctgccttgtcctcccaaagtgctgggattacaggcgtgagccaccacacccggccagctcatcttattttagaggtgggatctcagtatattgcccaggttaaagtgcagtagcttcacaggcaccatcattgtgcactacctccttgaactcctggggtcaagagatcctcctacctcagcctcctgagaagctggggctacaggtgcccaccaccatgccggcctcatgatttatagctcatcttatgggtccctggtggaggcaagaaataaaaagaaaagcagtagctcttgccaggtcctctccttctcttccctttaagaacctgctttgaggggcactttctgattccccctctctctctgacacttgctgcaggggccccacagatcactctcctgggcattgtgtgatgattggcggccatgtctctcagggcaaatgatcgttttttcgctttctctttcctacttttccctctcttcacactttcatgcttttactctcatgagtaataaacagcactaatattaacaacaataatatctggagtttgtctcactttcctgtttttcattctttcgtctctaagacccagtcactgagggctcagaggctcccgaggacctctgctgaggaatagtcccagggaattgtttgctcccaggaatcctgtttctgcaagaacaacctcttcagtctttctgttgttgtttgtttgtttgtttgtttgtttttgaaacggagtctcgctctgtcgcagaggctggagtgcagtggcgcaatctctgctcactgcaagctccgcctcccgggttcatgccattctcctgcctcatgaggcctcccgagtagctgggactacaggcacccaccaccacgcctagataattttttttttctgtatttttagtaaagacggggtttcaccatgttagccaggatggtctccatctcctgacctcgtgatccgcccaccttggcctcccaaagttctgggattacaggcatgagccaccaagcccagcttgcctcttcggtctttctacactgattaaatgtcctcaaagaactccttgcctagcttgaagggtaggggccttgatacatggtgatggtcccagacatctgggaaagacatctattattattattttattatttttttgaaatggagtttcactcttgttgcccaggctggagtgcaatggcgtggtcttggctcactgcaacctctgcctcctgggttccagcaattctcctgcctcagcctcttaaatagctgggattacaggcgcgcaccatcatgcccagctaattttgtgtttttagtagagacggggtttcaccatgttggccagactggtttcaaactcctgacctcaggtgatccacccatctcagcctcccaaagtgtagggattacaggcatgagccaccatgcccagcctattattgttgttgttattattattattattattattattattattattttaagatagagtcttgctctgtcacccaggctggagtgcggtggtgtaatctcagctcactgcaacctcacctcccaggttcaagcaattctcctgcctcagccctccaagtagctgggactacaggtgtgtggcaccacacccggctaatttttgtattttttagtagagacggggtttgtcatgttgcccaggctggtcttgaactcctggcctcaagtaatctgcccatgttggcctcccaaagtgctgggattataggcgtgagtcaccgcgcccgaccagaaagacatagtcttaacaagagcaagtagctttatttgccaacgaccagtttgggcttagttcatcggaaaaggctattgcctaccttggatgaaagagcctgggactggctgcccctgtgtccctccccggagcctgcttgtctattagaagaggctggaaggtgggcctttggtcttagcagggatagccctgcagtttctctccacgcttggtcccaggaagtctcccttctagttaagaggctggtggtgctggactccttacctggagagtatacctcctcaactccagtagctcaactcctgacctttggaaacagattaaataccaccatttctataaaaccttccaatgcaaagtagtcactcctatttcctataatttacttcacttgggaggactataactttctgccctacttttttttttttttttttgaggaagggtcttgatcctttgcccaggttgtagtgcaggggtgtaatcatagttcactgcagccttgacctctcaggctcaagcaatcctcctacctcagcctcccacttagctgggactacaggtgctcaccaccatgcctggctaattcttttttgtattttgtagagatgaggtcttgctatgttgcccaggctggtctcgaactcctgagctcaaggaatcctcccacctgggcctctcaaaatgttgggattacaggcatgagccaccgtgcccagcccaggtaccctacttctgtagttgcttacttatatttgtatcttccaggtagaccataaggcattcatttttgccctttcaaagcagtttgtaagtaaataatggcaaaaaccacaattttgcactgaccttaatatttgtttggtcagtgaaggagtgaattacattggcttccatcattttctttcctttcatcttcctctgcagcccctcctgcgcatcttcctttccacctttcagccaaaaatgctcctgctcactcagaaatgccactttcactatcatgtccacagcatggcattttcttaaggggagcccccactacctgggctggagttagacacatgcctggcaggcagcagaaatagaagtgcttaagtccctgatacacatgcaggatattcacaatacccagagaagcctcgccacagcatctgccaatgcactgcagaggctgcaggggtgtcccgcgggtctatccggcatccatccacacctcttcagaaactctcgaatttcctgaggccagaccacggggcagtgtgttttgtgatggagccctagatcgcaggttggccaacccaagtgcatgttccgactccactacctactggttgggagtctcaggagattctggacaatgaagagaaccagggaatgaggggtccaccagaggctgaactcaccattcagcagcacagattctgacaacagaacagggcgttagagggagtcagtgggctggtgggcactggatgcaagaggaccccacaggggtcgatgaatccagggatctgagtctagactgtgaggtcagcttcctggtgattggagctttgttgtattgtgagagagctcattgattccgcatgagctgccctccatttggccagctgcacccaaggcctcagcatgctgaatccagagcagtctaataatcaagaagccccatttctaccttgtccaccgcttactcacgtgctcctaccacatggcctggcgaccgtgggctcagttggaagtcctggattttacccatctgttgacccctggcctccacaccattagttcctgccacactgcacatacttcataaatatacacgaattgaattgaaatatgttctttgtagggcagtttggaaaagggtagattcagagaaggcacttactttttaggaagtatcattttctgtgttttcgttttgtttttaaattccaagaggaatttaaaaatcctcttgttcagaccacatagaaactattaagagagagctcgtctctatgagaaaccactggcaagagggtgctgggccgagggcgccggtgtctctgtggaaaaggcaagtagacagtccaaatcaggagcgggacaatggccagctgtggaacaagagaacaaacagtgaaaagcgaactttcacagggagaaggcaaagcaattgccgtggttactccctcgcttgggaggtcatcgcagctgcttagctcagggtctggggccccccagtgggagaaacattctgctttctctgcaggaggtttgtgcgtaggcgtttctgatgatgaaagtacgcagtttattatcattatagcatatttacaaacgttggaaaaaagtcagagaaaaaagttatgtgaatttcatcagctaaaaatgtctaatgaggaaagactaagaaaactgatactacagttatgtgtcgcttaacgacagggatgcattctgagagcagagttgccgggtgatttcatttttgtgtgaacatcatgaaaagttcatagaaggttaatagcctatataataggtgacagaatcattgacttaagttatgtccaatttttcaataatataaataatgccaacataagtttgtgctcacagtttttctgtatttcgtattatttgccttaggtaagattctctgaaatgggacaaacaaaaaagactcctgatacctgttgtcaatttttctttttcttttttttggagacagaggctcgctctgtcacccaggctggagtgcagtggcacaatctcagctcactacagcctccacctcccgggttcaagcaattctcctgcctcagcccccagcctagacagggaatttcaaagacctgtgatgactatggtaaaggctctagagaagaaggtggacaacatgcatgaacagatgggaaattgcagcacagagatgaaaacagcaagaaagagtcaaataaaagtgctagaggccgggtgcagtggctcttgcctgtaatcccagcactttgggaggctgaggcgggcagatcacgaggtcaggagatcgagaccaccctggctaacatggtgaaacctcatctctactaaaaatacagaaaattagctgggcgtggtgccaggcgcctgtagtcccagctactccggaggctgaggcaggagaatggcgtgaacccgggacgcggagcttgcagtgacccaagatcgggccactgcactccagcctgggggacagagcgagactctgtctcaaaaaaaaaaaaaaaaaaagtgctagaaaggcctggtgtggtggctcacacctgtaatcccagcactttgggaggccaaggtgggtggatcacttgaggtcaggagtttgagactagcctggccaacatggtgaaaccctgtctctactaaaaatacaaaaattacccgggtgtggtggcatgcacctgtaatcccagctactcaggaggctgaggcaggagaatcgtttgaacccaggaggcggaggttgctgtgagccgagattgtgctattgcactccagcttgggtgacagagtgagactccatctcaaaaaaaaagaaaaaggaaggaaggagggagggaaggaaggaaggaaggaaggaaggaaggaaggaaggaaggaaggaaggaaggaaagaaacaaagaaagaaagtcaagtaaagtgctagaaagggctgggttcggtggcttaaacctgtaatcccagcactttgggaggctgaggcaggcggaacacctgaggtcagggatttgagaccagcctgagcaacatggagaaaccctgtctctactaaaaatacaaaattagctgagcatggtggcgtatgcctgtagtcccagctactcaggaggctgaggcaggagaatcacttgaacccgggaggcggaggttgcggtgagctgatatcgcgccattgcactctagcctgggcaacaagagagaaactctgtctcaaaaaaaaaaaaaaaaaaaaaaagtgctacaaaggccaggcagggtggcttacatctgtaacacctgtaatcccagaactttgggaggctgaggcgcaggcagaggattacttgaggtcaggagtttgagaccagcctggccaacatggtgaaacaccatctctactgaaaatacaaaaattagccaggtgtggtggtgcatgcctgtaatcccagctattcaggaggctgaggcaagaaaatcacttaaatgctggaggccgaggttgcattgagctgagatcaggccactgcactccagcctgggtgacaaagccagactttctcaaacataaataaataaataagtgctagaaattaaacagctggtgccagagattcttcaataaacttaccacacgactcaacagagctggtgaaaggatcagcgaaggtaggttaatagaaattatccaactattcatctttgtcctgggctaggtaaaaaaagaaaagaaagaaaaggaaaagaaataactcaactaaaaattcagagatctttacaaaatcactaagataatttatttttggagttctgttgtgttctttgcctccctattattccttgcctcctcctattttccctcaaaactcttttttttttttaaagacggtctcattctgtcgcccaggctggagtgcagtggcgtgatcatacctcactgcagcctagaactcctgggctcaagcaatcctcctaccttagcctcccaaaatgctgagattacaggtgtgagccaccatgcctacttaatttaaaataaattttttgttgaagagacagggtcttggccgggtgtggtggctcatgcctgtaatcctagcactttgggaggccaaagcaggaggatcacttgatcccaggagttcaagaccagcctgaactctacttattttatttatttagggagcaacatagggagatcctgtctgtacttattttatttatttaattttttttttttttttgagactgagtctcgctctgtcacccaggctggagtgctgtggcacgatctcggctcactgcaacctctgcctcctgggttcaagcaattctcttgcctcagcctcctgagtagctgggattataggcatgtgccaccacgcccagctaatttttatacttttagtagagacagggtttcaccatgttggtcgggctggtctcgaactcctgacctcgtgatccacctgtcttggcctcccaaagtactgggattataggcgtgagccaccacgcccggccatttatttattttttgagaatgggttatgaaactggctaatttttcgtatttttcgtagagaccagatttttcaatttgtccaggctgctctccaattcctggcctcaagtgacccatctgcctcagcttccccaaatgctgggattacaggtgtaagtcactgcacctggcccctttcacccatttcttatgagcctagtagcttctttttttttttttttttttttttttttagacagagtcttgctctgtcgcccaggctggagtgcagtggcattcactgcaacctctgctcccaggttcaagtgattctcctgcctgagcctccctgagtagctgggattacaggcatgtgccaccacgcctagctactttttttgtatttttagtagagatggggattcaccgtgttggctaggctggtctaaactgcctgacctcaagtgatccaccagcctccacctcctgaagtgctgggattacaggcgagagccacctcacccacccccagtaggttctttaattctcttctgaaactagtgaggtatcttgtttcaggtcttactatgttggctctttttccttgaacagtgttaaataatcttatttaattgaatctagggccagtcgtggtggctcacacctataatcccagcactttgggaggccgaggtgggtggatcatttgagattgggagtttgagaccaccctgggcaacatggtgggcgaaaccccatctctacaaaaaatacaaaaattaggtggtgttgtgtgtctatagacccagctactcgggaggctaatgtaggaggatcacctgagcccaggcagggtgaggctgcagtgtgccgtgatcatgccactatactccagcctgggcgacagagtgagacgctgtctcaaaaaaaaagaatctaaatgtcttcagttgttgaaagatgaacttttctttttcttgagatgaaatttcacttgttacccaggctagagtgcaatggcgcggtctcagctcactgcaacctccgcctcccatgttcaagtgattctcctgcctcagcctcccaagtagctgggattacaagcacctaccaccatgcctagctaatttttgtgttttcagtagagacggggtttctccatgttggccaggcttgtctcaaactcctgacctcaggtgatccacctgcctcagcctcccaaagtgctggaattacaggtgagccactacaccaggccgaaatattaactttttttttcttttgagactttttgctcttgttgcccaggctggaatgcagtggccgatattgaacacctcccgggttcaagcaattctcctgtctcagcctcccgagtagctgggattatggcacataccaccatgcctggctaatttttgtatttttagtagagatggagtttcatcatattggtcaggctggtctcgaactcctgacctcaggtgatccacccacctcagcctcccaaagtgctgggattacaggcgtgagccacttcacccggccgaaagatgaacttttattttataacccataataatgaaaaagatgctgccaatttaaccatgacaacctcatcctatcacttagaatttaactttttatatttattgaaagagctattttagacttgctagacataaattttaatcatatatcactcttgtgaaaaagaaaatacgagagaaataatttggttaaggtgttcctaaaattcacactcagaatccagtgctaatgaatcactttttgacttggagttttcaatgtctgtgtttctattattattattattattttttttttttgacgaagtcttgctctgtggccaggctggagtgccgtgatgcaatctcggctcactgcaacctccacctcctgggttcaagtgattctcctgcctcagcctcctgggtagctgggactacaggtgcccaccaccatgcctggctaatttttgtatttttagtagagatggggtttcaccatgttggccagtatggtctcgatctcttgacctcgtgatccacctgcctgggcctcccaaagtgctgggattacaggcatgagccaccatgcctggccaatgtctgggttttttttttttttttgagacggagttttgctcttgttgcccaggctggagtgcaatggcatcatctccggctcaccacaacctccgcctcctgggttcaagcaattctcctgcctcagcctcccgagcagctgggattacaggcatgtgccaccacacccagctaattttgtatttttagtagagatggggtttctccatgttggtcagggtggtcttgaactcccagcctcaggtgatctgcccgcctcagcctcccaaagtgctgggattacaggtgtgagccactgcgcccagctgtctgtgttttttgtgtaatattatcctctttgtcttaagaatattggtgatctgggaattaaagagtgcttcaattgtagccattgaaatgcaaaggataggaaagaaaaggagaggggagggaaggggaggggaggggagaaggagggaggggggaggggagaggaggagaggagagggaaaaagagtgctccattattgtctctggggttttcctccaagatattcagaatcattctatatgtttttattctagtacattttggttttactgggtgtccagacaagtaccagaactcatatttctcctctgaattgacttcattgactgaaatgttaagaattttagtcatatttcattgtccagtcacacgtcttctcttccgacttgtgaagtgttttttttttttttttttttttttttttggtagagacagtgtcttgctatgttgcccaggttggtcttgaactcctggtctcaagcaatcctcctgcttcagcctcccaaagtgctgggattagaggcatgagccacagtgcccagccttggtttgtgtagtttttgactggaggattgcaccagctgggcatggtagtacacaactgtaatctcagcttcttgggaggctgaggtgggaggattgcttaaggccaggagttcaagaccagcctgggcaacatagcaagactccatctctaaaaaataaaaatcaaaagaagattgcagtcattcttatgccgttcacctgtgtgtaatgcgtcatctttctctggctgcttttatggtttcccttttcatcactggcattcatccatttgattgtggtgcgtcttggtgcgtgtatgttgatgtgtctataagtaaatgagtgtgggtggtgcatgcgttttatcctacttgaggcttgtgagcttcttggatctgtggatgtatatcattcatcagatttggaaaattttgtctttatttcattaaatattgctgttatgccatagttcacctctttcttcacagatctatttcttcacatatattcgggtctgctcctctgtgatttctgtggacttctctttcttggggaaaactgagaagagagaattcagtgggatgaactgtagtcgccatcaatgccattggtcttgagaccacaactggcacttgccttctttctccccctccattcattctaaattcccctcatcctcagcaatcacctcaggaggccttggcttccctgggggtgtgacccaaatcttcattcctgagggctctgagtctttcagtccagatttgctgcatgtgtccattcacagttacaatggatccaggcaattctgggatgcactggacagccctacttcctcctgccaatcagggttaattgccctgccactgtagtgactcttctcacctgctggttctgggcatgtgaagtcctaagtgtgccagtggcggccgtaacttgtagttcaatggacccttaccatgtccactggcaagtgtgctcccttcgagatcaggacctccaacgctgcagcacccagagtttcggggatgacaaggataaaattccccagtgggctattgggaatcatgttgaaaggggccattcctgcttccatcccttgagtcccagatccacatattctctgattaaggacacagtgccatttagaggtttctgatttagtgcataagttgaatcctgaaggagtatgcctccgagctagcacttcccgttgtttttcaggaagctgctcccaagctctgtgaggccagctgcttcaacctggagcagtctgtcatatgaccatggaccctatggccaggggccccctcctgccccaccttcactaggaagttgggcctcttgtcagatattctgctccttgtaattctgtgtttgtgaatcaggaatcccccaagcctggcagaggatctgtggtcagggaaggtcaatccatgcccgggtatctaaagcggtgaggatgaactgctgaccctccaagattgaaggggcacgatgtgtttgcctttcacagatctggtctggagatatagcgccatactggggctcagtattggtccctgttgctcacaagttggacattcggaggcagcaatggctagctctgccttggtaagtgaaaatccacgttgttgggcccaagcagagccccgtctctgccaccatgggcatgccattcatgtctccagccgttctggggtgactgaaggtggctcatgtccactggcaagtcattttgtctacttggttgttcagtgcgtctcttgtggtagatgtttccagtgggcattaacatgcaaatcagaagtccttgaactgtctacccatttccatatgcacatccacatgcctctttctcaggattccttgtctccaatcttccaatctgtttccttccaagtccctgaccagatgctcagaccattggtcattggccaggaatttgtacatattttcccttcaggccacttttcctcacacgtatctactccttgcagcttcccccattgagaacattgttccctctttccgggccacccgtcagtgtggctaatgtccgcttttagctctacccatgaactgagcagatccatctgtaaaccaagcttgggctttttccttcttatttagccagtcatatggactctccctagtaggctgtacacataaccaggggagggcatgggtgcatctgttatgggtgacatgggcctctgggcttcttgctcatgcagcttactcatgccctgtggcccctccaggacccaatcctgatggatcacttccattttatgattgctgctggacacatgtgactttatgacttgttgggtccaacagaacccagttcccagcagtcacttatggacgtgtggtcacatggtgtttggtagccaagggttctatctccaccaggctccagtaacagttgcttctcaaacagcataagctgctctgctgtggatatcatggtcttgctccagaatcccaggaggctgcgatctgattcttccaccagagctcgccattacccatcccctcacgctgcctcctttccaactgctgactacccctaccccaccaacaccatagggtctgaagatcagatggtccaagttgcagtgtggtttgcactgtggcctggacctgtcacataaccctttcctgctccaggcctcactcaaagctggaagccttctgtgtcacctggtttacaggctggagaagtattcctgcatgtggaaggcactgaatagtagtcctcagagtgtagggtgttacctgcaaaactcaaatagctctaccaggagctgtgcctccttgtttgtggtaggagattccagatgcagcaatttgcctttcactttgaagtggttatcttggcatgccctccatcactggacctctcaaaatgtcactgaagcagccagtccctgagtcatcatagcatttacttcccacgagcttaccaagacttctggtatatgagcctctcatctgtcctgtgcaatcagcacaacgtcactgatagaatgggtcagcgtcatgttctgcttgatgtctgcgtggtccaggttctctttggactatatcatgacagatgttgggaaacttaatatagtcctgaaataaactataaatgaatattcctgtttctcttgtttgaaagcaaatatttctggttctcttttctaattacaatggaaaggaatgcacttgccaaatcactggctgcatcaccacgtacctgatgcctagtctgccacggtgacaatatcacatccagccttgcagtgcaatcagaaatgaagttggttacatctgtggtagcctacagtcattctccggggtgcaaaagcagggatcaccctgcaaatgctaagggccagcactctgtattctatatgaaggtctttaatggtgctcatctgcactgccccactccactccaaggcagtacaggccagcaacccaacatgaggattattccaactgccaagcataaaattcctgttgtataatcagggacttgggaaaagccaactgggaccatggaaccactgggcccactgtgaatgggacttcagccagtactccattgatcacttggcccccaatctagcaggggctcgggataacgctcatgttttcaggtatcaatgtcaactcagaccctgtgccaagaatcctttaaatgtctcccagtgtatagtcacctgagtaaatgaccatagctccctttagggaaatactgggggaatccttgcagtatatatttgccatgagattgcagggttcttacccctagggtcttggccacctcctatcagtgaattttggatttgaaaattggctcagttctggaaactgaacaagaatcatgacttttaattgaggcaactgctccttcattctttgcttttctttttttttttttttttttttaggtttgtaatatgacctttattgagcttatccaccagagtggaaataatgtctgtacaaaaccaaatgtttgttactctaacttctgcatcacaattaaaatccaaacagtttttcaaaaacagtccactcaatcaaaacccactacttcagaatcaatagcttctttgaagccacagtaatacttaaatatggttaagactggaatgcagaaatttggttggttggaaagctaattaaacttccagattgctcacatagaatttcaaaaaggcaaaattgtgttttttacagagatgcagtccactggaatccgcaacactggacagctggcagagtatttagagtcctgagatatcaaggaatccaggcagcctttagacagtcttctgttgtcctttcttcccagtcagagatttgtggatgtgtggaatgacaccaccaccagcaatcgtagccttgatgagagaatccaattcttcatctccacggatagcaagttgcaagtgaccagtggtactacgctttacctttaagtctttggatgcatttcctgccagttcaagtacctctgcggtgaggtacttcaggatggctgcgctgtacacagcggcagtcgcgcccacacgtccatgattggtcgtcctagatttcaggtgtagatgaatacgcccaactgggaactgcaagccggctctctggcagcgggaaaccgcctttgtcttggcctttccggagtccttcccagccttaccgccagtcatttcgaattctgctgaagctcaagcaaggcagagaaagggctaatcagacccatggcgagactccttcgtcccaccgcgattcaaactgcccattcttatcttttttgattgtagctgttaagccgatagctcgcggtagggaaggatgggccttctctacaagccgagaaggctcagggagcttcagtcaatagcttcagaagtatccatccagatatttccacccatgttgaagggccccaggcttttcctacaagggttctatcttttgcgtaacagaccttccttagttcagcatctaaaacctcttaacaattagctccttaacctgccaatcgcctgaaagtagggaggaatcgaggggaggctagaagagcggaaagaccgtgaaggaaggttaggtgaaagggtctaaaagtgcagtcccaaatccaagtttggcaaggccgacagagtgcttgagtcaaggttgctccttacagcagtcctgtctcctgttgggtctgccttggtatccctgccacattttatttatttatttatttatttagagacagagtctcactccgacacccaggctggagtgcagtggcgtcatctcggctcactgcaacttccgcctctccggtttaagcgattctcctgcctcagcctccggagcagctgggactacaggcgcgcgccactatgccctgcgtagagacggagtttcatcatgttggccaggctggtctcaaattcctgacctcaggtgatccgcccgcctcggcctccagaagtgttgggattacaggcgtgagccaccgcgcccagatgatttggcttcttaatcacgcatccagaggtgctggctggctcctgagccgggagacatctgtgggaaacttcgcttgcttcttgacgttactcactgcttgccattcagctttccaggggctacaaaatgagtcaccacccttttatcagctttcaacttacattttgttgctgttgtttcatctcctattatccttgtccttgtgggtttatgcctttataaaaaggcatttgggccaggcgcggtggctcatgcttataatcccagcactttgtgaggccgaggcgggtggatcacttgaggctgggagtttaagaccagcctgggcaacatagtgaaacctttccgtctctacaaaatgtaaaaaattagctgggctaggactacgcctgtagtcctagctactcaggagactgaggtggaaggatcatttgagcccaggagttcgtggatgtagtggctatggttatgccactgcactccagcctgggtgacagagatcctgtgtgtgaaaaaaaaaaaaaaaaaaaggcatttggctgggtgcagtggctcatgtctataatcccagcactttgggaggccgaggtgggcagatcacttgaggtcaagagttcgagaccagcctggccaacacggtaaaaccccatctctactacagatacaaaaattagctggctgttgtggtgcacacttctagtcctagctacttgggaggctgaggcaggaaaatcgcatgaacctgagagacagaggttgcagtgagccgagatcacaccactgcactccagcctgggccacagagtgagactctgtctcaaaaaaaaaaaaaaaaaaaaaaaaaggcatttgtgttagtgggatatgggagggagatgaggtagtcatgggttcaatcctccattctaactgacctctttaataggctattaactgatttccctggactttttaaaaaaaaaaatttggccccgtgtggtatttcatttttaaaatttattttaactttttgttgttgttgttgagactgagttttgctcctgttgcccaggctagaatgcagtggcataatctcagctcactgcaacctctgcctcctgggttcaagcgattctcctgcctcagcctcccgagtagctgggattacaggcacgcgccaccacacccggctgattttatttattttttttttttgtggagacagggtttcaccatgtgggccaggctggtctcgaactcctgacctcaggcgatccgcttgcttcggccccccaaagtgctgggattacaggtgtgagacgctgcgccaagccataattattttttaaattgagacatttctccacatagttgctggccttttgaaaacaaaagttaggtcctattactcccttttaaaaactctccaggccaggtgtggtggctcatgcctgtagtcccagcactttgggaagccaagggccggggggggtggattatctgaggtcaggagttcgagaccagcctgaccaacatggagaaaccccatctctaccaaaaatacaaaattagcggggcgtggtggcacatgcttctaatcccagctactcaggtgtctgaggcaggaaaattgcttgaacctgggaggtggaggttgcaatgagcccagattgcgccattgcactccagcctgggcaacaaaagcgaaactccgtctcaaaacaaaaaaaacaaaaacgaaaacaaacagaaactctccactggcttccatacttagaataagaaccaagttccttgctttggtccttgagaccttggatgatctggccccaggctgcgttttggccctcgcctcctgaggttgcccctcaagtgtctttctaaccacacactggcttcaccgtccttcagacatcacaagttggttttgtctcctgacctttgtacctgctgtttgttctacctggaacacacctcccagtttcttccatatcaggctccctcactttctgatctctgaccaaatgatgaaagggtcaatgcatcagaagggcatgtaactgttatattggtactgtctatgtgccaaatagtgtttcaaagtacaaaagcagagataatatacttaaagggagaaagagacctcagtaactgataacaaaccagattaaaaattagtaaggaaccacttatattctgtctacaaggttggaagttaaaggatgaataaagatacaacctgcaaaatgaatccagctttagcatgtctatgtgcatttcggacaaagaaaacaaggcaaggaagcttaccagagacagtgtggggcattatataaaagagccagtttgtcttgagaaacgtatatgctcctaataacatagcttctgagtgaagtagcaaaaatcaacagaagtgagaaaaattccaaaccataatcggagactttgttagcattagtagacaaaatgtgtaggatgctgctaaaagctgtaaagaggacgtatagccttgaaatttatacagtaggaaaaaaaaaaaaaggttgaaaaatttatacattctcaagaagttagaaaaaaacctaccaagataaacccaaagtaaacacaagctaggaaaaaaaattggttcaaatatgcagtaggtggaatagacaggtttaaaaagtaagaggagacattctgaagaattaaactggaggccagacaactctagccatatggcttcagtcatgagttctacccaaaatacaaagaaatacctatcttaccaaacttacacatttattccaggtgccaaagaatgttcatttccaccatagtccatggaagttatttgtggctattactaacctcttttttgccaaatcaataaatgaaaaatagcatctccttactatttttgtttgcaacttattatgatgttcaacacctaatattagccatttttcactttcagtatttcatcttttttgctcattttccttttttcatttttaactttgtattttaatattactgttatacattatatttggtgagtctacagtatatatgatttatgtatatgtagaatattagaatatttttggtagaatattatatatattacatattagatttatatgtatacacatatataatatataaataaatctaatataatcttatatataataaatctaatacttatacacacacaaatatatgtatatttacttatccatttcttaataacttgtttttcaaaagatgtttccacttttctgataatgcaaacataaccttctagcaattttacatttatgtttaacccttgatccatttggcatttgttaatatcgtggggtagggagttaagcttggtatttcactcaaatgtgaccaactgtctcaacaccatttttttttagaacaatgattctgtgaattagaaatgaaatctgtcatatattgattttatatttacacagcaatctgtctctgggctctttttcaaagagtatttattcctatctgtgttaagtaaaggaataaataaagagtatttattcctacctgtgttaagtattttataccacaaatcaatagattataaaatgttttgttagaagtcccacatcttccaaatttctcattattatcatacattttttcttccaaatgcatcttacttctttttcttgatagggattgtcatgaatttcgggaaagaatgaatggtcttatatttgggtctttctgggttgatagcatgtctccattttttaaaatctacatcttttgattaacctttagttttcttcacaaagctctgtgacacttcctgttagatgtaattccacttaataagcattgtattattttgttattgtgaatgggcatcttttaaagatacgatttcaaaattagtgtggatagattacattgatttttgtatagtctagccatcttacagagcttttctattcattccaaaagcagggcaaaaccaaaaacccaaaaacctttcgggttttcccataatcaagttgtcaaaaatgttttctgtctattctcgtattagtactttatttcttagtcttggtagtggggctccttgttttgttgactttaattaatacttttagttcaccattaagatgtttcattgggaatgccatcagataactttaaatatatttatgacatttacttttcctagctttattttttaaaaatgaatgagagctaacgtttgtcctacacaaatttatcaaatggcactcattgttaatcatgtttatttcttcctttaatctgttaaaatagttaatagcattgatatagttttctaatcattttttgggggatcttttaaaaatacaattccaggttgtatttcctaatatttcacatagtttatgatctaggtttcaggtactgtacttgtactgcttatcaactattaaaccattatggatattctaatgcatgatacgaccttcctaagccagtcagaagtccacattattcttgtaaatgtgtctggagatttgggagtggaaggtggaacagtatggtgatgagtcatctaggactgaatggaactagatgtggcttatatttgccattaagttattagataatcctttatttcaaatgtaaaaatttataaaatgggttattggaagaattaaatgttaaggtgctgtcaacagtgtcaactaccatataaatataataaattattaaattacaaggtctttttaaatgcaattatgaaagaagatacaatataaacacattaaaatctctaaagccatgtaaaacccgaaggcattaaaatttattaaatgatgcaataacaacagaattctttatttacaatagcattatttaacatcaaataagcaaatagcatcagcaaagcaatattaacttgcataaatgtatttaaaatttctctgaatatatctacctttgcataaactgctcacactagaaatacaaacatcaatgcaggtgaacaaagtgatgttcagagtcaactccattttgaaaataaatcacaacctgaaacactgtaagctttctcctgaagaaccatagttaatatattgcttaattttacccttgtataatcttttcatatacacacatctcagatgcaacttcatgaggaactgtacaaataaaactcacaaatgacaaaggaaaaaaatgacagttaaatgtctgaagaaatgtatcatcatcactattcaaacaacataaaggttaagtgatgatgcacttattcaaaaattgtacacaattcactatacaaatataatacatcggacagctatgtaggaatatacaagacttaaaaacagatctaaggcattatgctagattttagcattttgaggttcttgcacatagcttttacctgtagtaagaaacttaaaagattttgctttagtctataaagaaacaccagggagaaaattctaattaaaatcgaagccactacagtaattttcttttgtgcagaggatgctttgctcttaggcagcataccaccatacaaacactagaaaattttaaattcacaccaacaattaatggcttaagttgcatttcaaaactgattgtgtatctttgggttctgcaagtggatctgtgccacccatttcatgtgttaagcccatatgaactccatttttgaacacagattaaaaattgcattatataaactgcaaaaacattgctttcaattattacaggccataagagatacacatagggggaggggcattttaatctttgagtcaaacgaattcattgtagtaaaacagctcacttcactttttaaacttaccacattacatgaacacttaaaatgagttttacaaccaagttaatgtatgtatacttttcacattatgtttttcacatttagtaatataagtgaaacactgattatttgttctattaaacaaaaaccaagtactcagtctaacaaatttattgtgtacagcatgagaaatactgataatgaagggaactgatttggcttttgcttctatagtgatcaatatgatcagaggattccttcacttacttttcttctcctaactagatgtaaaacaaaatccattacctgattgaaaccgtaagagaatttatcatctcttttccttcaaaacagcaatgatcacgaattattataaattaccagtatcatgaagttgcggatttgtctgaattaggattgacattaaaatacagcgggcagatggataaaaaagaagagataggtagatagttttggacggtgttgtagtgaaaagggacttgaaactcaaaacaaaacaaatccagtttaaactccatttctcttttgtgctgtgtgaagttaaaagtcattctaattcacatatttctgaacattaaaactggtcacactgaattgtatgccacatgagcctcagcccacggggaggtcctggagttctgggccaacatctgcttgttttttccatcacagttgggcaacccaatggtttggtggagaaaagtagagccttttgaggggatatatgaactggtggccactgagaagtgttgttccttggccacctccctgtattgagacccctctcaagtggaaaaaagtagcgaaatgcaaatttccagaaaggttctttagtatggagcaacattttcagactgtctacttaccatctatctttgggctatatctcttcctatatttccataatgcgtacatatagagagagatataagtataaataggggtagtttgtacatttttcaccctgccacaaataaacaaacaatcaaatttcaaggaaaaacttctctgttcctaaaaagcctggctaatgagatattataaaatgctttgctttttagacatcaaaaagatatcattctgaaatttaggtaagaaaggtattaggggttaaggagaaatagctcaaaaaaggtcatcagtttcttggtattggagttgtctgaaactgacacctattaataaaagatttttcccctaccagagtgggcaagaaaaacaaccataaaagtggcctgcttagtaacatgtagtctttctaaggttcattaagaaagaatataaacatataaaaatcaagaattggttcctacagcggctgcatatcatatagattagataaatgacttataagcagaatcacaaggtttagaaaataaaaagtcttaagtctacaaattaggtctaatcaaggcattgatatcctttacaaaacacctttaggagacattgctatgaagatatctaatttaatactgaagtacctcatttttgagtcaattccacaatatgtatacctcacaaaaattatacaattaaaacacataagttctcaacttaaattattgcttgtttacatataaattggattttatgtaccttacaaaacttcggcttagtcagcactgctaaaaaacaaaataaaaaacacatggcagaggttaaatctgtcgtgatatctgctatcaatttaaacacactggcgttttctcccattttggaggccagagttgctggggaacagaataaacatgcttccaaagcaggtatccttagctcgattggtatcaagccttaactttgctcttctccttgccagtaaatgcattttttttttctgaaattcaatacttagcaattggtaagtggctggcaaaacatttaaggaaataaagggcttacctggtttctgtagcttatattattttttaaaaaaggaatgaaaatagggagtatggggaatgagagaggggaagggaagagtcaggctgacagggaagaagagatgctgattcaagctgtctgatcaaactaaaagggacttaatttagaaatgaaaattatttcttctcaattcatgattcaggtgaaccagtttggttttaacaaagaaaaaacaaggaaaaaatatttgctaatgttaacagccctctcacaggctccttttcatctgttcagtaactggagactctttccaacatggtctttagagctttctagagatacgactgtgactttgttggtcttcacgcactgggtgtgtctgtaaatacagcgctgtccacggtgtctgtcctgcttccatcccaaattcaggctttagcttaaaacatctttagtttaattttttaaaaaattcttttctttcccccagataaaatcttaatcttttgcactagactgttagccagggaaaacaaagcaagaaaccagtgtctggaaccgaacaggaacagaacaagagcatggttctccttaaatacatacatttaaatacattcaatctgacatgggtatgaaatttgcctgtcaacatttacttttgcaggagagatctaagttgcactaaggtgaatgcagtgaacagactgagcgactgtctggatgcgagcttcagactgtcaagagaagaggcagctcctcctgccacagccgagtggacgccaccctgggaaccagggccaggcctgtctgctctagcagaaccggctggcaggtcagttgggttgaaacaaatagacacagctctccagactggaagtgttttgagcaagtgagcccggtcagctgaagaagcaactggcttcagcagtgtcagcaatatttctgtaggaaaacagataaaaagttgtgaaacatctttgaggttttgaaaaaaacatcataaagcccaccacaaaaacatcaaaattcctgactgttttcaataaagcaaatcacagaggccgcatctggatgagtacattcgatgtggaggtgaacaggcagagggcgccattcctccctccacacaacgcttccaggagccaaggaggagcccagcgaatcctacatgctatttctcgcaggccatcgtctgcaaatggatgatgaatctctccttaatgaccgctctccaaccaacaacatcctagctcaatttcatttctcccaccttcaataaagatgacagaacaattcacccagctgctttttggcagcatccgatccagaaggggccactgcttcctaattcttcctcaaattcatccagtacaaacccttcttctataaaatggccctcctgattttccctaatcagatactcccaaggttctctgggtgtgttctccctggcttcagcaagctagatcatgatgggttttgactcctggggttttgtatttttagtagagatggggtttcaccatgttggccaggttggtctcaaactcctgacctcaagtgatctgcccgccttggcctctcaaaatgctgggattacaggtgtgaggcactgcacccggcctcttggggtgttcttgctggtttttggctgctatgtgctgatgatgtgaatgactgaataccaaaggttatagtgagcaaattatgtggcgttgtttctttggttggtgcaaatatatctgtcaatgattttctttggctaccgactatcttccttccaaaagttttcattcacttagcaaatattaattcagcatctattacatgctaggtgctgggatatatccacaacaagacattcttggtcactgctatcacaaaaattgcccgactaggcaaggctgacaacactggagattataattgtaccttgctacaaatcaaattattacaaataacaacatgatctgagtttggttagtggaaatactgtctgctttgggaacaattgcttctgggatttagatatttagacacagaattctagcccatcagggccattagaaattatctaatttaagtaagattagagaggaagccagctccaaataatctattttaccttagcactccaaaaagagagttctggggaaagtattgccagatcatgagttctagtggccaaaggtggaattacattagcccctgatcaggtgcacaattctcctaagcttaaaaaatgagcttagaatacctgtgattttacttctcagagaagaacatttagcatactttataatataaagctgaatagatatgtattcctaacttgtgtcacttttatgatttcatataaaaacactccatggtgctgattaaaatatgaaaaaccctcaattttccagttagtctagaaaaagtctactgagaagtatttatttatttatttatttatttatttttgagacggagtttcgctcttgttgcccaggctggagttcaatggtacgatctcggctcactgcaacctctgcctcccaggttaaagcaattctcctgcctcagcctcccggagaagtatttatacctattgcgtttctgaggcttagaaactttgtaaggcagtattctctggcatggactaacatcaatgagcagccaccggccagaatcagtttgatgaaggagaatgctgtgctccgcacacacctctggagtcatgctgcctggggtgtaccctggctgtgtcactttaggggtggggtccattacgtacctaatacttctaggatggttgtaaggattaaacaaaatgatgcacatgaagtgtttaaatagttcttggaacatcataagtgctcagtaaatgtcatcaccactatcaccatcatcatcaactaaaagccgaccctattagtaatcaattttcataacactagtaaatacaagtaattacaagagaaccatgctgctgagcagtaaactcaattttaatctatttaaatatatctaaaatataaagaaatactgtaagttcttataaaaggaagaatcttctggttaggtcaaataactgcccttctctaaatatatatttttggtaagtcaacggttgtacatactagctctgcttaaagcaaggtaccattataatttccaattcaagataaatggaacagtcaattaaaaatggatgacagggccaggcgcagtggctcacacctgtaatcccagcactttgggaggccgaggcaggcagatcatgaggttaggagatcgagaccatcctggctaacacggtgaaaccccgtctctactaaaaatacaaaaaaattagccgggcgtggtggagggtgcctgtagtcccagctactagggaggctgaggaaggagaatggcatgaacctgggaggcggagcttgcagtgagccgagattgcgccactgcactccagcctgggcgacaaagcgagactctgtcttaaaaaaaaaaaaaaaaaaaaaggatgacagtagtatcttgttcaacaaatagaaccaagttaccaataacaattctggaaaagagcagggcacagtggctcacgcctgtaatcccagcacttcgggaggccgaggcaggcggatcatttgaggtcaggagtttgagagcagcctggccaacatggtgagaccctgtctctactaaaaatacaaaaattagctgggtgtggtggcatgggcctgtaatccagctacttgggaagtggaggcaggagattcgcttgaacctgggagacagaggctgcagtgagctaagatcgcgccactgcactctagcctggtcgacacagagtccgtctcaaaaaaaaaaaaaattctggaaaaagctccttgattcataacagcagcagagcttattacggaaacacgggatgatgactgaacccctgtcaatgtgcacataagtagcacagtgacaaatccaagtaacttccggttatttctgatgaatgaaaagggatatcctatacagattattctctaaagcaaatgagtctctatgacggactgttctctggccttaacaatcagcatgaagaaagtgcaggtggatgaggcagattcaagagggggactagaaaaaaacagggaaagttgacgaggttatcagtggcctgagcaagatggtaacagagaggtgctgtgtcgcccaggctggagtgcagtggctgttcacaggtgtagtcatagctcattgcagcctagaactcctggcctcaagccacctgagtagctgtgactacaagcgtgccacccactgtgcctcacctgaaagacgcctttgctgggaagagagaacatcctatatttactgaaaattgatgtcttacatcctaacactactctttccattttgggtttaaagggcccccatgggccaccaggatgcacgtgaaggtgaacccctggtcctgccagcctgccgtgtggcccgcaccacagggctggttgcaggcctacccctaaacccccagccgggcactttctaccttgattggtctgggtcaccagttctctaagtcttcagactagctggtagccctgcataaattatctcatcctctgagattcagtctcatctgaaatggtggggaaccttaaatacctacgaagggcctggcactatccctggtaaattcgaggccaaaagattcattcccttccctcgctctgggaggttcctccctcctgagatgaagaatcccaatgcctgaggctgaggatgcttccaaaaatgtagctgaatatttactgtctgtccacattgtttatcaatatctttcttgtcccttcaagatctaaatagagaagggagtggcaccaaagaagaaaattatccattgttggccttctccaatgttacctgcataaaaccccttagaaaaatctcacaagccctcagtgttccctttagggaagtggcaggagggtgcaggggttaagaatgcatatttggggtcagccggcctggatttacttcccagtgttgtaagaccttgatcgagtcattaaactctcaaaacagtagctctaccagacagttgtggtgtggtttaaatgagggaatctaaacaaaacttttaatagagaataggcttgcagtaaatgctcagtacatgttggttgtttctgtaaatttttaaaaggcagaatgtgggaccatctcagtgttctgcttttatagtaggtgagtctcttcttggaggttacatggcagctgaagaaagagcacaaggcagggcaggtcaattcctggggttcttgggagacaggggtggcagacggggcccatgcaatatttgagggccttaccctacggagtggctttctcggggcacctgctctgctggagccctggcctaggtggctagcatgcagccgcatgatgaagggtgaggcagggaggtctaatctcactgtggtgaattcagggagggagacgtaagcctggcctcccaaatccatttttctcccatagagatatgatacgctcagaggttgagctccctggcacttttgggttaaaatggcccctctgtgggagcccaattatcagtaacatcactgttcttctgggaagtgcattcctgatttcaacttctgcacataagccacgactgagttgtgtggccactcatttcctgtactcagtggaggagagaacaggattggcaccaggaaagacaccagcccctctaggtatatacagacaacatctacaggactcccaccaacagccagcacctctgccactcgggactgtgattcttaaaaacaagagaaaccgcatggagaatatgcacacagtaagttaaaatctggagcaaacttatgctattactttctcaacttgaatgctagtattaaccaaatcatcaaatacccacttttttttgggaggaaactgaacaacaaccttgtactgtctctactgggggaggatttttttttttttttttgagacagagttttgctcttgtcacccatgctggagtgcaacggcatgatctcggctcactacaacttccgcctcccaggttcaagcaattctcctatctcagcctcccgagtagctgggactacaggcgtgtgcttctacactcggctaattttgtatttttagtagaggtgaggtttcaccatgttagccaggctagtctcaaactcttgacctcaggtgatccatccgcctcagcctccgaaagtgttgggattacaggcttgagccactgcacctggccaggagaggattttttattttatttttatttgttcaaatttatgggggtacatatgaaatttcattacataatgcatagtgagggatcaagacagggttttagggtgtccattacccagatgcaatacatttttaactatagttatgctactctgctaacattacatttattccaactgtatgtctgtaacctctcacccacttctcttcctcctctcctgccctcacagtcacccttctcagtctctgttatctatttttccactctctacttccatgtgaacaaattttctagctctcatatgtaagaacatgcaatagatatttgtctttttgtgcctgccttatctcagttaagataatgacctccagttccatctacgttgccacaaatgacatgatttcatttttttaatggctaaatagtattctactgtgtatatgtaccacattttctttatccattttatccactgatggacacacaggttgattctgtatctttgctattgtgaatagtgctgcaataaccacaagagtgcaggtatccctttgatatactgacctttcttcctttgggtagaaacccagcagtgtgactcctggatcaaatgataattctgtttttagttttttgagaaatctccatactggctctactagtttacattccaacagtgtatgagagttcccttttttactctatcttgccgacatctgttattttttgtgtttttaataatagccattctgactggggtaagatggtatctccttatggtttttatttgtatttctctgatgattactgatgctgagcatttttaatataactgctggccacctgtacattttcttttgagaaattattcatgtcctttgtccacttttttttttttttgagatggagtctcactctgtcacctaggctggagtgcaatggcatggtctccactcactgcaacctccacctccaaagtataagtgattctcccacctcagcctcccaagtagttgggactacaggcacgtgccaccacacctggctaatttttgtatttttagtaaagatggggtttcactatgttggccaggctggtcacaaactttgcccactttttaatgggattatctgttttattcctgttgagttctctgtatattatagatattagtcccttgttggataaatggtttgcaaatattttcttccacttaacaggttgtatgggataggattttttaaaaaagagctacctactgtgaagggtaatatctcttaccttaaagggccacataggcccatttatctatgtgccaaactgctcagacttcttcctgcaagagatctgctgctaggtacacatttcaattacgtctaagtactaattattctacagtttcattggctgaacatggtaatatcattctctttagaacaagtgtttaataggccaggtgtggtggttcacgcctataatcccagcactttgggaggctgaggtgggtggatcacctgaggtcaggagttcaagaccagcctggccaacatggtgaaaccccatctctactaaaaatacaaaaattagccaggcatggtggcatgtgcctgtaatcccagctactcaagaggctgaggcaggagagttgcctgaacccgcgaggtggaggttgcagtgagccaagactgtgccactgcattccagcctgggcaacaaagcaagacactgtctcaaaaaaacaaaacaaaacaaaacaaaaaaacaaaacaaaaagagaagtgtttaaggtgtaataggcaaataacacaataatgtaaataatgtactagattgttcctaaacacaacgaaatatagaaaacccttaagaagacttaattaagggagtgaacaatgtaagttaattcctcttaatcctcctaaaaatctagccttataattcagaaatagcaaaaataaaagtttgccctaacacaactaattatttgccacattatttcttcctttgctatcatagtatcattccagggcaaaattactgttcttttgttggctacgaagactacagaaaaaaaagataaataaataaaaaaaaatttagtgttcttaattcatatggtaccattagctgagttaaaatgagcttaaagaaataatcattcacacaaaagcactgtatgccagatgaaaccagaagatattttacgattatctttaatctactggttgacaatatatctatgccacttttggtctatcaaatattcatgtttgctttacttccatattcatatatttcactgttctttcttacccgtgttgtgtctccctcctgcttaatcatatccattccaggcagctggtttgggaacaggttgcctcccctcagagcaggatcattaacctaaggacaagaagacaggacagtggctacgcagagcagaatgtccaagagtgcactggaaaacaagtggccgccgcccttcctctgtttttaggggtgtaaaaacggggaaaaggaactgcagaacaatggcctcatcctacacaagctctcccatgtacgtattttgcggagtctagaggaacatgaaaatactcatgaaatactagctgccttcaaaattaacctttatctgcatgctgtacagaaatcaaattcaattgacttaataataatagagccatttttgtgccataaccagcatgctttcttggcttattcaaattagaccaatgactcacatttgggactttgaagtcatctgagaaattcctgacatctttgctacttaggcaagttattaattatcaagagcaagtgtaaatacccaaactagtgctggactttgtcaatttactctgaccaaatggactattcatttgcatttgtacatttctttacacattagaaagtaaatttgcaaatgctaatagaataatgatttttgtaggaagacacactgcagttgtgccttggggcttccaaattaaccatgggattcaaatggtttaaaatcatgcagaagtttcaaaacaatctggattgttaaaaatacatcaaataaaaatgcatcaattcattgctgagcagactggactaagatcgtattacactagactatctcagtagcccttactttgtacgcttttcctcagcaagcaaattaggagtcattagtggcccatttttgcaggaaataaaacatcaaccctacatttctccattgaagaaataaaagcatagatatctctctataaacacacgcatatattttaagagatagggtcttgatctgttacccaggctggagtgcagtggtacaatcttagctcactgcagcctcaaactcttgggctcaatagatcctccagcctcaatttcccaagtagctggaattataagcacctgccaccatgcctagctaatttaaactttttttttttttttcagagacagagtcttactatgttgcccagactggtcttgaattcctggcttcaagccatcttcccacttcagcctcctgaatagctgggattataggcacaagccaacatgccaggctaaaagtctgtatttctttatgtctgcttaatgtatccaaataagcatttaactgccatcaattcaacaacagaagtgtaagttattactacaagcacacaaccttcttaaaatgcaaagggctttaaattttctcatgtaccactttccatttttattaatcgttttaaataaaacacggaagctctgtaatagttcttaaaattttcacaaaaattgtggtctactaacagaattaaatagatctaatcaaactcttcaatctttcaccattctcacaatcttgttctaacagacattcacagacctgtcagtgatttcatgcttaagtcatttacactttccatactgcactttctccttatatgaaataagagtcaaggtcttgccatattttttacttgtgtgaactactgaggatcagtggtagagtggtcagcattttgggcctttaaaaacaagatcttctgtaaataccatggtacaattattaacctctacttttacctctgaatcagccacagatttttggattccaggctggctactgctatctcaaatgctttgagtctctctgccatctagtgaagttaggaacagaatcattttgatgttgttcaacgcaaaacaattattttaaaaaatcattgccttcacgttccaaagtaaaaagaatagtttttggattatctgtgtcggtctctttgcataaatgaaggatcatttcaaactaactggatggcaggtagtttggcctttgcttttcatctggttttacacttagaaataaatccattattaaactataatcctctagccgggcacggtagtatgtgcctataatcccagctacccaggaggctgaggtgggaggactgcttgagccgggagacggatgttgcagtgagccaagatagtgccactgcgctccagcctaggtgacagagtgagactctctatcaaacaaaacaaaacccccccaaacgataacccccaaatagagctattttaaaagtacactcactatttcatctttagagattcattttagatactggtgaattcctcaagagaaaaatgtcaatgataagaaagttacaaaatattttaaaagctcctcaagcagtcaggaatcctttctgtttatttaatcattaacaaagatttttattaatgtcactaacacaggtgaagggtgaaaaacactcctcaaagtaaatgtgggagttggtggctaaagtcagatacatggaaagatatatttgatgcagaagtagaaaaaaagccgtgatatgaagccactgggttgcttctccttgggcactcacctgctcgggacccatggaggacagccctgacgtaggcacggaggtcactgaggtcatgctgatctgtcctgtcatctggttcatgctgctcatgccacctgtgttggtcgccatggacacattgatgttcatgttgttactgtacatgctggtgtttgcttgctgcccaaagtgtggtggggactgctgggaaaacatgctggaatacaatggaaagattgaatgaatgttacagcttgctggtatccagaggcaggcagctcagggcacttgtttctcaggcgtttactctgagtgaataaacctgaactgcatgaacccaggctgagacagccggcaggtggtgggcttgctgaagccgagacagcaggggaagtggcattcaatgaagctgtgggggcaattctgtgtgttgctgtgataaatgatcaccagggaaactttctatagactacctgtctcctttctttctttctgtttttttttttttaaagtctttgctcatgcaagcgatatcaagcaaacttctaaataagccagtttacttttcctagagcaggagtcactagaatttacaaaagcttagcaaggaacattctttggaggaacaagaacatccctaacaaggtaccaccgaccaatttatgatagaaattgctgtggaaggcggtgacctagaagccatcctttatcactacgtttgataaaaacaaacagaaagctcctcgggtgcaggcatgaaggtgggggatgtccttcagctgtcacagtggcggtatgaaaaggagaaggatttgcggttacctgtttccgcccatgttcccctgcgcccatccatttatgtcggagggggcctgataggctgggttggcctgagactgttgcatcatgggactctgtgtatgtgccattcggggtgacataagtgggctctggggagtcgtagccccagtaaagcctggatcaggttgctgacttattccttaaaaaaaaaaacagaaacagaaatccaaaagagactgttagttatattgtagagactggtgggggggaaagaacattccaaattaggcatgcataaaaaattactttcaaatatatgattgtgtactgattaattacatacatttaagaaagattccaagctcggataaaatatggagaaaataaaatctccatactgattccccttagtagttagatggtgcctaggaaccattaaccatcatagctagagttagaaagaaacaatgctattctttcttcaaattcctttccaaatcaagaatgagtcacatattttgatcaacaagaaatatatatatatatacacatataaaatctcaaagtatcactgcaattagtttaaattaagcttattattattattttgacatagggtcttgcttgctctgttgcccaggctggagtacagtggcgtgatcatagttcactgcagccttgacctcctgggcgcaaaggatcctctcacctcagcttcctgagtagctgggactacaggcatgcacgaccatgcccagctaatttttttaatttttagtagagataaggtctcactatgttgctcaggctggtcttgaactcctgagctcaagagattcttggcctcccaaagtgctgggattacaggcatgagccattgcacctggccagattgtttaaattaaatttaaattggattaaagttcagctatatatcaaaagtcaacacatttgaataaatttatattaaattagctgaagccattccatgatgagatggatccacctttaaaaataaatagctgtattcatggttagcttgttttgtctttataaagagctctgtggtactttagggctatccaatattagtaagaataagaaaaaaattcaatgtatgcttcttgttcagtttcgaggcaaacagaatttaaactaaaaggaaagagaactttcagcacacttttctaaatcatcaagaaggaaatagagaaaggagctgggaaacaaaggaggcaacttagagtattttgaggatggtattaagtacacttttgcatagaagacttgtaaaacatgcatatttaattaatatttaaattagctacaaaagaaaagcttaagatcatatagaaaaaggctgcacattatctttctgttctttaaagaaacaggagacttggatttcggcaacagacttcacagttatttacagataactggcaaagggtagggaaagtcatttttgaatattaacattaatgtaagcacttactttatcaataattcaaccattaactgaacatgacatgcacacaaatattaatgttcatgacattacacacttggtatctcttaagactgacattaaacaacaaatcaatatgaagaggactaaaaggtctcccactgtagtttctatacagtacttctcaagaattacctattcattaatgatctggtataatctgtaaagtatttttcaaaagtcgcagaatgtctatatttaaatttatagaggtctttttacattttgtatctattgatttgtttgagtcagactcagaggctttcaaatatataaacatatatgaacttgtagacattgacataaacatagatccatacacgctcgcacacaagatagacacagtctatgcacacacacttacttcggtcattcttaaagtaagacctgcactcagagaaaaggaggtacctgagctgagagcctggaaggtactgtgctggacttggggactcctcacaggccccaactgtcctcccaggtttcctatcattccctggttagccagattcatctgggagccatgcaaagagctgtgagagaggagctgtgacccaacactgggggacactggggagaaaggactggtgaaaggtggtggggatctaagtccagtaccgtagtttggaggaaatggaaactgctgtgcatttgcctggggaatccgagggttgctcatagttgctggcataccactaggagccaccatgcttggtgtcatattcaacccttgtcctctcatcatcaaagttcgttgctgaacttgctgttgctgatgcatttgtctctgtcgaagatgctggttcaggatttccctctgtctctgggccagcatctgtgcattaataggtgcctgaaatccggggcaacacatggaggaaaatgtcggggacagacatagattaaaaaacaaagtgagtattatagagaggctagcaaatggtactatcatctgtaaaattatttggaaaaaaattacatgaaaggaatgactcagagttgaacaactagtgattgagaacatgagcttctaagttctaaagatatgattattctgaagctttgctatgactcagcagagttaagtttgatgctaatatcaattaaatcattttgtaaggacacaattaactgaaggatctcaaaataacacagtcctttctataagaagactgtaatataaaccctgaggatggtagtttagagtctcattcaagtgacattcaagtctatagagaaataaaatcactgggacaaaaggtgacgtggtgcacttcacaaaaggctgagcagaggcaggaggaaaaggggagagcgaggagagtgcctgataagaacgcacagagaccgagtcagaggtggagggtggagagggaggaaaggcaggatggatgaagggaagggatcccagtgcttgctgtcagtgagaggcatgaggctgctaagatatcgttgatcctcatttatgaattccacatttctgaagttgcctactcagtaaaatttatttgtaacccccaaatcaatacacatgccactgtcacagtcattcgtagacatgagcacagtggtaaaacatttcagatatgcaatgtgcacacttccagcagaggttgaacaaggcaacactttgccttctggtttcagctctcatactgtaaactagtgtcctctgtgatctatttggtgccaagatttttgcattttttgcttttcctgttggtgattttgctgcttaaactggctcccaggcatggtgctgcagtgctctctagtgttcctaagtgcaagaggcggtgatgtgccttctggagaaaacaggtgtgctagataagcgccattcaggcctgagttacagtgagttctttaaacagaaacacacataaaacaaggttatgtgttgactggatgatgacaatgttgtgaccagaggtctgcaggaacccaaccctgtattcctcctaggaacgatagttggctgttctctaattcagtgtttgcagtaactttatgtagcacaacttcttagaataacaagaattgactgtacctggcaataaaaatggcagtgattagaagggaaaaatataacacactagtaggtaactagatgacagtacagggctagtgtgctgatctggatccacgtctactaagttaactttcttcagagaggaagaaatgacaaaagcagctgcatgcatacaatgaaagctaatggctggtatgttgccttacctgtgttggtactccaggcctcagagtcaagttcacattggaaacattgctgatttgattcataagtggctggcgattctaaatacatacaaacaggatgaatacattttaagaacagaatacattttactttaaatcaagtttcccaagtaactgccctccccaacccagtatctgcacattgttggacagctgtgctgtctcacatcatcttccccatgtcctccacccagcacccctgacttcccaggtgccatcgaagaacagacctgctgtgcttggaggcgatgctgaagttgaagtcttagttgatttggctggttctgcactaggcccgtgggcctgaggcccggtctgggctgcatacggagtgtggcataactaggccgctgtcccatggtgtgaaagtttggatcttgcatgggagaatagctaccctgggccatttgtgcctgagatgcatactgctgtgggaaaacgggcgccttctgctccagcatgatgttggaatcctgacttgagaactgttctggatctactgcttggctctggagagaaagtcccaaataacaaacaaataattaaaccataaaaacagcagagtcaatataaggctgttttctctcactatcatatatttgaagctttttatactttttaatattatacttactacacaaaggtacctttagagcttgactccacttgtctttctagaaaatgcttctgctcacagctctggttacacaaggacagaagccggggtcacactggactcccagcagcacttcttccaagggaaggggaaaaatgggtcaggactacagaatgcctcctacccactccaccaatcatattggcctggactttcagatgcaaatatcccctggaagtgttaagtttttgattgattattcatatctgtagagttcattttaattagataacctctttggcacctgactgggatcagcagtgtggggtactgaccatcattatcctgattttgtagcttaaaaaaatgagacttaaagacatgaattgaattgcaataagccctattcagctagtacatggtggggtccaattcagtttgtgatttgggatctgagctcctcaccaatgtgatgcgctgcctattatctactgctttctgtggctgtcaggatttcctacgtgccccacattttgccatcatcctctcattacctactagacatggtttatgtgtctgtcactcctgactttttttttttgagacggagtttcgctcttgttgctcaggctggagtgcaatgttgtgatctcggctcactgcaaccttgcctcccaggttcaagcaattctcctgcctcagcctcccaagtagctgggatcacaggcatgcgccaccaagcccggctacttttgtatttttagtggagacggggtttctccatgttggtcaggctggtctcgaactcccaacctcaggtgatctgcccgtttcagcctcccaaagtgctgggattacaggcgtgagccaccacgcccagcctcaagttttctttagctcagcgttgtcctaggccttcttgaaaaccatctacccatgtagtgctggagccgcccagagccctgagctctgatcagcacagccctaaggccagcctgtgacagccaggagcccactgccctccctatggtaattctaaacacagggatggagcctaagcagaggaaaccactcattgctgaattactgctctaactaaacacaaaaacatctcagaactttaacatgaatacgaataatttgtattctatacttccctcaattctacctaataaacatatttctataattcagtttcatgacaatattataatgatggtggatttgatgagacaaaatagaaataacagaaatgagtgaaaaacggactaaaaatattaaaagacatgacacctgttttgataacattacaagtcactcagcaactccacggatcacattttaaaatgtcacttagataaactcaaggataaaatagtactgagggctgaattctaactatcactgaagacaaagcaaaccagtcacacaggaaatacttaaactccattttcctttcttatttcaggttatatcatgtaacctcaagtcatttctttccattctgctgttttcaatatgaattggtaagtcacaactcccacctgtgtctgctcaactgtgggaattatgacaagactaattttaatgtttcagagaagtctccaatgactctgcatcatctttctctcagaaagatgatgacacatcatatggccaagaagtagactggacactggcaggtactttttggcagtaagaaataaagatgattcatgctaagtaaggaggaaaacagtaactagaacatgatggtttttctgggttactctttacacagtaagccaggctgcactgcttcacacaaagttagctgtgcagtcagttcagatagtgttttgttctttcaagggactatgttaggttatttactatatcattgctatcaggtactctaaaagcagggacttccttttttatagtaaccaactaattacttggaagaagaaagctaaataagctcactaagattagttaacttttttatattcccatttacgcttaaacatccccaaaattatggtgggctaaaccataagtgaaaggaactgtagctaggactataggtgtgtgccaccacaactggctgtgacattttattttttttttggtaaagacagggtttcattatgttgcccaggctagagtgcagtagcttttcacaggcacagtcagtgcacactacatccttgaactcctgggctaaaccataagtgaaaggtttaacccgccatttttaaaggtaaaaatgatgaaagagttgcagctacctgtaaaatgacttctgctaacttatgtggaaagtattcttttagcacaaacagcttcctatcaccagcccacaggtgtgaaatgaatactggggtcacgactacactcacaccaacttccagggggaagcgttctaggtcacaaggcagcaatgtgctgtttgtggtttctctgtatcttgtgtgtccttccctatcagcaagggcggacaccaggtgaaatggacttgagtttgtgtctttctgctaacttgaactgtatgcaatgctcattttcagtgctctccattctcaggcaaaagtttatgtgagggttacaaggaaaggggaggaagaaacagggccagcctgttttgaggtaaaaaaaacaacaacaatatattctaaaaagcagaccgtggagtacctgtaaacagaaaatggacacctctgcgcccatgagagcgcttggcccccacctgctgcccttccgcgcatacctggctgaccagttcgggtattcctaaggctctatcaatctcctccaggccatcaaaattccgcaaggccagatacagctggtccaggagagctccctcatcactcggagactcagctgcaggatgtggacatagcaagtcatctggagaactgccaaatggctgcctgtaaagacagaaatgtcaccttgggccaatggaaaagctagttgattagagaacaaattctttatctcaaaggtgaaagtatcaattgacttccagggttgttgcaacaaactactgtaccaactcaacacagaacaaaaggacagtctgaaatattcgatacactttattcagtgcccaatacaggccaggcacaaatctagacatttaaggtatgatttttatttctattggtcccacttcacggctggcaaagctgaggcttagtgaggtgaggtccacatggatctgtgtgagtccagggctcaccaacctacaccgactgctcaagcatgtaaatatttacttggcattgaaggaaccaaaggacttttctgccctttagtaggaatcacggattgacttaagattcttagttagaagctgtgatgacccacctgggagaaatgagagaactagaggcatcagagctgcattaactttcttgaactcagctgcagctagattaaatttggctgggttgataggaaatttcttagtcatgcacaagcaggcctggaaaacatttatttttctctgagacagggtctcacttcattgcccaggctggagtgcagtggtgtgatcatggctcacagcagcctcaacctcccgggcttaggtgatcctcctacctcagcatccaagtagctgggactataggcacgcgccaccacgcctggctaattttttgtatttttttgtagagatggcgtttcgccatgttacccacactggtcttgaactcctgagctcaagcgatccacccacttcggtctccctaagtgctgggataacaggcgtgagctaccacacctggcctgaaaacatttattaaaaccctcaagaagtgtatctgttagccttcctgcattaggtacataaggaaagtggatcatcaacatgcaaattatatttgttattatataagataattggtgatgaaatcagaacactaaactctaaattacatggtacatacaactcctatacatttaaattaattgtcagattagagtagaggaggggtgtgtgtgtgtgtgtgtgtgtatgtgtgtagtgatgccatcatggctcactgggctcaggtgatcctctggcctcaccctcctgagtagctaggactataggtgtgtgccaccacaactggctgctacttttttttttttttttttttggtaaagacagggtttcattatgttgcccaggctggagtgcagtagcttttcacaggcacaatcattgcacactacatccttgaactcctgggctaaaggaatccttctacctcagcctcctgagtagctgggactacagatttgatgtgtaccaccacgcttggctaatttttgtacattttttgtagagacagggtcttgctacattgcccaggctggtctcgaactcctggactcaagcaatcctcccaccttggcctcccaagtgctgggataacaggcgtgagccaccacatctagcctagaggaggcttttaaaaaagagcttctgagttgcctgaatactaaaagggaaaatggtatttgtactttaccaaaagtctattttgtactcttagagtcactacatgatgttttggagaaaataaacatttacagattaaaaaacaaacaaaaagtttatagatgagcaaactcattcttaagcaagtcagaataaacttatcaagaaatgaagttacctatgaacacagttcaatatgccatgtggtttttaaatgctctaatatgctattttggcttagaattctgaaatactgaagtgctagcactgaaaccaacaattaatttcaaatgttcataaaggaatgcattaataacaacctattctctccactcacctctagtaacttggaaattgtccagctgagggtcccttgaggccacgcgtcacctgcttccccgacttcctcactgcaggagctccttgcatttctaagggacccacccagacccctgagaggcaggtgctcttcccactcccgcccctttctgcccctttcttgtcactactgggcttcacaaagtcacacatgctgggagcttgctggctccttcctcctgcttcttctccacagcccacactctcctagaactttctttaaaccaaatgtgatcagactgctccactactgctacacttagggagcgggaggaagaagcagatgcagaaaagcagtcaggagagggagaaaccactggactgtctgccatgatagcaaagagaggagattcctcaatgaggaggggccaacaaacatggatatggcaggagttccatgaaagagttcaagtcagtcaagagtaatgtcagctatttaccaaattctcctaggcagctacctcattccctaaaaatgctagttaagttaggcattaaaggattttctttacctagattttgtcattttcaacttgtttctttggaagctgcattcatatgcaaccctcccgtcccagatgtattcagtgatggcaggttcgtgtgaaatctaatgcgtgcaggctgtacaagcagacttctcagcctcacatctggcggaaacccactgtcaggaggaggcaggcactgtctcgtgcctttgtaagaccactccaccttgacagatcagcaatacagccaaatgcttaataacaaacaactaaaacaatcatttgaatttaaacaatttcctacatcataaaatcactttttgttacatgcttttcttttttaatttaaaaaaccccaaataaatgcagagattaaaaagttaaacagtgcctccagaccgtcccactttggtcaaggccctcttcaacacaagttgggactctcgggacactttcccaacaactttcctgcttgcatggtatctctaattctaatatgatgctctcaggttcccattcccaaagcacactttacagagcaaacaggccctactcagaattcttatgtggttcttcagctctcccaggaaaacgcccctggaatagggtggtagtggtggtgggtaacgcctaaccttcccaaacttaatgttcatgccttccctgtgagctccagctaccacgggcagctgatctttctccaaaagatgctacacataccaccagaaaaccaataccttgacatttaccccatccttcccacgctcttctccagctgagggtctactttccattggggtgccacccatctcctcatagactgccccgctttctcctctcagcattaaaccacttactgtgctatgctgaattgatactaacaatttatgttaaaaacacaacttcacaccatgctcacacggggcaagcattgcatcctctacctctttttggcccagtgcttgaacataaacacagtataggtgcagtaagtttctagtggatgaaaacaaaaggttcctgatttggctgagctacaatacattaaaaaccacttttatattcagaaatacatactgccttgtggcttggtgttataaatttgggcatgagtgatatcacttcccttagagatgtcataatatgcttgcttacagaaaaaacactgatccagactcccaatctgaactttataaatggccactaacacaatgaagaaattattttcctatgttttgggcaattacatatagttacaacctagttagcatctgacagataaatataatattaagacgagaatagaattcagggtaataaagggaaaaacacacacaggccccaggctggtgcaaaataataactaataaacaagcagagagagatccataatcaatggaaatcccataccttaaagtctacatgtttatttatggactagtaggtcattaagtacgggactaagaaggagaattaggtcaaattctcagcacttgattgagaaaccataacattaccatttcttcacttttcaaaagtattttcaaaattctgcaaaaaagcagcagctactgaatgatgagaaatagtcaacaaaagaaaccttacttagagatacatttcaaacaggggaaaatcaaattaaaattgtgaacttaggctgggcgcggtggctcacacctacaatctcagcactttgggaggctgaggcaggtggattacctgaggtcaggagttcgagaccagcctggccaacacggcaaaagcctgtctctactataaatacaaaaattagctgggcacctgtaatcccagctactcaggaggctgaggcaggagaatcacttgaacccaggaggtggaggttgcagtgagccgagaccacaccactgcactccagcctgggcaacaaagtgagactctgtctcaaaacaaaaaaaccaaacaaaaatccaccaaattgtgaacttaatgcaaaaggaagtctttcatgaaagacagctattgtatttcaagagaaaacccctttaataaaaccaacagatatctttaaaaagtcatctataaatttttggctatattataaagatctcttttatataccagatgaatgaaggaaaaaaaaaaaaacccaaaaacccataatggaactaaaagtggaaattagctataaatacatgaatatgtgaatgttacagatttaagggctaaactactatctttttgaaatgtatacataaactgatgctggattcataaaacgttaaaaaacctggttcctaaatattaactgtgatgcttataaaggggatttttaaaaagcactgctcttcttttatttcaaaagagagacatggttagaaactttattacccattacttctgattttctatgacagtaagattaccataaagctggttctaagtttcttccacactgaattatttaaaataaaaatgtgagagtggctagaaaaactgaaataactttaaacgtaatgaaaatgttttgtccacacattgcttatgcaaaaaacctaactgatggtaacagaaacaacaacatgctagggcagtgctgagtcacagacacttgcacagcaaacttaacatgctgactctatcactggagtttcgctcttgttgcccaggctggagtgcaacggtgcggtctcagctcaccacaacctctgccttccgggttcaagcgattctcctgcctcagcctcccgagtatctgggattacaggcatgcgccaccacacccggctaagtttttttgtatttttagcagagacagggtttctccacgttggtcaggctggtctcaaactcctgacctcaggtgatctgcccgcctcaacctcccaaagtgctaggattacaggcgtgagccaccgcgtctagctccatttttgttttaagagaactctcctcctgtttgggcaacactaaaaatcctaattttgggtctagttcttcctaaaaactaatctttgacatttcatccaaaaacaactaacaggtggtggatttaattattatacatttgtcctgtgttatattcaagtttccatggaaatgggtgggtttctaacatatcaaataaacgtatctagaaatagcctaccattcactgatgtcatgaaacaagaatcaaagaacaagatggactgtgagaaaccaccacctccaagtatgacagcagctccaagtgcgacagcaatggctatctacctggggcatgcttccctgtctacacagtgtgcgcctaccactgcccttggcagccagtttgggacgagccacaccgcctgcctgaggttcttcctctgtcacccactgcctcaattctactcacagcaatccttactctggccctgtgatatgcagcttttaccagctggactggcttcctgtcatctctgccatctgaaatgagaccttttcttcaagattctgaaggcttctccaagcatcctggttggatgatcttctgaaacatggcttatgatttttataccacacactacctcaatattacagttatcagcatacatatgttattttccatttaatttgtaactcctttaaaggtatgtcctaggtcatactgatttctggattcacccctcctcttcatgcactgcacagtagataatatagtaccaataaatgaaaactggtcaggcaccgactactccaaaggaaaagattaatttctggacaggtataaaataactggctaccctaggtgctcaggactcacctgttttggctggcaaaagacgcctggtctataggcaggatgctttcaggccatggggcagtctgatttggaggagcttgttgttggctatactgaggtccccccatgttcatctctaattcagatggccctagaaagggagaagaaaaaaatcttacatctttaatcaaggaagcatttatttctgctatgtaatataaagtgaaatgtctggtttatgaaaaagggaaaacacagaagcagtaataattaactaggtgaatataagaagataaaattctgattctgaaatagaagtcaataaatatgaaagccatttcagagaatatctagacaagcagttctaaacctttagcatttaagactttaaatactcaaaaaagtttttattcatgtgcgttatatcttactgatatttactgtactggaaattgaaattgagaaacagaaaaaagtgtagattcatttaaaaatcacaataaatgaattatatgttaaaagatttttttctagatccaagtaagtggaagaaataagatttttgattgcaaaattaaaaaattcttttattggcatcgttttacatttctgcaaatagctttaatgcctgggttaatggaatagagtgaaatcctctgttttcgcatttcatcttctgtgatatcatatagcatgtaaaatttctggaaaactctaccataacgcttgggcgataataagagtgaagaagccaacagtgttttaggattagtatgaaaatagttttggccttgcagactctctgactgggaatcagggtgctgcaccatgtcgagactgctggctcctgaacgtcgactaactgtacttcagctggctcccctaccagagaaagagcagagcagaaaggaggccaagacaacccacaagcactctttctccgaagttcttcgaaaggctttaaagccaatggatgagatgagcttttaaaaattatattatcatcattatctgtagacctgtattccattccaaaagataattttctgttgaattaatagcttttggagtttattaaaaatcagagaaactcagctatacaataaagcttatagagccatatttccagctcaagagccagatgctcttcagtgaagactgagaataaattacatttctggatataaggtactcactattatgatttttaatcaataaatatttttaaatttctcatttaattttgcacagaaatcagtttttagcatttttcgtgctgtcaaattatacaaatttatgtttgagaatcactcattaagtacattcaatgtagtgaggcaatataaatgccatctctgagaaacaataagccaaaatatgctgaacaattaaataggtaagaaaactaatgccaagttaggatgaaaattctacactgtcttgtcaaaacaacgctggccatcttttttttttttttttttttttttttgaggaggagtctcactctgttgcccaggctggaatgcagtgttgcagtcacagctcactgcaacctctgtctcccgggttcaagcaatttccctaccgcaacctcctgagtagctgggattacaggtatgcgccaccacccccggctaatttttgtatttttagcagagaccgggtttcaccatgttggccaggctggtctcaaactcctgacctcaggtgatctgcctacctcagcctcccacagtgcctggcatctttttgtgaattatttagctcttcctcattgtgcaatatctaagtatatgaaaagaacataaacttattggaattatgctaatgtacaagaagagggctaacatgtcaatgataaaggaaataatctcaagtatgagttgtacagaccattaatttttaaaatataacagctttattgagagataattcacataacatacaattcacctatttaaagtgtacaatgagttttagtatattcagagttgtacaaccatcacaccacaatcgacttcagaacgctttcattcccccaaaaagaaacccattactcattaggagtcactccctacttcctacctgagcccctccccacaactcctggccctaggtaaccactactttactttctgtccctacagatttgctcattctggacatttcatataaatggtatcatatgatgtatcagaccatcaattttaataatatgtgaactgtctccaaatagaattctagtaatcctcacattctgtgagatgttctgtaagaccttgcaaccttcagtgagggcctgggatagtctgatttagtagtctaggtggtggcccaggaatctgcatttgaagttcctgatattgttctgatgatcacacagcgttagaaactactgctgtaccacctaagttttttttttttttttttttttttgagacagagtcttgctctgttgcccaggcttgagtgcagtggtgtcatcttggctcaatgcaccctccacctcccaggaagtgattctcctgcctcagcatcctgagtagctggggttacaggtgcccaccaccacacccagctaatttttgtaattttagtagagatggggtttcaccatgttggccaggctggtctcgaactcctgacctcaagtgatcctcctgcctcggcctcccaaagtgctgggattacaagcgtgagtcaccgtgcctggcctatttctttattaatagtgtgacattataattcatttcttccccaaagttgaaattaggtaatttagtaaaaataaaacatctcaaaggtagttgggtctcttatatgactgaagaacttttgagattctaattccatacagagttccagcaaaatcccacttatggcagcttcatgggaggattatctaaaatgcccataagaagcatgtcttgaaagaacttatgacgctctcttttctaagagagcataaaagttaaaagcaaacagcactagagccaccttacctatattcatgacctgagactgaagcgtctgtctttggccaggctggctgctgggcctcatggggatgctggctgctgggttccgaatcatacctccttggactggccggttcatggcactggtggtagcagcacaggtgactctcacagccgaactctgcggtgcccattctccagatggcatagtaggccgagaagcactgttaccaatcattcctgcatgcaagccaaagaaaactgagagatgcagtaactgaaaacatatttagcatgtatgaacaccagatgatcttaccctacaaaacaatcattctgtaattcacacttagccaatagctaatgttctcattgggcagatgtgggaccttggctaagaaataacaattggcaatcactacatagttttcataacatggacctgccgctctttatagtttagaaaagctattaaaattgttcccatttgtacttagaaacaggtgccgtggcgtgtggataaccccaacttccttcctcaggaagtgaatcacattagctgatatacacgtcaatgctttactttccaaaagggaggtagaggccaagaggaataaggtaaaaactgataatcaatactctcattataaacgataatcatagaagatatcttgaagtctatatgagactttatcctcaagtctccttcagggtatacttcaaaactgaccaagagtagcctctaagcaatggagaacttatagatctttctgatatttactgtagttcttcatagccaaggcaagggagttccttgccttgtatccactgtattcctgactatacagacctagaatgggttaggacagatttgtaaaaatcccttcctttttgaggtgttaacagttatctgaccacacataagagcgtaacgctgctaagcaggactgtgtttgctctgtcctgtcctggcccccaggatgctgataatggccaaacatttgctaagacttgatattctaaagggaaaactcttcaaatgaggtctcttcattttgaagtgtttaatgatggatacatgaaggttctgctttcaaatatatggctgctttcattttctttaattacgataaacaactaaaaatggggtatatttaacaaatgaacatgcattgtgggcgtttcttcacttacgaaatgagaatgtgctgtgatgattaagggtgaaaggtagtcagttagattttaaagttaagaggccaggcgcggtggctcatgtctgtaatcccagcacttagggaggctgcggtgggcagattgcttgagcccaggaattcgaggtgagcctgggcaacatggggaagcctcatctctataaaaaatacaaaaattagccgggcatggtggcagatgcctgtagtcccaattactcaggaggctgaggtgggaggatcacttgagcctgggaggttgaagctatggtgagctgtgattgagccactgcactccagcctgggtgacaaagtaagactctgtctcaaaaataaactaaaataaaaagttagaagggtattctattaacacatattttaaaaaccattttagaattagatttgaactatagaaaaatattatgggaaaaagggattttatttttttaaaaatctgttatctaaataatatgacaagattataggaagtctagaaagcaaaaaagagaatgatccataattcaacaatattactgcaatgataaatgggaaagtccctctcagtctgtgttttgttttttttgtttttttttttttgagatggagtctcactctgttgcccaggctggagtgcagtggtatgatctcggctcactacaacctccgcctcctgggttcaagtgattctcctgcctcagcctcctgagtagccgggattacaggtgcacgccaccacgcccatttaatttttgtatttttagtggagatgaggtttcaccatgttggtcgggatggtctcgaactcctgaccttgtcatccacccgccttggcctcccaaagtgctgggattacaggcatgagccaccatgcctggcctagtctgtgtttttttaaacagcgtgagagtattgtatgatcttcacaggctggacaccagtgctctcttggctgctcggattttaatacaggcctattctcaaattcctgcagaagattcctacaagaactcatatcttcttgtattctgctggtaagccttaataaatcatggctcctttttctcttatagaactttatataaatcaatattttatttatcttaaattttaaattaatctttgtttactgaatatttaatgaaatgaatatgactatataattagtgaagcagtcagtgcatgacatatgtggcaggcacccaataaatatttgctgaaggaaaaagttaccttaatacagcacagttcacagttgccatgaattccttataaacaatagaaagttaaaaatctacttcttccccttaaattgaactcttatattcagttaactgtgtaaacagcactcaatgtgtgtatagggatacaggcttggctaaaaataaaataccaacagttaaaacacctaccactataagttcttcttacaagatttctttccatgcctttgtttctagtgactcattgagacagaggaagaaagctataaactgtgagcagctttgcattagaaaacagcatcctgctatatccataataaaaatatgttacagggtacaggatgtggatgtggtggcaacagcaatcggtgctactgcagtgacttccaatctgaactggatataagcttgggaatataatggccactgagacagtgactactacctaggaaatgtgcctaggcaaattgccagacacctgcaattatagcaggtcaacatccaaacctgatcacaggcaacttcctacatcttcaaaagggagctggggaccagatctgaaagctattaggccaggcatattactgtttaaagttctttatttttaattagtactttttggaataagaattttatcacctagaagtataaaaggttggttgaattttaagctcttattctgaaattctccaaacacaaataatcaatccataagtttttgaggtatcagtaaattatccctggagtaattttatatataccctgcaatgcctagaacagtaactgggatagaagtgaaataagtctcagctataggattaatggttggaaacctcataaaagtaacaatcacagaattaaatggttagctcacccaaaggctttcccacatgccattctcacagtgaaaatctgtagaattttctcactttcagatgttattttctaacataaaaagttcacttgaaaaattctactagtttgatgtggataaatataccattaaattaaataacccaccaataaagtaacagtgcatttgaccccttacctgtgctactgttccctaaatttccttggtttcctatcatcccttgattacccatcattcctggctgaggtatcactgagtagggactactgtttctgattggtgggaaaggtccagcaccagttgggctttgcaatgtgatgtcaagtggtaaattctggtttggcaataacctgcccagttgccctggtcgtgggttattaaaagctaaggagaaaacaaatgaaaattgaaggttaatataggataatggaaaataatattaacagtagtgtttagggacaatgtctgtaaaatgacaaaggtatgtatgtcagggaccaactacctagataaaagacaaaatcacagacaaaaaacacatgcagcaccccaaagcatagatgtgtgatctaatcaactggtctctaattcttgacgatcttgcaaaacaaaacaaacacatgtatattatttaccatataccttcctcaccaatagtaatttcattcattcattcattcattcattctctctctctctttttttattctgagacagagtttcgctcttgttgcccaagctagagtgcaatggcacgatctcggctcattacaacctctgcctccgaggttcaagagattctcctgcttcagcctcccaagtagctgggattataggcgtgcactaccatgcccggctaattttttcttttttttttttgagacggagtctcgctctgttgcgaggctggagtgtagtggcccgatctcggctcactgcaacctctgcctctagggttcaagtgattctcttgcctcagcctcccgagtagctgggactacagctgtgccaccatgcccagctaatttttgtatttttagtagagacggggtttcaccatgttggccaggatggtctcgatctcttgaccgtgtgacccgcctgcctcggcctcccaaagtgctgggattacaggcctgagccactgtgcccagccctttttttttttttttaatacagggtctcactctgttgtgccagctggagtgtagcagcacaattgtagttaactgcagcttttaactcctgggcttaagaaaaggttaagagatcctcttgcctcagctttctgagtagctaggactacaggtaagtaccaccaggtctggctaattttaaaatttttttgttgagacagtgtctcactatattgcctaaggtggtctcaaacttcttgcctcaagtgatcctcctgccttggccccccaaagtgctgggattacaggcatgagccaccgtgtctggctcccaatagtaatttcaaatatataactgtatttgctaattaaaccagtgtttttttcacgttataatattcagacttaggagtactgctttctcacagctatgaagctattaacatctcttacatatatcaccaaacctatacatacatggtttggatattagaacatcacttcttaactgggctttcctaggattagaattagattaaaagtggttactctcattagaagttaaaaattttaagtgtgaactctgttgcctaaagcagtattaaattaaagctgtaggaccctgcttacttttcaaagtacagcttctttaaattctagacatatttggatttgatatgatttttatagctagttgacaagaatttattgtgtactaagcactagaccagcatcacactgacaacctataatttgttaacgctattaaatttaatactaagatattacaaattatagtaacttattacataacatcaagtactttattttcctgaattatataaacatagtctgaaatagcacatttaaaagaaaaagttcttaaccatcaatgatagaaataaaatattttaaaaaattagggctgagaatggaaattatgtgcgtgcttaatcatgacttcctcaggtttggttatcaggttgccatcaataatctgaataccaccaggagctacagaaagaggagaaaccataaattctacacagtccttcataacctcccctagggctaatgagcatggactgtctagtgtgtctgtttttttttttgagactgagtttcactcttgttgtccacggtggagtgcaatggcatgatctcagctcactgcaacctccaccttccgggttcaagcaattctcctgcctcagcctcccgagtagctgggattacaggcgcccaccatcatgcccagcaaattttttgtagtagagatggggtttcaccatgttggccaggctggtcttgaactcctgacctcaggtgatcgacctgcctcagcctccccaagtgctgggattacaggcacgtgcgactgcgcccagcctgtctagtgtgtttcttacccaattctcaactcttttgacttcgtgatctcccatgatccacaattaactctccattgcccaagaaagagtgaggtttgagaggtcacatgcaaatctttcgcgcgcgcgcgcgcgcgtgtgtgtgtgtgtgtgtgttctgagatggagttttgctctgtcgcccaggctggagtacagcggcgcaatctcggaccactgcaacctccgcctcccgggttcaaccaattctcctgcctcggcctcccgagtagctggaattacaggcacccaccaccacgcccggcccaaactcatctgtcttttgtttttcctatttcagaatggtcagaaatcacttgagaaaagacctagcaatgaaagatgttctatgatttgactgatggttgccatttttgatctgagaacaaatgccaggtattggctcaaattgtatctgaaaaggaaaaatcactctgttttgccaatttaatgctgaagaggttatctatctttcataaattatggccttgctacataacagatattttcttccattcaagattatcagacaacttcaggtattaatcaagtttgtaaactgagtgttcatagtaaacaagtttatcctaagcttacaaaactttaaaatgaaaagatagaagatgttctttctaaacagacaacttaacttagaatacatttagaaacgtaaagttccacgtcaagtgatgtttatatgaagattcctgagacagggcaagatttttaatgtgtgtagccctttcatgtaaaaatacttttagtagaatattttattatttttttttaaatttattttttgttactaccagctgagcagtttgggagggtagaatatttttaaatagtgtattatccctaaaaagtcagcatagctcccaaatgttatatatttcagtatttcattgtctattaaacacataaaatccaggataaactccatgtctgaaggcagtcactgaaatgaagggaaatatgacaatcagttgaagaacttcatcaatgtaggtcagtctccctgtccagtgctgattaaattaacccacaagagaatgtgagagaaccatgctcaggaggatccattttgaatactgtttcaaaagaccaggacagtagatggtgctatttgatcacaaaaaccttaaagtgactaagctggttgcatcagacttcaataatccctgtttctgatagtgattatatggaaatttcttggcataaccagccatttctcatactcactgctctgtgaaattcgcagtgctgttttctgggctccaacaggtgtgacagggctgttttcagctgtgagttgcatgaggtcattgatgatggcttgcttgtcaactgatccagcaggggcgcctggcctcgtgtctgggaaaagctgtggtaattgactattctgcaaatcatccaaaatctcctccaagttgtccagctcactgccaggctgtagttgacaaacagaagagtttatccagtctactctaagagtagacaccacaagcccatttgcaatcactgacctaactgccataaggcaccacagccaaataaaataggtagattcctgcataccacaggcctaacagataattgatcatcttttaaaaaattaggttaacaaaggacaaataatttaatctcttggtcctcaatttcctcatctataaaaagagatggctgaataagaaagaaagctctcttccagcattgtgatttattggcaatttataaattctcctttattttatgcttatcattcaattaattataagaatatatatttccaattaattatgaatagactatgactttggtccaggtctaggttttatcatcaaaactccctaagaaataacaacaacaaaaaactggcatataatgtaatccaaatttgcacccaatcagtatttaacaaacagtcatttcccttcaggatttttttttttttaatctttaaaagaacacaggggtggggagagagaagcaaaataagcttgaagcatccatgaactaagcactgccttttcaatttgagtagtcctttttttctgcttggactttcaattttgaatgacaatggctttcccagtcttttgccagcttaggtaacaaaggtagggaagcaggataaaaactggttgccccccaaacatagcactattaacctaattatacagaagctataaaaatgttttttttgtttttttttttctgagaaagggtcttgctctgtcacccagactggcgagcagtagcgcaaacactcatccctgtagtcttgatctcctgggctcaagtgatcctgccacctgagcctcctcagtagctgggaccacaggcatgcaccaccaccaccatgtctggctaattttttgattttttttttttttagagatgggggtctcattttgttgcccaggctggtctctgagctcaagcagtcctcctgcctcagcttcccaaagtgctgggattacaggagagagccaccgtgcctgtctacagaagccataaaaaatgtttttaagttttctcttccattaaaaaaaaaaacaaaattcaagcactaacataagctaagtatcaccactatttcacacttagcacttttctgctaggaagctaaactggaatttattctagattttacagatattcttttaaatataacctatctatgtgccagatatttaaaatcagatagtgcatgctaggattgctttctagtgcagaaagtagtacgaacgattttcttgatgtgtaagtggaaaacgtaagttagtttcctcagtcattggactttgaatccttgaccacaactattcctttcatctacactggcaaatcaaatgaaatacatggcatacatctaataatgagttacactgaaagtaggatggcttacatttttatccgacatacaattcctccccatgcagaggttggatatgctaagatttttgcaacttacagcaaatttaacatccatatgagatgttttttgattggaaatatttctcaagttaggaagaatagaatgaagtgagattttatttggttcttctcagagacaactagcttagcaatgattgggagatccattttcctaacgcattgttagagcaattacaagaccattttttagctagtttagccactcaattgtaacaaaagagggaggtatctaatacaggagagtcagttatgaattaagagctgggttccaaagttagcatcctaaagtaccaacagtcacagacaggtcaaattatccttaaagctctgtaggaaggcaccgcactgactatctcctccaacagcaacagtctttcctccagagtggcagcaaattactatttctttggctgagtcctaagtgaagtagtttatgtaggggccatactgcatttaaaaagcccataggtacatgttcacactattagagccacaagggaaccaaaacccagcaaagtcatgtcacccacctcatgatcactccactacggcaggtattcattgagttcaatggtgggcaaaactgctcatactactgaaataaccatttaataaccatctgttcttccaggaacataaaactgactttatgtacttaaaatacatatgtaaagttgactccactgtaatcttctttatcatgttttgctgaatgcataaggtataaactgttattctcagtataaacatagattgtcctccaaggacagtgcctagaactaagtaatgggcactgagtcaacacgatgatttcttttaatcatattaacacaaactttaaaaaatcttccccaaatcagtaatttttttcataggaattcctataatttccattactttttcagaaaatgtttcataaaaatgtgtggtaaatttccttacacttgtcatgaagatagatcagaaaaagcctctaataaactgagaaggttatatctgttctatgaaaaccagtttccctactacaatgttgtcctgtgttgagcatttttaaaaggtagaagctccatgtgtgggggtgagggaggtgggctataataagtgatgagttgcctcttgagaaagctctgcagattacttttaagagaaatatccaaaataaataggtccatgtaaacaataaaagtaaagtatgttatttctcaatggatacatttatatttgcttccaatcccagacatatgtaaaaggaacttttgacaatatatattaagaacagtctagactcacacttttccttttttttttttggagacaaggtctcactctgtcacccaggctggagtgcagtggtgtaatctaggctcactgcaacctccgcctcccaggttcaagcaattctcctgcctcagcctccccaacagctggaactacaggtgtgcacaaccacacctggctcattttcgcatttttagtagaaatggggtttcaccatgttggctaggctggtcttgaactcccaacctcagatgatctgcctgccttggcttcccaaagtgttgggattacaggtgtgagccatcgcgcccggcctaaatacatttttcttaagaaagccattcaggatcttcttagtatcaaaaggaactagttctatgaaggcttaaaactatgaacactatttgaattcattcaagcttggcatctgaaaaatgcactatgaagttttcccaactagagataatattgctttgcctgtgtttattccttgtcaatttatggagtacacatttaacattaattgtcgtaagttcactttacatgttcttcttcaaggagataaagttcagaatatctatacccctcaggttaacagtaacatttgatgactacagaatttttttttttctgtattcatgtaagttttggaaggaataaatttgatcacattaagtttctgttaaaaaattttctcccctcaatttttgtaggctttaattctcatcaaaagttcttctagtctctatccactttgttaggcacaatttctttacaagacaaaaagattaatgccttcctttaaaatgctttgccaagatacttcaaagttttgcttaggcatctatttgaatgctcaaattagccacatcaatttgagttgttagtttaaactatttcaggcagaaaatgagtcagaaagatttttataaaagttctacaaaatgaaaatcagacttgatttctttaatttttcatttttctggttttaggattttttcatgtcaaatcaacttgttctctgcaggaaatataaaaagcacaagcatttaaacaacatcagtattctaataaattacaaggcatcttttcaaaatattttaaataaaaagtataattttaccatatttgcctaacacaaagttgttaagaaatggtaatacaattctaccacatctggagagaaattttcaggacactatcagtttaaaatatggtttgcctttctaatggagtcaaataccaagaagaaattctttttagactatttccaaacccttatcatacgtgtctcagcagcattagaaaggacccagtagtatcgtttggttaagtatcaaccatgttccactgtgtaaataagcatgtaacttaaaagtgtgtaaacatactggaaatttttctgttactgtttcctgctggttaggaaatgctgtagaaacaaatgtttaaccactctgctcggtaaaaaatgctattttgggtataatagcaccatcgaagtacttcctgtcattaataagttagtaataggttaaacacacactcagtcaatggctcttttctgaatcaaaataacaagacagttaactgtgcaattcagactcattaatagtttgttttatctcactaaataacttattgtattcccttgaaatgaaagaaaagtcttcaataagtttgtacagcaatcaataggagatacaattaacctgtatttggaaacagtgaaggtgagcaagaggtgaaagaatcattgtttttttcttaaagtaagtcattctaactttgatctaaatataggtaatgcacacttcctgtggtaacttttcaagctgcaatgtttttgatgttaaaattgctctaaagcagtacttctggtggagttttacatgagagtaaagggagggcgagaccagagactggatttcattaagaaaaatatacttactatatgtgcctctgtgtgtgtgcacatgcatgtgtgcctgtgtacactgctttttgattcaccccaaaaaaacagatctgtgctgattacactctggactttatgtttcctaggtgagacaatttttatcagaaaaacatttctcctaaataaataacctgaaactgcaagtgactcaaggagtttttaaaaaactcctcttttgtcagtttcttgtctgaagttagtgcaatcacataaataaatacagaaataccaaagagtggcccctttccttgaccctctaagtcccttgggcctcagatcaggcctaggatagaaataaatcgtttacacagggaaggcctggccacgttagacactaagctaggggagaccatcttgccctccagcatgtgtcaagagaccggagtgccattgtctgtgcctgccactctggattaccactagctgtgtagattctaatctagtacacctcaaaagattaaaacacttacaggtgttaatatggttttacatttcactttattcaagacattgctattaattttctgctgagacaccagtttccccatttaatgattttacagtgttacggaacagctgctaatagaaccttgcactaatatctaagtttaaggattaatcacccaagacgtttatataatttggctccgcttcccttgtgaaggacatgaaggtttgaaaaattgtatccgacctttaggaatggtagcagctgtcgagacatcaaagtgaaagaaataaggaagccaagtgcttagaagcctagatggagcccagctagaagagcaagtgtggccttggcttccctgaggatggctctcaaccccagacctgcctctgggttagctctaccgactcagcagagctccaaggtacagcaaggggtgtgcttttcctctctccatccattgaagacactgacacatgaaatatcctctcgcaaaacaaatttcaaggacaaaccttgagtcatttaaagtaggaaagccctcttggcttcttcacttcttaaccaatcatgacccaagaacagataagaagtatagggcatattcagggactagagaaaagtgatggctagggtaaagtctttgatcattgattccctaggaaacgtctcatgccaagtcactgtggctgttaataacccatgttttctttaaatgggttttaattttttgagacagggtctcaatctattgcctaggctggagtgcactggtgcagtcatagctcactgcagcctccaactcctgggctcaagcagcctcagcctcctgagtagctgagactacaggtgcatgccaccacacctagctaattttttatgttttctagagatggggtttcatcatgctgcccaggctggtcttgaactcttgtcctcaagcagtcctccaccttggcctcccaaagtgttgggattacaagcatgagccacctcacccagtctgtttttgtttttttaataaagaaaaatagcttactttttccctgtgatgtcattatctccttagaggattatcaagaatgatttggggtggaaggttgaggagatgttggtcaaaggatacaaatttcagttagccgggaagagtaagttcaagagatctattgtacaacactgtggctacagttagtaacaatgtattatatgcctgaaaatcactaatagattttaagtgtttgtaccccaaaaagtatgtgaggtaatgtatttgttaattagcttggtctagccattccaggatatggatttcaaaacaacatgttgtataccataaatatatacaattttaatttgtcaagtataaataagtattattttgaatatcacttaaggtatcctggattttttcagggaacttatttttcagacaatgagagcacataatgtagcctattattctagttttgaatttacataccatggctcagacgtactaatatcagttcaatctttctttctcctttctactatccctttccctcttaaatattttttataccagtggtctaagaaattcttttgcattaatcagaagtttagttaagaataaagagaggtagaacgaccttcattgggtttcaaaaccagttaaactctgatcttaaaaagagagaaaggtaaataagaaataattcaattacgtctgttctgacaaagcccagtttcaaggaagtgattatctccaattcaggcagcttctataacagaggtcagcaaactaccaccagcctgtgggctaaatcttgtttttgtatgagctaagaatgaatttacatttttttaatggttaaaaacattttaaatattttgtgacacatgataattccatgaaattcaaatttcagtgtctataagcaatgttttatcggagcaaagtcatattcaagtttgtttacacagtgtctgtggctgcttttgcactacaatggtggatttgaatggctgtgacagagactatatggcctgcaaagcctaaaatacttacatttggtcctcacaaaaaaaggcctgcccacctatgttctataacaatgtcactctgctaggagagtatttgaaacacacagcttcagcgagattttcaagataagaacaacaaaggagaaagcttatttttatccaatcacctgagacttcaaaatgcccctatggagaaaatccttgatggatacagattagtacacctgcgagaagatgtgataaaacttacctggtcaccaggctcaaagctcatctcctccttctcagttttcattgctattaattttgtgttactggcaggatctgtcttactgtccagtctctcaagtttgggggttatttctggtaaaccaatatctttagtatcatctttatctagcaaatagcgaagtagtgcattctctttcttcttggggctcaccggctcttgtttaatagtcacttctgatccaggagctgtgctgctggactcctggctcaggtctttgcctgtggcttctgctgttaacttggccaagtccacaggggaactgctgtcctgcaagagtctgtgcaaaattttatgcttctccttgagcgaggttccatgtgtagacccagaaccaggcaagctacctgtggagtctttgtttgtatccgacaaagagctggctaagggcgagggctccatctgatcagatttggtggtcagcagctgcaggagtttggtctgccctttgctgtcatgcagtctgctctgcccgtcagctctctcactgctcacggccgggggcaggttggggtcatttgtttccttttgctctccaggatggcagctgctctctgcttgtccagttgtaccttcagagggctccccatatagtccaaaacagtcttttgagtccaagcttcccatcttgctgagtgggggaggattcatattaactggggagttttgcaaattgcccatttttaggtctggtgaagccaacgatgaccctaatgagaccccgtgcccctcgctgagggcctgaagtgcattgagggagctgttggtataactatggctatttcctgtgctgctgcaaactcccacaggggaatgcaagcttcctgcaggggaaaactgactgggtgggattcgagggctgccagccactccagggctcatgcgatgccttggtgaaagcatggaggtgggctgtcctggattcatgccagggctgctttgtgaggggctgttcattttgagtgcatagttactaccctgaggagtggttgcttgcatgcctgacacatggttcattcccccagaaccaccaaacctgcccatgggcatgcccatttgttcctttgggccatttatgggaaaatttatattgctactgagggtcatgtcctgacctgggttcccactgcacagggcctgatgggcagggctgttagagctaattggattcagtggcttccccatcgtttgtccagtcagatccggattcatcacacacacattctgctctctgtataacgagaaaagaaaaaaatgtaagataaaaggaaaaatacttagcaagttgttattaatttttaaaaatgatatggcctcttcaccttaaaagaacaggctacattttaaggatagataatactttgttgaaatcatctgcaattattgacaagactgaacatgtacagtgttggaccaagagggatgtttttcaggcaactcattaagatgtctggttttacagagggggtgtgtttaaatttgactactactgtatttaaattgcatttactagacaagacattaacagggttccaattacataatacatctttctcatgagtagttgagagcttgtactgtcttaaagaaatgagtagagctgtcttcagttttttttccagagattataattcctaacaatagacacatctgtaagcccagagctctgatatttactacttggctcaagataaacacgcttaggggaaaacaacttgcccctaactgttaaaagagaaactctgccagttctagaactaatagttactaaaactgtttagaattagatcaccttgtttaacagatttccactcatctcctcaccccacacccctccaagtcagagcaagacctcagagccaacagcatgggaagggaagttcagagtgactttagtttgggatcttattcttctacttctggataactccattccatctccttactaatgactaaaagcaggctttctgagcaagatgattttgcaagttctatgagctttaatttacagccttggcagtcacttttgagttaccaaatgtgttcacaaatccaaataaaacaggtttcacaaattgtcaaacatcagcttttcgttaggtgggtgaaatttgccacatctgtaatcactttcaaattgtttcagtttgaggttagatttattaacagttggcaaacagagttgcctgatttttttactcctaaacagtgaattgagaaatgtgataaaatggaactcctcagccagagcaacgttatatatttactgataggacctcataaagttttccacagcataagcataaatatttagataactaatgaaatttaatcattttcctaaatatgtgctctaagacaatatggcttatgacatttatttaaaaatcaatattcaatttctttatcttcacttttttatgaaaatgtttattacccttcaatttaaggtctaatgttgagaagttaatttgaaccagagaacaaaaatctaaaatattatttgtaaatatatacatagaaagttctagatttaggctaggtgtggtagtccacacctgtaattccagcaatttgggaggccaaggtggaaggatcactcaaggctggcgcatgcctgtaatcacagctactcaggaggtggaggcacaagaattgcctgaacccaagaggcagaggttgcagtgagctgagatcgcgccactgcactccagtctgggagacagagcaagactctgcctcaaaacaaaacaaaaaacaaaacaaaacaaaaaaaccaaacagttctacatttaaacacacaggagcagaaatcatactagtgacatcaatattcctgccctgcatttgttgctactgggagctgatcaataaatttccctttttcaatgtaatgggcaatcatgtctaagcaaacttagtgccaactgggttttacaattaactagtgttaaggctaaaattcaaagtagagtcctactttgccagtacagttgttctttggttatatgggggactggttctagcctccaccctgcccccacgctgcagatactaaaatccatggatgctcaagtccctgaaattaatagcataatttttgcatataacctacacacatcctcctatatactttaaatcatttctagaaataatttcttatacctgatacagtgtaaatatagttataatacaaataatacagtataacattatatatatatatatatatatttttttttttttcccccaaatattttccatctgtggttggttgactcctgggatgcagaagccatggatacagagggccaattatattatgaattgtcttttagccaacagctaataacaatttaattttatattttacattactgggattgatgagaagaaatgtctaacaaatcctcaaagctctaaaataatttgctgcttttgtaatatctcctcttaacttggaaatggaaaatgacttcttagaactaggattacctgtgaagcatatgtaaagatattacaagttgaggttcattagtagtctgagaacggatgagtttgctcttcgtttgtgcagcaacaagagtgccatcagacaaggaaaaacgatagatttgactgaatgccaatccttgtctcagtactgcaggcaagcaaggaaacagaaggcacgtttagaaaaaaaaattgaggggtcggggaggacaagacataataagagtaatcaacttcattaagtttcataatagtttcccaccagcatgtaaagagttataagtaatactttatgagattgaaacataacattttaaaagcacatttacttttcactgaaaataccaataacctcaattatctgttttccttatgaaaaggagtaagagcctggaccctcaaactgtgttcttaaaatctttattattatggcaaaacagtgtaaaccatttaactgctcaaacaagctttataatgatttgcttaaaatggtagaaaacaacacaatgtataaacagggtatctcttacgtatacaatatgactttaatttccttgtaaaactaatacaaatatgaaaataaaatttatgacatttaatatgttctctgaatattcatctagaaattacgtactgttcaatccatcatctcacacactactctcccccagtcctgtttctcactgtgtaagaagtattatttatgtggttaggacaacaggaagtaaaagataaacaatcagaagaatctattcagagaaaaaaaggctaaacaaaactgaaacaataaaagtgcaaatcttagcaacactggaattggtttaacttttagataagggatcaggtgtttccattttcaagacaataacaaaatagaacacaaatcaactaggttaatataatttctcttaaaagaattgagatttatcttttaaagctactatgttttataactgtcttatatcacctattaaaaaagaacatttcaattcagttaaaaaaaaagacatagaatttagttcctcttaaaccattttaacaaggctactatgttgctaccacataatcctcagcacaaattttgtgggttgaatagttacccctaaagcaaccatgtgtattcaccatgccacaaaactgccacaagtgagagacagagagagagagagagagagagggagagagagagagagagagactgacatataatgtggattctaatttcttcgtaaaatttcactttaagcaatttgtctaatgactcctctctgcagtttcagttagatactacatttaggtttcactttctgccatcaactgttgcacaatgttagtctgaagtggaagtactgaaaatgaattactgaacatgtgagtatcttgctttgcacaaagtgtctaaaagatgacataaatgtaattttttatagtaagacttatatttccaatggcttataatttcagaattttacctgaccttggctgtgatccctaaagattttcatttcctcttggtctacatccaacacctctgaaaagtaggtatctgtgagcacgcacctgaacacatttaggaagtgcctccatttaaacaacgctttgcagtagatttctgttcaatgtaactgatcattcctgatcttacctatttcaaaagtttgaaatgtctatacggggtttccttccagtgggtcccatctgtttaaatctagtgcagtgcctgatccatctgtgtaaatccttttgtaaggaatcaggttgtcaaagaattaaactcaggacccaaggatgctgaacatgtttgcttatgccagtttcttagtttttgttattactattcttcctattttaaaccagatgtaatgaaatagtaggttaaatattgatttctgtcaatgtagcatcattatttccttgtattctttcaaacttgaagaaaaatgacggaagacacaagttgttggattatgcacttatttctaaaaaataggatgaataggatgaaaagaatgaataagatgaggggaaaaaaagggcatgggagaaacaggtcatttattaagatttttgcttttttataagtgatctaaaaagtataaagtttaaacataccaacactattggtaaagtgccagatgcacattaggtggatgatgacaaactgaaactccattttcaataactagctacaaatttttttctgcaaggatgcagacaactgttgaagctgagttacaagctgcactgcactgcatgagtccctcacgtgcagcatggcgcagctgacagtgcatgtggagccctggccaaccgcactgctgggacacagagagaaggacagtctccctccccaaattagcacatactaaagcaaaagaattttttttttttttggttcctacctctttaacagaaaacaacaatgcacttgagaaaaagtgattctttgggaagaccttcggaagcagcatgacagtgaccaaaatgagctcagatggacgtcctgcactgacactgaatgctagagagtcagtcatttcacttgcctgaacctcctcgtccccttgtccagagtgagagacgtgatgttcacatcacaggcttgctgtgagggccagtgagaggaggcaaaagggataatgccacacaaagaccaggtgctcaataagggctgctgttattactgaagtcttgggctcagttccagctgtcctattgcttaagtctgtgagctgagacaagtcgtgtcaacttttgggccctctagaaacacctggatagtctttgttggttaccaccttgaagaagggcttggggtcccactgttaccttcaccaggggttcactcactctccaaaattccacttactcttatattcagattctaactgaatcgttaatatttcttttcattagatggtacttataatcttgtcacatatctagaagcccctggatcaaagaaaatgacctcttcctccttttgcctgcctctgtgacactatcatctcctgttctactttcatcactcttctgtcctacaggttctcctgttaaattttcctttagatggcaacactggggccagatgagacagctcacgagaacagtcaccagctctgttcccaaggtgaactccaggaatcattgacagaaagctcccacaggaagcaataatttaagaaaaatcatttagagatgcttaccttcatgatgatgcctcttagcataggacacagattctccttcatgctgcgcatggaacttctgaatacaccttcttaccaggtcctcccagcctggtttcatggctgctctcatggtgctggtatccagagacgtgatcttgcctattaagtaacagcaggcattatacctacatgttgatctattctttatggaaataatttttttttttttttttttttgagacagagtctcactctatcgtccaggctggagtgcagtggtgcgatctcagctcactgcaacctctacctcctggggtcaaacgactcttgtgaatcagatgcccaagtagctgggattacaggcgtgtaccaccacatttggctaatttttgtatttttaatacagatgaggttttgccatgttggccaggctggctttgaactcctgacctcaagtgatcctcctgcctcagccacccaaagtgttggggttacaggtgtgagccaccgtgcccagccagaaacaattaaattttaacaagatttaaatgtatttatttaaactaggtaacataagtacatggaacaaaagggtatacagtgagagccagtggctctctctccggtcctccaactccttgacatttctactgcagcagcaattgctagtactagcatccttacagtcttctaaatagagtccttgcattcccaaatatgtaagtattctaaaatgattcctttggtcttctttggagaggaaatttaccttggagatcctggcgagtagtaaaactttctgatgagggaagaactggtctttccttcatgggaactcttcttgccacgcaaatcaagcaggactgcaaatcttaaaccacacatgtttacatttatcatattgggcttttctagtgattcaaacaaacccaagtgtatttatgacagcacagcctgtcattaaaaaagcagtaagggagacagtgatgaaacactatgtacctgagcttcctactggttttattctcttcatgaaagtggtaggtgggtaagggagacggagggtggctgtgtaaggagagctggggagcaaaggataaactgccaagtccccgcgatacatgtgatggaaatacatcgactacactaaaacgttaataatctgaaaccctctctccagcagtagaaaaaaaaatgaaatcctttctttttaaatggctgatagaaaaccaggttaatttgtaatgaagtacaaaaatgatgaaactaaaatatgatactcttgttttgtcaagggtttgcttcttgagttttagggttcaggaaaactaggtacaccttatgccaaactaagtaaatactacaatggcaacatgcaatttaaagcaaagaatataaactgggtctagacgcagattcagagaacgactcccacaatacctagaaaatgcagcgtgcaccagaacagctgcattatagttcagaatcttggctgtggacggtttctcacacagccaattctaatcacttaatcctcaccttgcttcaactgtcttatgcgtcagggttcatttctggaggaaagggaaaagttttatttatctttgtaacatgcagagtactctgcacagccctttccatttaaaaaacactggacaaatgctgttgtcaaaaaacttaagtaatcccttcatgtcttcttatatcactgatttctgattgtttacctctaaatttgagaatttcttgaatttgacaaagagtttattatttttctttgctcctgctgctaccctatctaaaatatcaggctgcctcaatttcatcctccacaggtattcatgctgtaaggcggaggtcctctacaatcagtacttcactaactactataggaccccacactgcctccttggacagatttttctttctcaacttttacagaaattttaggatatagtttttaacttggctgttcctgaattgctctactgtagtcttttaaaactgtttcatgtattatttcttcaacaagactgaaatatccagtaatagctggtatcacaaaactaaaatgcaattatagtcctcaagaaaataacaactaaatttttgggcactacgagataaacacctttctagctactgtatgagttattaactcatttaatcctcttaacagctctatgacacacgtagtagcattatttccattttacagacaaaaagatcaaagcacaaagtttaagtaacttgtccaatgtcacgcaaaccttcggcaaagccaggattagaatctgagcatgccatggctcagaaaccctgtgcttatgctatactgtgttaacttaacatagaacgtacttttaaatgtacaaaaaatgtttataaagcacaaagtaataaattagctcagctattccttttttatactgccttggaatattatcagatggataaattagcagcacttactccgctgcataaaacaaaataaaatcatttgacctaggcaaaaaacttaattttgaaatactatgtgtttattatctctaacagctctaatatttccttctcaataaaatttaaattttaaaataagcattaaataactagcattcaatgccaaccacagttcagcatattcatttaaaccttattacattctgatactggtattggtgacttcacttgataataaactgttgctcagaaaggccaaggattctgtccaaagtcccagagctgggagcagctgaattaggagttggcctgtctgattatgtagccggggatgttttcagtcacaagtggtcctcagctctttcccttctgctccccacgcacaatgcactcttcaacactgccttgtattagagtgacactcagctgtgtggacggcttgcctagtgggctcaggaagtgaatgctacatcagcacatctttatggcaaacagcctaataagcttagagtctaaaaccccctccattccccactcctgtctctatcctctctttagtaccattgtattttatcaattctgggcccagcatccatggataggctacatggattccattaaccccttgaaagtatatttaaaaggttgttttaactgtgtgcatttttcttttttcttttctgagatggagtctcactctgtcgcccaggctggagtgcaatggcgtgatcttggctaactgcaacctccgcctctcaggttcaagtgattctcctgcctcagcctcctgagtagctgggactacaggcacatgccagccaccacgcccggctactttttgtacttttagtagagacagggtttcaccatgttggccaggatggtctcgatctcctgatctcgtgatccacccgcctcagtctcccaaagtgctgggattacaggcgtgagccaccgtgccaggaaaactgtgcatttttctagggctgtggctcacagcttgcactagatgttcaaagagcctaggatccctcaaaagtgtgctcactaatacagttatactagtacagtagccgctaactgcatgtggctattcaaacgtaaatttaataaaaattaaaactcccgccccctagctgcactactgacatttcaaggctcaccagccacacatggctagtggctgccacaccagacagtgaagatatgtcacttccaccattgcagataattctgttggacagtgctgttctgaagacttaaaaatttccatcacaaaacagtaaaattgaaaagaacaaagatactgcctcctcacttttctttgggtgaccactaattaaagtgtgaaggaagtagcacaggaataaatacacagacacacagaacaccctagggattctgtcccaccttctccttcttctttgatggactttggttgagagacagcgaagcactgcatagtttcatatttctgatgagcttcctggttatcatgaccctcctcttctgaatcaggtaaaggttttaccagcatccgacaattgaaggtatggctgttccgcctcggaggttcgccagaccaagatcccccatttactgagcaaggcaaaagtaatccagttttacaaagaaacaaacatcagattcattgcctctgaattattaaaatgatgtaggaaaaatatgattatttcatctttatgtactacttttatacttgtctaaatactttcataatctagaggaggaaaaatctttaccatttttacaacttgggaatatcttgggattttcttttttccaatttttttttcttttattatacttcaagttctggaatacatgtggaatcttgggattttcaaaacattttctacactacttctttaccctgactccttcccttcaagtccagtcctggattatttgttactagaatactatagttttctacttttgcgtcttcctaactgatttcttagaaatttagttcaatctacttgcattctaattttagataagtcagccctgctcaaaattctgtgagtggcaccaaatgtagtgcacgttaaattctttcagaggatttagacttgatgtagtctggaggatgaagtccattaacacagactctcactaaccagctccattgcatccatctaacgggatcttccacattcccctgcacaagcctccccatgctccaccataccgggcccgcatggatgtccttgctcctgctgccaccctatctgacatatcaggttgcctcagtttctctctccataggtactcatgctctaaggctgaggtcctctacaatcaatactttactaactactcccccatactgcctccttgggcagatttttcttttctcaaattttacagaaactttagtatatagtttataactttgtttttcctaagttgttcagtggtagtctttttaaattgtttcatgtacatttcttcaataagactgaaaaatccttgaaaatacagtgcaaatgtcatttcttttcaagttaactacttcagacatctatttgagtattaaaactaaaaaaagtatatatttaagaatgagacaatgaaagagaggaaagacaacaattatttttgaaatgcattagagataacaatgaaagaaataaaacaatgactgattttgagaattaaagggtgtttatggattttaccaggttaacttcctcatttgacacataaaaaaaatctgatgtccaaagacatgttcaactactagaaaagttggaatcagaatcaatcctaattctcattttggtgttcttttctatatcattccttatgctttatctaaaatatactggggacagtaggacaatagaacaggagatcaaaaaaagggtgagtcataagaaaactaatatattctccagtcatcagctaaagaaaatggagaaggacatgtaggtgttacagcgaatccaatggcccatgaatggcccagtgaacccaaagagcccatggccactgggctgtagaatgagaaaggaaacaaaccctcgaaaggaaaaagttagctgtaagaaattatttgaaaattacagaaaaacccataactagctttttatgtttttgcagacatttgggaagtttatttcagcatcagcattttattttattattattacttttttgagacagagtctctgtcaccaaggctggagtgcagtggcgtgatcttggctcactgaaatctccacctcctgggctcaagggattctcatgcctcagcctctggagaagctgggattacaggcacgagccaccatgcctggctaatgttttgtattttttagtggaggcagggttttgccatgttggccaggctggtcttgaactcctgacctcaagcgatccaccagccttggcctcccaaagtgctgggattacacgggtgagccactgagcccagccagtatcagcattttgaaaagcttatttacaaaataaagactacacagagtagtcaactgaagggaaaaagagttcttattaagtcagattaataagttgaaagttaaaaggatacaatataaagtaaggcaaagagctctttagacaagtgaattaataatagtgaattaataagtagaagtcttttaaggaagtcataaaactactgaagagatctgaaaatattagttacttgaaataagaaatcccattttcttaatttactagagaatataataaaggaatcctacacaagtattcatacattttgtatcactgttatagtcactttgaacaaagaattatcacataaaggaaaagctagcccgaatgaaatttgaaaaggaccttttcctacttattacaacaataagaccagctagtataaacaatcttaagaacagaagtacttgccaactcaggatttgaccttattttgcacttccttcaatccgtgaagatgttcttagcatcatcaatttgagaatattaaaaaaagaatcacttagtgagtgggaacagcagtactctagagcagcagctaaggtgggcccacgctgtgaatcacccactgcacagtgtgtccttaatcatcacgtactcggacgacatctccaaaataagatgaagtcaggaaattccagacagggagagtaggctaaggcagcggcatctggtgatcacacctacagggcccactggagagtctgcaagaccgaagagcccattcagggcttgggctatagcatctgaacctctccatctgccacttgttccttaacattttatttttagaatgtgtacacacctataatatgcttcatgtgcaggactcaaaatacgctgaatctcaaacttctcatgacctttgacttttcagatggtcatggagaaaatggacaaaacaaagttggctagcatggaacagggtgaggcaatgtgtcaccttaaaaaaacaatctctgcattatagcacaaaggacagatgctcaaggggataaataccccatctccatgatgtgactatttcacactgcatgtctgtatcaaaacacctcatgtaccccataaatatatacacctactatgtatgcacaaaaataaaaaattaaaaaaaatacaacaatcttaatgaaaatagttgccatataagtactttccatctgaatcattttcatgaatctgaatcaatttctgttcatttatcatgaggtaattactgccaagcaaaatcatcatcatcatcatcatcatcatcatcatcacttcttggccttttggctaagaagcaatgattttcacgtactttaaatataggatcgaaaatgatcactcatttgagatcagtatctgaagatgcccccttttccatgacttttaagcttaaacacacaagcatctgtaaaaaactacccagtcactctcctccccatctgatataatatagttttatttgatccacttcaaccaagacactgtgtgtatgaggcagggcaggtgggggtgacgggaggtagggagggagacccagcagacatttacctatagactttggcagcaggtttttgacaaattccgtgtggtccccaacatgcaagatgctatatacacttttgttcatcagctcttcttggttataccttagatactgtgtcacattctctgacacaaacacaacgttgccttccaggttcactacaaagaagaacccatcaagggcctagggaacaaagtacaaattgtgttagaaaggatgcaacataacatcacatgcaattgttaagaagggaatgatccctttcaaggaaacacaattcacacacagatagaaaagagatctttctcagccctctcccagttttcaggaacaattaacacattttctcttggtgaaatagaaattattccatcttagtaagtgggagagagagcctagactagggtttcttgtcacaaactaaacgaccaacactaactccattaatttatcaggagataattaccgtgaagtaaaagtgtacagacattcatctgtattttcaaaatgagactgacatactccacggggccaagaacaacttttatgtcatcaacctaatgcaaggtaattttgatctatagtttgtcatgttatacaatgagagaaaggggtcataatttttccccagtttaaggataattaccaggaaaaccttcctgaattttaccacctagctgtcacggattatatgaaaaacatcacagataatttcagacctttaaagaaacatcaatcctttattacttggtgtatatgggaaagggtctcggaagtgtctctgatgtggcaaactcaccttcatggggacctcagcattgccctgaccttagaagggcactaattatgtcaaattattctatgttacttgttctccagattaagatgcaggttcctaaattacccaaataacagtagcacgcttccggtaatgagttcacagcctcactttttgttgtcatcccaacggaggtaagggaaggagataaagaatctaggatcatttcaggaagttgagataataacagtggctgtggagcatgttcactgtgccttacaagtacctcctggaaggaatcttttatctttcccaatttacagaggaggaaactgaggctcaaagaggttaaagtctcagaactagtcagtggtagtacagcttgaatgtgaatccagaaggatcagattccaaagctcatgctttgatgaccattcagtacagtcctctactctaatattcattcacccctaatccacttcccatcatgtttaccttggtgatggaaatgttgggggtttagtttctcctggttacattaccccatttttctctttttgacccttgcttatcaaagctctgttttatggatcacgtgagtgatcaggactgaaagctttacattgattcatcatacctgggaccagggccatggggtctagtcagtttctttgtgatatgtgtttattacaattttatcttttttggagacaaggtcttgctctccgcccagcctggagtacagtggcacgatcatagctcactgcagccttgaactcctgggctcaagctatcctcccacctcagcctcctgagtagctaggatcacaggtatgcaccaccacacccagatattttttattttttgagacacagtctcactctgttgcataggctggggtgcaatggcatgatcatggctcactgcagccttcacctcctgggcccaagtgatcctcccacctcagcctaccaagtagctggaactacaggcatgtaccattacaaacttgactaatttttttatttttgtaatgatggggtctccctgtgttgcccaagctggtcttgaactcctgggtccaagtgatcctccttgtctcagcctcacaaaggggtgaaattacaggcatgagccagtgcgccagtctttttaaattttctgtagagaaaggaactcactatgctgcccaggctggtctcaaactctcggcctcaagtgatcctcccaccactctgtaatcccaaagtgctgggattataggcatgagccactatgcccagcaagtttattactatttttaacatgaatgtcacatgtatacacatacaacaatgaatttggtggatggggcctgaagtgtttactttttccctagtttgtttttcccttatgttattaaacaggctcctattttatgagctatctttgaatatatttcatctttaattctattttaatcacaaaactaagtgctctctcaaattagaactgaccataaggcaccagagaaaggttcacccatttggtttttaagtttttcttaaaacattctatcaggttttctcaattgtatgaaccacatgcaggacaaagcaagactatatgtaaataaatagcctttcataatacatggtactaaccttgagaactgtgtgcaagtgtgtgcactcaggaggttaggtgataagttacatgcccagtgtcccttttcaactcactgctttggatacaccctttgatagggattttcataatcatattacctatggttcatttttaaaagtacatgttgcttcctactgcttataccacagtaaaaagactgacttgaggtataataaaactgaaagacgaaattgtttcctctcataaagctgtgttttttttaaggctcactatgatatgctctgatgaaaaaagctgacatttggttttgttgcctagcaaccactatgctatgatgtaagcatgagtgtgcatctatgcctaggaacagctccatgagaacatgttctctctgtttaagtgattacacgtaaacagggacaaaaatttaaattcaaaccataagtcaccagatttaagaataacctctctaacacatttaacactcaagtcctgctacacaggttcttgatcaatgcactaaattctcagaagactattctgaatgacaaaaatgttggtttgattttatgacatcaggtctactgacatctagcaatctgatttctacaattaatgaactcagtctcaaagggcttgagtcccagctctgttattcccagcatttctatttagaagtatcaaaagtcttcccaggagttgccactctaatgttccccccaccccaagatacaatgaataaacacatgtatagggaaatttcccaattgtaataatttagttaacataattttcaaatcagtttttaatttgtaattcaaacattttccaaaggaaattatccagtttctttcatttaattctaaatggtccacctagttatagttttcataatctgcttctaagaacccagagagaagtagcactctctggccttccattgccttgttgactatggaaaattgggttaagtgtgtttttgcttttctcctggaaagggaggctgaatgttttcaagccagtgattctagaggagataagcaagggccaacactgggacatttaaagccttttggccagcaggtccagccccaggaaatgaagtttgtcatttctaaatacaaagactgggtcagatgctcttggagtctttattgtgtgccccccctccgccctgcccccaattttatggtagattttcatagaattagattttctaaaaataaaaatccctttaagcatcaactgaaaaaaaagagataagggggactattggttatctctgttttaaaaatactaattattgtctgctgcagcaagctagctgattctacaatggcagtgctgcaaagcttctggccatgcagtcttttcaacctcatcgtatcatcagccgagcaaattatcctgagaactgacataatttatgtctcagggttcctctgtttcttgttatatattcactgacatttttttttctcatcttaccataacctacatcttgaattttaattttggaacaggtacagcaaagcacttggcgtttagtactagttaataaaatagaaaaactgtactttacaaactgtagacattagctggtcataaagcttcctgaagttaataaacaacaggtagttaagaccaaccttatgcttctcttaaaagttccttttgcctattatttcagttttcttccttatgagataaataagctagtttcaaatagcataaatagaaagcataaagctcctccttggtcctcatattttaacctgtatgtataggcatttgtacatggcatgtacaaaatttaagaattttgagaacatttcaagctaaaatacaacacagaatttagtaggacttgtgaatacagtttctcaaataaatgctcaactggcaattacaacttgtcaatgtctactctaatctagttaatttaattctatgttaatttcaaacacacatatactggcagcaggagccaaaacatacatagagacacacaggcatatcagcaagctcaagaggtccatagtactagtactagtgtggattctccttaaattatattcacctgaaattaaatgtaataatgtgaagatcaacaagattttaaaatacagcactaaaatgaagatgtgctacctcaagcatcataggccccagcgcatccttgtcgatgacaccctgccctgtagaggatacatctgacttctgcacttcatctatgttggcagctgctgctttctctgcaataaacataagtgtgaattaaatggcagtgctatttcaaggacagagtgacacagaaatgtttttactgtaatgatttttaaaaatctctagtgggatcagatgcagctacaaaagagttacagtacatccctgttgcccctaaatgggagaaactgctggaagcagaagccagaacattaacttttcacctctagaacctgtggcttggatccactttcaggctgcccagaaaatgaattttgaggtttcatgacagtccccaacaggcatttttttctagattatgaaactgctatattctatggcacaattaatttctactcaggagattccccaaactaggataaaggaaggtctgttgttcagaatttggtagcataatcacagatagatttgcacacatttgaagaagtaacaaggactcctaaactgctatggctgcccccatgagacattctgcaatgtctgcctggactcttttactgttccacttctgcttacattcccatttaaagtggacaggaagatttggtccctgacttgttcaaagtgcttctccatctaagaggttagaagcaccctaccaggcacttggggaatttcaatggctgccctctgatctagcagaaaggcgcgtagcgtgcgctcctggatggaaacgtgcaaggcaaattttaggctcatgaagacaggaaggccccggaagacatttcttcatagaatgagaatgttttgtgaaaaagctcacagaagaaaaagatgcacacttatcaacgtatgtggtaaagtagttatttcaagaacaccaaaaaaagtttacagcataacacatacatatcaacaacttgctagaaaacaacacaaaacaacgtgacaattatttgtacttgaataaattatatcctgtttacactgcatgttatcgttgtaattaaacgtagaaatagaaaactgtaaatcaatttagcactcagaattaacctgctttcagaaccttaataatttttttttttttgtcaaaaatattttatacagtatgttgaaaatctgtaaagcctaatttatggctgagaacctagaaaacaattaggaatgatgtgggtcctcccaatcttgccattcccatgacaaagctttcacagaggggaggatgacctgtgcagttcaagctcaaactcagtcactaagaagtatgacttcaagcaagttgcttcaatttacctgtctcccgtatatcatggactgagccaaagtaaatgggatggtatgtgaaacactctttaaaaatacaaagaagtttacaaatgtatcttaatactagcatatctgtattgattagttcttccttgagttccaaatgtagtaatttctctgcagagcttatcataagcagactgtatctgctttatcaactctctaatatattcctgattcacctctttagatcgaaaaaattgtgactgcctataaatagagatatgacttgtctggtagccttcataactcaatattggtggatttgtcagtccttgcttcatttctggctttgctgccttcccaagctcctcactgctgggtcctgtacatttgttctgtctgcaggcttggtctcattccaattcctcagccggtcccttctgaggcggcaaatacctcagggtctccagccacaggattggcttggccaattattgcatgtgaccgcccccacccccttttactggaatctttttcattgccaaatagactcacagtaaaataaatgtgcactggggcatactttttaatttttttggcagttcactctctaagaatgttgatttctcctcaagatctgctcacttttctacccaccagtacaggaataggatttgtactgctacctgctgcttcatctaattttcaagggccatcttgctacagtagctatgctggattttccttgagcacctccatccacaccacactctgtggggtcttcttggatgtggacagggtgtgtacctcccttaacagtccttgttgtagaggccccagtgtgcctcagacctaaggatccctatgtttcatgaatactaaatctcaaggcccatataaaacatgtcataatttatgtggtcctactgcattcttacttctttattgtcttcagtgttgcagcagtccacatgcaggagcaatgtgctgacatcccacagactgactgatctgcagcctttccttcgcctaactattcacaggggtcgcatcaggggtcacattctcccatctttcagtagcagcagtgattctcaaaatgcaatggtaaacatgagaagacaacctccctggaggggggtctatcagaatgtgcagtgggaacacacagacagcttgaaaggtctgctttgctgagattctgatacatcttcctaggaggatatccccattctcctgcctcctacagtgtgacacacagtccacaaaagagtaggctacccgacttgaaggtaagctttttgaactgtgtctggatcctcaatagcaccgtccctatttcagaccaggttttcactgcatctatgggggctgactgaaaggctagacccaccaccagcacttcctcccagaagcatgggagcaagtgggatcgagggtgtgtggaaagataaagtaattttccccttttgcctcacaggacctccagggtagaggaggaagatagaataggtggacagggtcaagtaatatgggaaagggtttcctaaaaactggtcttaaataacaatcttatcttgctatagtcaagaagtttcaaggcatctcatattctctcaggatcccaagtcctattattctctcaggatccaagtcctattttattctttttaagaatgaatttaatttaggttaatgttgcgggagagagtgagaggaaacaacagctgcccaatcacaaaggcaaccctgtgcctatcgctgatcactagaaaacatcagcctatttggcacatgagattctgatatcacaatagtaatgaattattgtttcctatggtatctatactaatgttgcatttttgggcaaaataaatacaaaataatgatgtttgtgatagtaacccatttctaggccttttaaagacaataagtaggccttgtgagatgtttatattatcagggtatgataatctttctgaggatctaaattcagccatcgacattctgtgtgatacaaaaaccttacacttagataactcaatcaggcaggttcctcaacactgctaagtcttcatgcctgggtattctaaattctagcaatgtgctcaggcaaagaattttagacttttgtcagaggttatgtagaatcaggatcaaatatgtacagtattttatttttaggaatttatcagatataatttggggtaagggcctacaatttaaattgggagatgatttggatctcacaaaacatgtgtttgaggaacaactggaggaaagcctggataaaaataattattaccctgaaacattacttataaatgcaaaacatgctgttttattctttaaaatagtcaactgataaatatttaagaggaagaaagcagtagctaacaccagtaatggagaatgagtggcctatgtgagcccacatgagggaatggaacagtgacactgggatgggcagagtagcctatgtctgtgtgtctggtctgtggcctgcactgtctgtgcaggggaagcaaagtgaaaaatcctcgtctgccgagggctcaccctctgtccaggagggcaaaagtatacaacccaaccaaatgagcacaacatagggctaaacagcaagccctcagttcaaaaaaagggatggaaatggctggacatagctgaaagtatttcacatttgttgtaaccgaattggattctgcaggatatgcaagtggacagcaagaaaacaggtggagacggatgtgtggctggcatcgggccactacaaaatctcagcctggtttgaaagcccatggtaaggaacactggcgaaacattgatctaagctggaactctagcaaactcagacagaaaataaaacaacaaagttgttcacaagatcaatctaaacttatattagtggaaattgtgatttgaaagaaaattccaaatgactctataggttaattgcaagagaagctttaaaaagtgttgcaatatttacacaaatgctatttatatatattaagagaatgagaaatttttattcctcattaataaaagaaaaaagggtgaagaattcagagcttactcttattctcacaagaatgaaacatatgtattttctagctaatttgtcatctattctttaattctgtattgaatttgtgctttgaccatttctcaatattaaaaagaaaaaaatcaataatatgaagtgatagaaaacactcagaaatatggctttaccaatgtaatcggaatctaaattaaagtggccctaaatttatgttatttgggtacttttcatgaagtaattactacctctgttgaatgttcagttgagccttgatattataccggaggaggaaaagaagggaggaagggaggaggaaaaagaaaaggactctttagagagatactattatgttaaccggacatatactggtatcttgacagagcatttcagtaatgagtatgctatttttatgtaccagatataaataagcttaaatccttagatatttatacttctgtaagtacagcattactacactaaaacacactattaaatatttttaaataaggcagttttctcagcggtcacaaactatatttacttttctatcttttgcatccattaaccataaaaatatattctgttacaaaaatatccttcagtaaactcaacagtagaaagctcgtctcagagtttcatatgatcaaaaccttatgaaatctcattattacagatggaaatctttttaaatcagagaaagagatgataaaatcaaattttcagagactactagaatatttcttctaagccctgacttcattatttcttcctgctacgcttttaccattaaagttattctttttattttattaaatttttgtttttgtttttgtagagacagggtttcactctgttgcccaggctggtcttgaactcctgggctcaagcaatcttctcgccttggcctcccaaagtgctgggattacaggcatgaaccaccatgcccaatccccacagtttttctttttagataaagaccacgacctaagaaagtaacaatgaaaatactaattctatccttgtcttcctcactcacaaaagacttaaagaaatcataaaatatctctgatctttttagatctgatcagtaggaagtagctatgatctttttaatagcgcccagttttacaaatgcaaaacctgattggagagatcatccaaggatgcctctataatttttctctgactcgccttttcctcctgggtggctgcttgaacagcaatccctcacaatctccttctccatttgcccgcgctccagaaatccaacaccaattaattagatttccactttcaaagcgaagaacaaaaccccatctcttcagggaccatgttaagatgagtcataccacaaactggggaaaaatcattaatattatattccataggtttttttataagtaattattattcgtgctttctcttagaacaaaagaaaaggtgaacagggaagaatctgatcctagaaatataagtgatttgaaaatacaaggaaaaaatatttattttttgaagcagctgtattaaattgctcattggcatgtacaggcataaatctgttatttatttatttgtttatttttagagacagcatcccactatgtcaccaggctggagtgcagtggctattcacaggtgtgatcatcacacactacagccttgaactcttggtcttaagcaatcctcctgactcagcctcctaagttgctgagattattggcaaatgccaccatgctcagctccatgcataaactgaaagtaaaattccagtcttctggtgagaacaataaattagaaactgatcctagcaaaaaatttatttttaaaaaagtacaattaaacatttttaaattatcaagtgatgttttaaaaaaaggcctttacataatcttctgaagtatcatttattaattttggtagcttacttaatctcatagtattaggtactcttaatcaattttttattaggcaactgaactgagattacaaattcagagagtctttccacaaagcattaccagaacagagttctatcccttcactggggtggcagtcatgctcaagggacagccacgtaattgttctaactccagcagcagcagtggcaaccactactgattacttagaaacctaaatgctattaaatgtctcccattatagggacagggtgacactgtcattatggtagaagttgatactcttgctttttccttttttggggatcatctgaagaggttgtagaaaacgcgcagaaattagtctatcttcaaaaagtcagaatccaaacaatgtcactcactctgtaataatgcatctactgagagataatccacagggtatgtacacatatatagagacattttaagactgcccatgtttacagatccctgatgtgtaaagacaattaagaatttaggttatctttctgtttggtcaagcctgaggagagttgtttttacagaagctgtattatttaaattagatagaatctctgactaaaatggaatctgatactttgtgtaggttttataattaattcctctgcttcaaagtgagtaaaatcactcacctagaaatctacgaatttttcagtagactgacgtcaaacacaagtctaattacctccacaacaaatttgaagattctaatgggaaaacatccacaatttctatgttttcctgcattaaggaactggatgtttcaggtgaagtgactgtcaaacccagcagcagtgagacctacgcagagcaaagaagtcactgaaacaatgatgggcagtttctgaccaagcactatagatgaaatattacaggaaaagttatgtagcatctccaaggttctagaaggtaaaatgagagaattatgcatctgcacccaactaaaattagaaaagctgccatatggctttgtgaagccagcagcacattcttattcattaggaagcattctgctaacataaaaacacaaggcccttcctgtgctctccaaatgtgtttatcttttcaacattaatgcactatatatcatcaagctgctgaagtctcctgccgtgcatattaaaagcgcgcagctgcactttctttagtagtgggaggaacctaagccgcaagttgcctccctctttttctgacattgagcttcttaacatcatgatttcccttcagcatgaagaaatagcaaaattaaccaatctgaaggccatctccacccagcaaaaccctcttactctctgctttagagaaagcaacatatttggcttcattttcatcaatggtataaggcatgactacttaagtagaaacaaaaatcatgtctcaagtttgaaatacacaggcctacttttaaaattaatgtactacagttaccaagagaaaggacagcaaccagaatagactttgagtattagacagaatatttaggctttgagtatagacagaatagactttaatagaaaatgcttttgttcatgggaattcactatcattccctctgctattgcccatacatattactatgtaatagcccacttcatatagtacctatcagtattgaatttactgaaaggtaaaatgggcagtggaaaatctttcatgataagccatgtcagtgaataacaatttgtccaaaatcttccttttatataatccaaattcctgcacctcacagttcatgtcctataggagcttaaatttaaagatcaactgcagaagaaaaaaaatacttaggcacacaataaacaatgtagacactgaaagaacccatggaaacatggcttcagaagtgcttcaagttagtgaactgaaagccaacaagtattaaatattatacatattactacatttattatggcagcattcattcattccctgatatgataatggtgcatctctatttgtatcttccacagcaatggagtactgagaggtgaaggcaaaataaaatataaaaactgctatttcagagtaaattctaatttattgggctccactcactaaagttttggaagttacctgaacaaggaaataaaggaatcataatttgcttagaaagttgaaaggtgaaattgagattagatgaaagaaggaaaaaaaatcaatgggtgtgaaagaaatgagaagtgaggtgaggctcgaagtcatcacttattcagaagattatgagtaagcctgtcaaaagaccaaattataaaaaagttctatttcttccaaatatgaatgtcaactcaaaagcaaggccaacaaagttacactgtaggagtacttaataaagtttctgataaatagcttaaaatatgaaaattatatttaaaaagttgtttataaaattctaagactttggtcttagttgtgcaacttttaaaatctcctaaatcacaattctgtttattagcgcagtaaacctcatctcccattattcctagcttatacaccatagcaatatttagtatctgtctccccccaaatgcatcacattctttcaagattttgagcattctctcagattgttccattggcacagatgcccttccaccccttctcttggaagatgccaccacagctccagaaagctcatgtcaacgaagttaggcccctgccgccgtgcttctgtgatgccctatgcccatccccatcttaacattcccctcaccattttgaaatgatctattttcatgtctgtcccttttcactacattgctggctccttggctgtaagaaatgactttttatttgctgcctggcacatagtgggcgctcaatgatgttgtgttaatactgaacacagtattcacagctgtgaatacagtttcacagctggagctaaaattaaattccatttagccagggctgaaatatcacaaatgtctcttcagaggtatctgtttggaagagctttaccatatacctaacatagtggaggttcattttaagactctgattttttatttttggagtcaaagtattaggtagagatgggatgagaaaaaaggtcagaccgtatttgctaagggcatcaagaataatagctcaggtggtcaggccaatgagaagaggatttggaagaaaagtcaccaaggctttctctacacctgagccacgaagtttaaaaaccccaaccagcctactttactagtccagattctcatctaggaagttacaacctactttacaaaaaaagtgatctgggtaacacagacatttttttcagtccttgggattttcccagccactcacagctcttaagaaaataaacctacccaagtggaggttgtacaaattgtcacatttgcctggggagccaggataaaagagcacttcatcaggtttcttgtccctcccacgcagagtgctgcgagaagccttggattctaaggataaggttaacagctgatagaggaaagccacctataaagcagcgctttataggtggctttataaagtgggattggccgaagggctaaaatccctggagaggctgccaaggttcttcctgtcttattcaactttgaatatccaatgactaaaataaagctgaacgccctaaagatggccaataaacgtgtagagaaagacagagggaaggatgaaggaaaggaaggggggctggttactttgtgctgtctcttctttctggctctgccaccaaccctcatttctatgaagcttgcaaggcttcacacccaggccgctgcttcaccttaatggtggctatctggaggggtgtctctcaaggcttcgaaaggactgaaaaccatcctagtacctgaccttcatttgtcttctggggccatatcttccatgcctaggaatcctccctgctcctcacttccttttcactgacatcttgctccccaatgcattttgttccacttctcagacctgcttgcatttctctccttgtgtttttctcccatctggttatcttttccttccagtttctctctacagacacaggatctgatgtcattctaaagagactgctacaactcatcatatgtagactcttctcctttcccctactgtgattctaacaatatcatagggaggttgaaattcccggtttcattttgcttactaccgtctattcccagttctctcattctagcatttgcttgagcaatcatgggaggacctcaccagtgtggtttttcaaaaagcaggtgttcctaatttaaagtacctaatgcaaaaagctgataatagaacacagaatcatccaatttagagcctaaaacattatgctaaatcatatcattgtagcagagaaagcaaagcagtgttaacaatgggagaactctgcataaatatacgcagcaccatggctctggccaagcaatgaaggcacagggagaatggggctgagaggacagcagactccagggagcaaaacaagaaagaccatgagaacaaaggaagtaactgtaaggcgagtgcaggctgcttgtggccagggcgcaagctctctgtggacagggtcatggggcacgtggtggggtggcgtggaggtggaacaactccagaggcaggctccagaaaagtttacaatctgacaccactcaaatctcccacaggcaaagatctctagtagccaagaatttgcttcagtcaaatcaactctctggaaagctgactgctaagacaaaaactaggtaatttctaagtgaacatttagggaggaaaataagtgggtatatgagaataggtctgtctagtctcaagtatttttttggcaatttgagcagttactacaggcagagtttaccatttcttgtgattctccaactgccattatttgttgtgtcattagtccttctctacatgtatgtttattttctacctggttcacaggatttttttttttaacctattagaaactacgtataggaatgcggccacctaacaatgaaaacgcacatacaaataataaacctaaatacatacacactctctcactctctctctctctttctccagagaaacccatcttggggaaaggagcccagatttatcctccaggatgtcaagaaaggatggtgtaaaaagtttataatcctgggtctcagttcacaacccagggactttctaaccattagaaggtctatgttcttcctaacagaacttctgtggggaaaactacataaagaataatatttatatcatatagaaacagattctgttcaaatgcttgaaacagcttaattttgaattcacatttttacatacaaagtgtatgtcctccctcctcactttcctcccctgaccagctaatctcagaatggtcccagtccttatgaactcggcactaccaaggcccctcagatcagggctgactgcagagggcaaggtgctgcgagggacaaagctgttatgaagtattcatcttctgcactaagatcatcagggccctcttccagaagagagctgttacctgggacaggtaaattctgcgaagtaaagtctggtaaaataaaggacctgatttgttctgaagatcaaaaatatgctactacaaaatttttaaaagcaaggtttgcatatgtaacaaataaacctgatatgtatttacagacaaatttacagtatgtcttattgtgtaacatgctcactgtattgagagtaagagatcaggtaaaacagtaggtgagaagaaagactaggaagcatttggaaaataattccaaagtagatcttcctaatttgtaaaaatgtgaattttctttattaacatcttcattaacacctaaattcaaaggacattctagaaaaagaggtcctgtcaaatatccattcaataattactgcatttcataatgacaacaggaagagctttaaatacatctttaaaatgaccctttaaataccttacagcataaattctctccaatttaagcaggcatggcagtgaatcatcaaccaaccttccacaactatttaaagcagtaggcaattaaaaagaatacaaggactggcatcactcagaaattgacatgcctcaaccaggcagcaggagaagcagtgagggccttagaaatggctggcacttccatgctgcaaagcccagcacaagtgtgaaagagaggtggttacaatttgcatgctgaggtcaaagtgacattaacaaaggccaaccaacatttacaatgtttcctaaatttggtatccagactaacctttctataaccaaatcctctccttttcttattttatttaattctgcagcaaattttgtaacctgaggggaaaaaatggtaatatcctcagtaatttagtaattccctgagattttatatcggttacgtgctctcaaatacaaggactgtttaagcaatcaaatccacttgcaagaaatcagaacaaatgtctatttaaagtctaacaattttccagtagatgttatggaaaagtttgagccacaacagacagatatacagactgtgagcaccatggctatggatggataagtcaaaaacgaaaaactctcagaaaattaattatgatcatccatataggccatagaacatatcacaattcagtatctaattataaatatgaaaaagacatggtaattaagttactccctatcaaattaactggtttaaattaccttaaaattagttttgttttacatatattaaccacaagagatgcttccccaccattctacaaccattcaaataatgaaataaaataaaatcctcataaaatttcttcttctttcaatttaattatcctacataagcttctagatgctaactaatttagtaatacactatcataagacttcagaaaagttctacccaatggcatttttcccccagtggcagtttgaaacaataagcttagcttcaatgcagatgcatgggttgaatccaagaaacctgtttttggaaatcctgcctgccaggtgatggcttacaggtgaggctgaagatgactgatgtgacagctgggcaggtccagttttcagagccatagcaagaacagaaggtagccttttttttgtagactgatagcctggacacgaggatgatggtgtactcatttcatatgtaattcacctgcttctcaaataaactgaatactgtcttagatttgctttttcaaaaacgcattgtgtgttgtttttaaattacatcaacggacagtgggcttcccagagaatggaatggtggcagtttgtcagctctgtattgccaaggaaaatatttggctgcatatagggtttcctgagagcaagttagtacacgacctcaatcttttccaagcttatcataatgccgtaaggctatgctgattcagcaaagcaataaataatcacttgcaaaatgccctgcttcacagggatgttatgagacttaataaaataatgcatgtgaagcactctgagctctacagaagaaaggcaggaagtaataatattattctgcatttataatgacaagcagtcttacaatggcaaaaatctaatagacctgttcacaaattacaaataaaaactagcttaaataatttaattgtacaacaaaaaaaacctgaaatcatttcagtctgaaaagtggaatgaacagacttcataaggctaagtcaaaatgaaaagaaatagacaagtttctactaaacagaaagattatattgctttgtgagagaatagaaatggaatcagaaacttacaagaaagaaaagtatattttattaaaattattttgtgacattgctgttatgaattaaatttagttatatttctatggctttcttactaataaattttaaatcaaagtcagtattaacagtaataaaatttcttcagttatcaatgataaaactgatttaactctcagtagaataaaacatgaatactataccaaatgtacattgtttctttttaacaaattaaaataatgctggattttctttctcttcttttctttctttcttccttttttgccaacagcatttgtcttatggatgggaaatgcctatttctttttcctccggacacgcccagccaaaggaacacgatgcattaaattccacttcatttggggtgtctctctaccagagctggccaggttgaagtggcattgctaggctcttaggtgccactgaatttactggatagtgacgggccttcttggttcagcagatgccattttctcaaggaaatctcagaatttcaggggatccaagctgtttaccctctgtgcttccacaacatgtccataatatcatttactgtatcatataaatcgtcttatttgatctagatctcagaactccctcaagattgtccagtctctgagccagaaattccatttttcatctgtgtatctctattcaccatgcaactgctgacccatgtagacaccatgtagacccaagtgacccacactctggagaaaacactgtttccctcaagtgggctgaacaggctgtacagcagcaacttcaagcacatgggacgaggaattttactctctaattttcatttgtaattttgttttagagaagtagtagtttatgttttcttttttaaaaatacatgatattagatggtggaaatgcaaagatgaaaaagacaagctctgcctcttatagggtttagggtgcactgccacggttaagccaagtgctgaaatggggttagtggattatcgtgattaaagtgttagggatttatgaacaaaagaaaaattaaatttgaaatttgtgaattcataagtattaaaaaggtttttctttatttagctagaagactccacttgtttggagagtataggaaacagcattgatctggatgctgaataaagaaagactctaattatctaagattttcactaagaatgctttcatcagagaatgaacatagcaaagctgattacttaactcaaaataaacttccatcaacacaccaggaacaatacatacacctcaggatgctaacagggcctaattagttctctgaagtataacagctcaaaaaaatttttggaaaataaaaatgtgaagattaataatctcttatattatcctctcaggataaatccaattgccaaggaaattagacttacaaatctcaaaaattcaggctaagaacataccctgcaggaataaaaagaaatctgttaatttttcaaaactaaacccagttaagtggtagacttagagaaaaacctacaatcatggaactacaaaagcatctatacaaagaggagttatactatctgtcctttctaaagaaactatgagtcactaagtcaggaatggaactaaataaaactcattggtgtttagatctttgctctcacgtatccgaatatggattgggagctcaattaaaaccttgatttccaaaaacagagagggtttagtagagtatatgaaagtacctcaggggctcttcagacgaattactataataaactatttataagaaggaaagtaaggcctggtgtgatggctcatgcctgtaattccagaactttgggaggctgaggcgggtggatcccctgaggtcaggagttcgagaccagcctggccaacatggcaaaaccctgtctctactaaaaatacaaaaaaaatttagctgggcgtggtggtagacgtctgtaatcccagctacttgggagggtgaagcaggagaattacttgaacccaggaggcagaggttgcagtaagctgagatcacctgggcgatggagtgagactctgtctccaaaaaaaaagtaaagtaaaagaaagttggaagaagatgaacttcaaatgactacattataaatgagaaaaatcaggggaatgggagtctaaaaatcaaggatcatttgtggaggatactttggtaagggagctaaaagcagtggacctaacagcaagaaaactaattgagaagctggtaggtacatgactttgacacaagaatatctgatactgcaggtctttacaaacactgataccaggtccataaactttcagcttcatcatgaatgacttctcccactctcactccaagggtcatttcaaaaaaagttaaattgttcatcatttgtgtgctttaaaaaaatatgaaaatagccttattgtgtcctataggcaaggaatgggcagagagtatattcttacaattctgagtgactactataatgaatagacagaaatcaaagataaaacttctatcaatttgaagccactgaagtagtaaacaaaaactcaaatgtccacctggttagccaggtaatgtacaatcacttcagtactgaaataatgccagtcaaaagacagacagggtggatttctatccactcctcaagctgcacacatagcctcacccacatttcctagtccccccacttagaatatcctctggcatagggagctcctagaaaattagactgagttttcctctgaagagatgaaccttacattaattcttcatgtaataaaagactcatcatttacctatacagtggcctttgtctctaagaaaaggaggaagagagagggaggaagagagagggagggagagggagaaagagacatacacaaatgggatatgtttttatagaagtgagagagacccatgagaatctcctgtgagattaaaagagataaactgaggggtttctaaagactgaaaaggccagggacggtggctcatgcctgtaatcccagaactttgggaggccgaagtgggtggatcacctgagctcaggagtttgagaccagcctggccaacatggcgaaaccccatctctactaaaaatacaaaaattagctggccatggtggaaggcgcctgtaatcccagttacttggggaggctgaggcaggagaaccgcttgaacctgggaggcagaggctgcagtgagctgagatcgtgccactgcactccagcctgggcgagagagtgagaatccgtctcaaaaaacaaaaataaaaataaaaacaaaaaataaaagactgaagacaacatgggagagttgaaaccaagctttacatgtatttcaaagaatacatttccaattgtatctgtacgtggaataccatttagtaggagtttttaagatttgctgaaagtttgtgacttttcccttattttactttgttattacagtaacaatccttactccccaaagagttgagcatttgcttcagggacaactgtacataaaaacctgaattttgtgctacagcggaccagaggaggggaaaaaaaagaaataaactgatggctagaggaagacagcagaatgggaagcaggtgacttataaagtaaaggaaggaactttgccagagtcttagaagagttactgtgctagcctgagcccttagtagctcctggcttccagcctgtgcatacacctgtgactggacaaccccaccacccacgggcctgcccctctgctcctaagagtcttgcctggtatttcatggcagtggaggcctgcaaagggaggagccaggacactaccagggcagaaaggaaggaagaggcaaccatgctccaggcttctctggaaatccagaacagatcttcccaggaaatatatggatgtgttgatcaattagcctctatagtatccctccttgtaataaacattgggtcagtggttcccaccttttggggtaagagggctctttttaacatcaataaaaatggagacctggccaagaacggtggctcatgcctgtaatcccagcactttgggaggcggaggcgggcagatcacgagctcaggagttcgagaccagcctgaccaacatggtgaaaactcatcactactaaaaatacgaaaattagccgggcatggtggcgcatgtctgtaatcccagctactcaggaggctgaggcaggagaattgcttgaacctgggaggcagaggttgcagtgagccgagattgcaccactgcactccagcctgggcgacagagcgagactctattaaaaaaaaaaaaaaaaaaaaaaatggagacccataggacaatatcatacttgaaaatgatatataacatgaagaacaggttacagtaagttcagtaatgcttctaaaagaactatctatcattacaccatcagagctatatgcaccacatagattaagaacttctctcgttagatgcaatattgataacaataggccttatggagctggtccaataatctaatcaccaaaatttgcattggtttgatagaaaataccctccattctgaacaattaacttatagttaaatctcagaaaaagaaaaggtttaaaggttaaaaggtctctttctttcttaagaaagcatggaagtgagggaaaaaaaagactcccaaatgcaatcacacaaggtatatacttccatattatctaagagacaaaaatatgtaacaacttctgatctttgacaattcagctatctaacaatattccaaataaaatgtactatgtgtaattttttcccctcatctgacataaaggatctacaaattgaagatggtctaccagaggaaaaaagcttttaagaagttgagtttaatcatgtcaatcccaaaagagcttgcttcttttcctcttctgtttcctcccatcagatgtaacaaaatgaatacaccacttggaatcttacagaatggtggtatgcgcatgcccatctaatgtagacaggcttaaataagaaatcaccactgctctgagaaccacttcgggcctaaagaaatagaggatacaggctccccaaaacgacctcagagttctgtaatgtttgctatctggtgttaactggcagtggaaaggcatctcagtgatgaatgtacgggaagcagcaccacgctgatattggcattatttattttactcttcttcctcagacaaaatttcttatttccaaaaaagacagctccaactggactctaaatctattacagatatcaaggttctaacactggaagagcagaatccaagtccgttttaaatgaacaacttttctctgctgtgtattttttctatgtgactatgttgaattggggtttccttttgtacaaaacaacagaaatgagaaacataggcaaagatgcaatttcatatctaaaattttaagtgtaaatatttgaaatctaataaattcattttctaggtggaagttcagattttacattcttttccagaacacaagttaaaacacactgcatacggtcttgtatatagctaagcactcttggccctcagattacattccttcatttttgatcaatgatgtaatgaatactggggtggtcacagtgactatctgcaaagtctgttttgctcccaacatacttcccaaaatgggagagaacaccttaacaaggccagtgttgtttatctagaggttacatcgcacaagtgaagatggacagatcttatgatggacaacagaacattcactctgacagaaaaattcctcatctgctcacataggggtacaaaatgaatgttctaaaacaagcctggtatccaatattctggctaaataccaagaagtcttttttggtctagagagcaactttctgtttttctgggctcttttatcttctttttttttttttttttttttcctgacaggaaaagctgacctgccttgaaagtgtgcatcatcttctgaaatagggatctgcaaaaaatattcttcctagtaaactaaaactcggtgtctctgtgtttcaaataacagctgataccatgcttacccaattgactcctaacaaccttcttccaaatggcagacaaagccaagagtaaacagctgggtaacaggtttaattgtctttccacttcactgggagacagtggatgtggagctaggtagagatctagacttcaatgctagtcctaccacttattagctgtgtgactctagagaagtctggagtctagacccaaacctaggttcttcttctgtaaaatggagataataactcaacttacctacagggagtgttgcaaggctgaaatgagatgacgtatgaaagagcagtgcctggcaccaagtcagcactctgtatgtgtgaattctcatttcactgtagtagctgacccttttgcttttgacagagtatatgtgacagactttgctagtacataaggatggatctgcattttgtagggcctggagcttaattacagggaagggtgtctctttaagagtaaaaaattgagtataaaagtgaatatttacatagaatgagaaaagagctgtaaacactagagtgatgaacaagattcaaatttcttcttctgagaactctgtagataataatctgaaatgcttctgaagaagtgcttcctgattgaaacgtggggtcctatctagaacactctatagctcctggcacatataggacccatacaagtaaggggtcctgaagcttaagctttgtcagcctagagggaattctgcctctgaaaatgtacaatataaaattttcacttaattatttttatgtcattcatctggcttttggcttgtaatattaattacatcttatgttctatattttatctttacaagcagattgttagaccaaagttcttgatatttacaagtcccttaaatataaatggtcatacaggaatcactgtttcatctgatgatccccggtggctacagaaatcccacgttccattgcatcctgctacaccgcttacaactttcttcccaatagctgcttcaccacattcctttaagagaccaattcattcccaccccaaacaccgtgtggtcacatcttcttgtgctccacaccacgccaaactacagccacctgtgagaagagtggcccagaaggaacagcattataggggacatcattcattgaaccccatattttatgttccttttaagacaacagaaaggcatgagtgctctgaatacagagcagcagtattcagatagtgttcatggccatgaggaattctcgcatctggaggaggaagaagaataataacctttcctggctgggcacggtggctcacgcctgtaatcccagcatgttgggaggccaaggcaggcagatcacgaggtcaggagttcgagaccagcctggacaacatggtgaaaccccgtctccactaaagatacaaaaattagctgggcatagtggtgcacgtctgtaatctcagctacttgggaggctgaggcacgagaatcacttgaacctgggaggcggaggttgcagtgagctgagatcacaccattgcactccagcctgggcaacagggctagactgtgtctcaaaaaaataaaaataaaaataaaaaataacctttccttttttctcttcacctatgatggatatacatcggcgatgaaagcctggttagaaatgcttagatgtgcagaacatacaggaccctggattagagacagttatgacctaaaggtgctgtttgctatagtgcttccttaacctataatgcctcagaggccttgactacagcctacataagatttaaggtttttaatgaaaccacatctaactcaaattatcaaaatctcttttctgaacaatatgtgttaaaactacctctaaaaaactatctctaaagacacagcaataactattacaaatctttatttttattttgaatgtgttgcttttggaatttctctgtggaacaacattttctgtcttaataaacaaaggcaaagttgaagacatgacaaccattctcaggtaggtaatggaatgcggaggtgaaagatcacaggctgcagaataaccagactgcgctttgggttctagtttgtcactgactagttttaaggcctcaaccttactactgtttttgtgtatcagtttccttatctatgaaacataggcaataattccaatcctgaggcagtctcacagatctattctatggacagagtgtagaatgcagtaggcgtctaaatgggatgaggtagctgaaaacagtatgtatgaatgcatttacatgacattctcttaacgctgctaaagaaaaaagtatagttaagtagccctggatacaaggaattttgattcttagtattagactttatttaaacattacccatatggtgaacttcaatatactcccggagatcaaaaaacgttttacttcctaccttctcttatcccactttcctttatatcactatatatctacatcaacctatcaatcaatcaatcatagtacttactaatttgctattattacttcttctttttcttagatccaggtatcagctttattacctactaaatgcaggcacaggccaagctggacccccactggcctcccttgagggtgggtccctacgtcagggagggtgagggacatatgctgaggagcagctattctaaaaaagctttaacgatttctttgttgtctgcacagcctgagagccccacaacgacagggacagtgctttacaggtctttatattcctgatggctagcacagtgtttgaacatagaagatatctggccaatgtgtcctgaacgtaagtatgaattaataagaaatcaccatgtttaaatataattatggcatattccctggtcatttggtcatttccagaccatatcattggaatttattttaaactgacacagcagttaatgaaagtccttaaatgtgttctttttcttcattattctattcataccttcttaaagcatctgaagaaaaccttggatttcttgctgctttcacattttctctaaaagtttttttttttttttaaagacaaggcttttctctgtcacccaggctagagtgcattggctcaagtgatcctcccagctcagcctcttgagtagctagaactacaggcacacaccaccatgcccatttaatttttttttattttttgtagggacaggatctcactacgttgcccaggctggtctcaaactcctggcctcaagagatcctcctgccttggcctcccaaagtgttggaataacaggtgtgagtaatggcatctggctttttgttcattttgtataaatgcttattaagtatctcttatgtacaagacaggtaaaagggtataaaaattattaagataaggttcctccacaaaagagctgtcgtggtaatggtaatagggagttttttgtgttttgttgttgttgttttcagtttaaactacactacaagccaaaatgatgtatacatttgatctaaaagtggcacacaagctgtgcagttatgagttaaagagtaattaaggctggaggtctgcctagaagtacgatggccagaaagataagagcaggagacagcctggaaagtacaatgggaccagccagcaaagggccttgaataccatgggaaggcattttccttcgtcctgcaggcagggagactcactggaggctcaggagttacacagccaatgtatttttagaaagttaatggtgatagcagcggggatggattatagaaggtaaagaagcagagatgagttaaggtgagaaaagatgtcttaaattagagtgctgaaaataaacatgggaaaaaagggttatatagcacagaatacagtgaggaactgacagagctgactaaattggctgattgtggggaaggaagaggtaaaagagaaggtggctggaactgaggtttctagcctcggtaaggacaaaacaggtgatcagcgcatggtggttacacagactgagatagagcacagaaaaaaggatgaggcagtcttttcagaaggcagaggagaaaacgggtttggtttgagagtatcaatttaaggcacctgtggaacacccctgtggatgtctaatggtagctggcaatctggacggacaatgaaactgtaagacgggggctgtggggagggactcaccgagtatctgtgcaatgaaagatgagggaaaggtcaagggcagatttaccttgacagtcagcacaaatacaagcaatagttaaaactcattaaagagcgaattttatttgagaagaagaaagggccaaggtttagatgaggaaaaaaagccagtgagtgaggatgaatgtggtacagctcaaaagtagaaaggggtgaggtgcagtggctcatgcctgtaattccagcactttgggaggctgaggtgggaggatcacctgaggtcaggagttcgaggccagcctggccaacatgatgaaaccttgtctctactaaaaatacaaaaaaaattacctgggtgtggtggtgggtgcctgtagtcccagctactcaggaggctgaggcaggagaattgcttgaacccaggaggtggaggttgcagaaagccaagattgcgccactgcactctagcctgggttgtcagagtgagactccatctcaaaaaaaaaaaaaaaaaaaagtagagagggatggtcaacagagacagctaccagagaagctaggcaggcagatgggaagaagagctgccacctctgatcaacgggagtcgctgcagacagtccagggagcagtgaggggcacacaggccagagtttagctgctgaacagtaaacaggagtgtaacttccttcattttgtaagaaatttggcaataaagagaagaagaacgagcaaacagtatggtgacaagaaaaccatcataaggaggcagaactcagatctttcttggtcccaggccacatcctgccatctccctattcactcctctgttagctgtaggctaattacatccattgacagccaactaggccagaatttgctaaaagaaacatctttaatactcacgctatcaggatttttcgtacctctatataatgtatacagtcagccttctgtatccatgggttctgcattggtggattcaaccaaccacagattgaaaatattcaggaaaagatggatggtctgtaccaaacatgaacaagcttttctttttccccccttgtcattattccctaaacaatacactataacaactatgtatatagcatttatattgttttacatattatataataagtaatctacagatgatttaaagtaaacaggaggatgtgcataggttatacacaaatactataccactttatatcagggacataagcatccaaggattttggtatccatgggggtcctggaaccaatcccccatggattcagaggggtgactgcataaaatatgtatatttatttataaggtacacgtatgtacctctgttagaatgaacatcaaatattattggagttcaatattatgggtcctggtttatctattcatttctagctgaaaggcaagagaccaaccaccttccatgaagcccaagcaagatcacttcctaaggcatacagcattactgccttactctagggatggattttgcactgtaatttactgatctgtggcctgtctctcctactgctcaactccagctccatgaagaaggcattcattaagggtttcctgactgacaaaatcattgtgtaattctgactcgccactacctatccctagtcaggtgacacaattgaaggaacaataattgctacaacatggataaagcttaaggacattacactaagtgaaatgagccagtcacagaagggcaaatattacatgattctacttacacaaggtaactataatagtcaaattcatagaagatgaacagtagtgatggttacacaaaaatgtgaatgtaaggccaggtgtggtggtgcatgcctgtaatcatcccagcactttgggaggtcgaggtgggaggactgcttcagctcaggagttcaaggccaacctgtgcaacatagcgagaactcaacactaccaaaaaagtcaaatgtggtgttgtacacctgtggtcctagctacttgggaggctgaggtgggagaatcacttgagcccaggaagtcaaggggctgcggtgagccacgattacactactgcactccagcctgggtaacagggtgagactgtgtctcaaaaaaaaaaaaaaaaaaaaaaagtaaagtgaatttacttaatgccactgaactgcacatttaaagatggtaaattttatattatgaatatttaccacaacaaaaaaggtcaaattaaaatcaattctcaggttaaaggataattggtatttagagtctttaaatcaataagtattacaagcagaactgcaattcttgtaattttgtgaagtatcctctacagtcacattcacagaaaatctcttaacaaaatatgaaccagaatctgacatgctgataaacacacctctggagtaaaagctggactagcaatcataatctccaagtccagaactgcaggtcaactttttagcagactttgcactcatgacaacacctaagctgtaagaggctccatttcttacctataaagctgaggtgaagaacactattactgttgccccggagttattaccttacaaatctcagggatggggatgataagaggataaaaacacaagctcctacactgattaccagggataaatgactcagtaattaacaaaaggtgaacattttgtaagaagaaatgaactaaaatatttcagagtgagcagcagtaataagaggaggaaagaactggaagtgagtgcctctattctgcccatgcccaaactacagatagaaggacagccattacacttcttctttccctgtaacctgtataggaagtctaacgtagcaaaaagcttcagcgcaagaaatactctttagggggacatgagaaacgactgaaatgaggcaaaatgtccagaaaggagatgtcaatgccatggtggttttctctcattctcctattgacttctaatctgcctcaaagaatcctccttcctgtaccttagaatctccccgctcccattttcttggcctatgatcatgtttagtgccctagattattcagtgataaatattatgatacttgactatagaaggcattctgtgatgcaatatagtattagataattattcttttcaaaatatctccttggaaaagatgttcaacatcactattcagcaggaaaatgcaaatgaaaaccacaatgagatatcacctcacacctattaaggacagccactatcaaaaccacccccagagagtaagtgttggtgagagtatgggaaaatggaaagtcttgcacactggtggtggaattgtaaaatgatgcatccactatagaagacactatggaggttccctgaaaatttaaatgcagaattaccatgtataagccagtaatctcacttctgggtatatacccaaaagaattgaaaacaggatctcaaagagatatttgcatccccatgttaattgcagtattttattcataacagccaagatatggaagcaatctatatgtacatcaatggataaatgaataaagaaaatgtggtatataacacagtagaatcttattcaggcttaaaaaaagaaggaaatccagtcacatgccacaaaatggatgaaccttgaggacattaagccatgtgaaagaaccccaatcacaaaaagacaaatactgccttgttttattcatataaggtatccgaagtagtcaaactagcagaactagaaactagaatggtgattgtcaggggcagggaaacagagttgctgtttactgggaacagagttttactcatgcaagatgaaattctagagatccactgtacaacaatgtgcatatagttaacaatattgtaatttacacctaaaaattggtaagagagtcaatttactttatgtgcttatttactaccccacccacaaattcaccaaccaaaaaaaagtctccttggaaggaccaatgaaaatagttgcaagggctgggcgcggtagcttatgcctataatcccaggactttgggaggctgaggtggccggatcacgaggtcaagagatcaagtggtggctcatgcctgtaatcccagcactttgggaggctgaggcaggtggatcacgaggtcaaaagatcgagaccattctggccaacacggtgaaaccccgtctcaactaaaaatataaaaattagctgggcatgatggcatgtgcctgtagtcccagctaatcaggaggctgacgcagaagaatcacttgaacctgggaggcagaggttgcagtgagccgagatcgcaccactgcactccaggctggtgatagaacaagactctgtctcaaaaaaaaaaagaaaaaagaaagaggaaatagttgcatgtgtaatttattactgtataatccatatcagtctgaaaatacgtaagtctaaagtccataaaattagtcacagttccctctcccttcttctaccagtacaacagatttttaaaataggatcgttcttattgatttgtttttaaaaaaacaaacccaaaacaaacacccatgaaaaatgtactttactataatcccagctacttaagaggctgaggtgggaggatcacttgaactcagaagtttgaatcaaacctgggcaacattgcaagacctcaactgaaaaaaaaaagaaataagaaagaaagaaacagaaaaacctactttaaacctaagctaaccagtgaatgacaataataaacagtggtatttgtgctcttatatcttttgtttatttctatgtttaaactcttctccctaccacagcacaaatatttaattcatttctcaaaaattggcatcattcttcaaactaaaagaatgaattaaatgtaaacatcagctcacagaaatttaaatgtactcggcaaattcttacatgagttatttcaaaaccaatatatctaatatctgcgcagcactaacataaaatgtgaatgtgcgttctatattatatattctagtctaaaacaatatgtctatttaaaacattagagaaaatattccatggtaattaaagttcctaataaaaaattataaaatacttcttttcataggattcttttttttttttaagatgaggtctcgctctatcacccatgagtgcagtggtgcaatcttggctcaccgcaacctctgcttcccgggttcaagcgattcttctgcctcagcctcctgagtagctgggattacaggcgtgtgccaccatgccaggctaatttttgtatttttagtagagacggggtttcaccatgttggccaggatagtctcgaactcctgacctcaagtgatccgcctgcctcagcctcccaaagtgctgggattacaggcataagccaccatgaccggcgaataggatttcaaaatatattctagtcgacaagctgtgaggattcttcatccttacaaaaacaaacagggctccagctatgcttatcagaatctaagagagttaacagttcaccaccacttgttttataaagatgttaatgcactatcaggaggcaaacaaaaatattgtaaataatatttgtcacaagataggttgtaatctgtaatccttgtgcaaggatgggaatgtattcactcagttactataatacaaatgttatgttcttaaatttagggcagtattttctcctgatataaaaccattacacaaggctgaataaaggccaggaatcagaaaaatccaacaaatatttattttacataaactaagaacaaacatgatactcaaaaccgctgcaggtggctgggtgcggtggctcacgcctgtaatcccagcacttagggaggacaaggagggcagatcacctgagctcaggagttcaagaccagcctgggcaacatggcgaaaccctgtctctactaaaaatacaaaaattagccaggcatggtggtgcatgactgtagtggtgcacacctataatcccagctactcaggaggatgaggcacaagaatcgcttgaacccgggaggcagaggttgcagtgagcggagatcgtaccattgcactctggcccggaagacagagcaagaccttgtctcaaaaaaagaagtgctgcaggtccaagggttaggtagataatacaacctctgccatcaagaaatctgtcattcagtgggtgaagagaaagtgaagtacctaaaacactaaacaaacactaaacagagtaagatcagacagtaccagagatgtcaaaggagatgaattcatatttgtttggagattagaaagtgttttgtgaaaaaaaaagcagtgtttgagataggccttgaagaatgaacagtaggaatgtaatgggaatagacagaaacaggaaaagcagtattttggatagggaggaaagaatacaaataatcacaccaaagtgaaaaagcacaagtatgtgaagtatgtgtcagcaataataagtagtctagggtaatgggctttgggtatacgtactgatgaaatgagccacaagaatacagtagtaggccaaactggtcagacccgaggtcttggtgaagcccccttgccactggaccttctactatcatccacccagattccctgtcactatacactacaaacgcagaatagctgtgatactccatcaggatggcctactaaaggtgagcagatgtcaaccagctgagaggggaaaaaaaaagaggcattcccaaacagaagacccagaaggaggaaaccacaacgtgagagcctgagccagtgtatgtcatggggaagagatgcaagtgcaaaggaggttgtcggttggagcaagggagaatggcaggactggagacaaatcacaggggtactagtcttctatggtgagggttcttcttttggactttgtcatagactccgctagtagtcacgaagtcggggcaaatgatcaacctggctccctcaaggaggatcttaaggagtacctttagcagattcttgtataggaatggccaagtattactcccctgggcacaatggcagatactatgccccagcaatcaaagtggcaggagcaggtagcatactgattcacctcccccaccctctgacaagtacaagagagggctgagcagccaggaaacatgtgggcactcttcactaaagctggggtgggagtaggacagaaggtaaggactggcagctagtgggctcagcccaagggctcttatctacaaatgtgcccgcagtgtcacaatatgactctgcattaagtcattagtgacaatgtcataaggaactataaactaagatatttaagaatttctctatcttggtgtttgaacctgcaagtgggtacttctgagtgtactttccatattcctctctctgtgtccagctctgtcattgtgagtctctctcactgtctttcacctctgtcatttccccctcttcatttcctcctgctccttctaagtctatttaaattataaaaataaatgaaagcttatttataaaacaaaatttatttcttattgatgaatgagaaattttatagttttccagcatttgttttaacttcattttttcttgttgtttcattagttatgcacctctccccctctagatttagaatttttaaaaatccaaattatctcccattccaaatatagagtatctctagaatctggagaggatggtagatgacttcaagccagctctgctgaagatggttagaggtctctcatttaatgttaccctctccaaattccaatattgcttactgtactgggcttactactctcctatctagctctgacttgcccttttcagcctcaaatccaaccaagtgctcccatacatcttattctacagtctgacccggcacacaccacatgccactgagcactcaggctcctctatttcctgtgtggagtgcctctcctcacgcccagccccgacttttttacctattaaaatcttacttttacagcaagacccagttcaagtttattgtcctcctcgaagcctgtgccagcttctttaataatcaacaggcttctttaataatcacattcctttccattgttccctacagttccacagctagttgtctgaaagctgattttcccccaaatgagtgaaagctccaagaaaaagaatcatgtacttactgattgctggatttcccctggcaaataaccatacgttttatatatagtatatactcaatacaaaatttattgaatgaatatttactcttgaatgaaagcaatacatacagtattgatgtatgattagtgtcatacattaatgacagaattaatttcttttcatacaagtacaaggtgatcaagaaaacaagggatgtctactttctatcagagtgtgatagccggcttgggtcttgaagtgagagctcacatcataaatcctaaagcattataacacattcaattatttaaatcctctttatctgaaagctgttaaacaaaaaacttccatgtacttaagaaataaaataaggggatcctaggaggaaatgagaatagaaattccatccctgctcactaattttaaggatttcattagccatataagccattaagccacatgaaaatgtgcgaaaatgaattatatgtagttcagtggaaaaatagttaatcttcattaaaaactgcagtattggtggggtgtggtggctcatgcctgtaatcccagcactctgggaggccaaggcgggtggatcaccttaggttaggagtttgagaccagcctgaccaacatggtgaaaccctgtctctactaaaaatacaaaaattagccaggcatggtggtgggcactgtaatcccagctactcgggaggctgaggcagaagaactgcttgaacctgggaggcagaggttgcagtgaactgagatggcgccactgaactccagcctgggtgacagagcctgactccacctcaaaaaaaaaaaaaaaaaaaaaaaagaagaagaagaagaagaaaagaaaagcaattgaaaatgaatagtgctacttcagcgaatgcatcaacaataaaaaagtgaaacagctggacgtggtgactcatgcctataatcacagcactttgggaggccaagtgggaggatctcttgagcttaagagttcgagaccagcctgggccacctagtgagatcccatctctgaaaataaaaaaataaaataaaataaatataagaaagtgaaatagcctttttgctgatatgcacaaagtttcagttgtctggacagaagatcaagccagccacaagattcccttaaatgagagcctaattgagagcaaggccctctcaattctatgagaagatgcagaagaaaattctatgagaagatgcagaagatattttcaattctatgagaagatgcagaagaaaagtttaaagctagcaaaggtgagttcataaagtttaaggaaaaaaatcctccataatataaaaatataaggtgaagcagcatgtgctgatggagaagctgtagcaagttatccagaaggtctggctaagatcattaatgaaggtggttacactaagcaatagattttcaatgtagacaaaaaaaccttctgttggaagaagcagccatctaggactttcatagctagaggagagaagtcaacgcctcatttcgaagcttgaaaggacaaactgactcttctgttaaggggctgatgcagctggtgacttgaagtaaatgttcacttcccattctgaaaattctagggctcttcataagaataatgctaaatctactctgcctgtgccctgaaataacaaagactgaatgtcagcacatttgtttatagtatggtttactgactattttaagcccattgttgagatgtactgcttagaaaaagattcctttcaaaatattactgctcattggcaatggacccagtcacccaagagctgtgatgaagatgtacaaggccaaaaatgtttgttttcatgcctgctaactaacacagtatctatgctatagccatgtttcaaggtgtacttaagaaatacactttgtaagggtgtatctgccacaggcagtgattcttctgatagatctgggcaaagtacaaagaaaaatattctggaaaggaatcaccattctagatgccatgaagaacattcatgattccatgggaggaggtcaaaatatcaacattaacaggaatttggaagaagctgattctaaccctcatggatgacttggagggattcctgacttcagtggaggaagtaactctagatgcagtggaaataacaagagaactggaattagaagtgaagtccaagatgtgactgaattgctgcaatctcatgatcaaacttgaacaaacgaggagttgctttttgcggataaacaaagaaaatggtttcttgagatggaatcaactcctggtaaagatgctgtgaacactgttgaaatgacaacaaaggatttagaatattccataaacttagttgataaggcaggaacagggtttgagaggactgattccaattttgaaagttctactgtgggtataatgccatcaaacagcattgcatggtacagagaaatctttcatgaaagtaagagtccatcagtatgacaaacttcactgttatcttactttaagaaatcgttatagccaccccagcctttagcaactcccaccctgatcagtcagcagccatcaacattgaggcaagaccctcccaccagcaaagagattagaacttgttgacgaggctcatatgcttgttatagcactttctagcattaaggtatttttaagttaaaatgtattaattttttaaagaagtaataccattgtacgcttaatagactacagtacagtgaagtataacttttatacaccctggaaaaacaaaaaattcatgtcacttgctttattttatattcgctttatggtgcggatctggaactgaacctgcagtatctctgaggtatgcctgtgcttactatttttctgtggaatagaagcaatattagcctcccagttagggaaaatggttatttgctatctgtttccatgactcctgtttctaagttatagaagagagaagttctaaacatttatgactatcataccaaatataaagaaatatcctacttcagtatcagaaagctgtgatgacagtgcagattccagacccagactgccctattctttcgcttaatggctgtgtgactttgccaggctacttaaccactctgtgtctcaggttcccctcctgccaagggggaaaacaatacgcctattccatggtttgttttgagtacgaaataggttatcaaatctgagcactttaaaaactgcctgacacacagtaagaactatttagtcttagctagtattaaaaattctccaagattatttagccaacagaagatctaacttaattactaagtaactaacttagctaataactaaggattatgaatgtcggccaaaaaaaaccccaccaacatgtacggaattctctatttgatggcagtcacactattagcatcaaactcttgtgtgtacttgctctgtttctacaaagtccattccacagttaatgctcttggagggctagcgtttatgaaacacgggtctcataaagcgctacgtacaacagaatgcttattaatttaactagctggtaatttcccctccaaatttccatcctttaggccatttaaaaatccttttcttctctccctttatttataaagcatataaaagttgagaagtaactgacagagcacagacttgagggaaagagccctccatgcctggctgacacgtcatagcttctgacactggagcagggttccataaagatgagcccagctttcctcattgtgtattctttagtatggcccctcatgcaacccagtttaacttctctaggataaataggcaggtttattacataatgggcatgttctcctgagctcccaaatgcattttattcacgctgacaactatgactgaaatacaaattaagtctggataatggtgtaaagatggtagttggattttatttatgctgattggtcaggggatcagttggggttgggggaagacagagttagagagaaaggctttggcctgacttatgtgttgttcttactggctgtcagatgctgagaaaaatcaaactggcccaaacagagctgctgatggagtggtacgcatgggttgcacagattttctggcaccagaaaattcttttactttctacaaataggtcaggcacagtggctcatgcctgtaatcccagcactttgggaggccgaggcaggcagatcatgaggtcaggagttcgagaccagcctggccaacatggtgaaaccccttctctattaaaaatacaaaaattagctggacgtggtggcgcatgcctgtaatcccagctactcgggaggctgaggcaggagaatcgcttgaacccagaaggtggaggttgcagtgagctgagatcgcgccactgcactccagcctgggcaacagagcaagactccaaaaaaaaaaagaaaaaaaaagaaaaaacagcatctttctgcttaagtaggaatgaaaactactgaacatctactatgacaggtgtttactgaatttacatggctcatgatatcttcaacagctatgtaacctaggtattgttagcactaaactctatatgaggcaactgagtctcagagataagataatttgcccaggttcaaaaagctcctaaatggaccaggattcatacctagctcctgtctgattcaattctgctctttttaaaaaacaaattattaaacaaagactattcggaaaatatcagagtagttgagaacttaaaaatacatttatgcttttcgttttttcatttggtatttaagttttgcttccctttacaaaacacgttgcttttcaaattagcaggaacattattagaagaataagacgtgacagggtatatattgctgcttcttgggtggttgtggtatgcagccctatgattaaaactatggttaaggtatggcgcagtcccagcatgacacatctgaacatgttttatggtttgaagggggaattaccaaggttttgcaaactttaaaaacttgtgcaagaccttctttgtggcgcatatatatatatatatatatatatatatatatatttgttttgaaatgtagaagtactacctaaacatgcagtgttctcaaaactgaatcattcataatccttagaaacctaaaacaagaagcttaatgatttctttactgtaatgacatcagcaactagaaacacagcaacttcaaggcactggttaataactttaaccaattatttctcctaagagttctaggaatattattttatccctttgctgacactaaaatatgaagatacaaaattgaggtttaaactgagtttttgataactagtgaaccccaaagggaaaagaaagacgagtgatgaaggggactgaaatgggcactgggagaagaaacccactggatgttaaaggtcatggagaaatcaggaaataaagactgatttgcagagtgggctggtgttagaaactgtgttgtgaatgctatatgtatatttttatgttcttagaagacagaactatacttgtaaaactattttatacagaatttagctcaacagtataggtatgaaatggaaaacgctaagatgatatgctaataggtagctaggatttgtgacagataagagcagacagtttcaggctcatgtattataaagacaaagatattatttttatgaaatatgccttttttgaatattatataaaaggcagattttaaaaatttgaactctaagaggatgcattcaaaaacagattacaggtcaggcacggtggctcacgcctgtaatcccagccctttgggaggccgaggcaggagggttgcttgaggtcaggagttccagaccagcctggcaaacacggtgaaaccctgtttttactaaaaatactaaaaaattagcagggcatggtggcaggcacctgtaatcccagctactcgggaggctgaggcaggagaatcgcttgaaccgaggaggcagaggttgcagtgagttgaggatcacaccactgcaccccagcctgggcgatagagtgagactgtctcaaaaaaaacaccaaaaaaaaaaaaaaaaaaccacaccagattacaaaagataataatctccccaggcctaaagaaaagcagtacacagatacttcaagagcatatattggccctgggcaccaaaacgttgttcatacatgccgaataaagatttatttttggcaccacaaagtcaaatgtgttcttaaaaacattattttcttgatatttttctgtaggcataaatatcaaagaaaagaatcataaaattatctcagaaaaaaagaaaaccataggaagagagctgtcatgttctatgtttcaagttcacagatggatttcttactggaggttagagactttcaaatctcttgtcattcaggatatgaaattctaatctagtgtcatggccagttgaggctcagattaatcaaatatgctgactagctgaaataggaggtgcttcacttccttacttctggtttacatctcaatctggctgctacttgcaacttttgatggtcacttgctgtgtatgccttgaaaatgccacagtgtggggaggagaattgtgggcacctaactgagtttactagatgaaaagttccatcaccctgactcacctcagtcttctctgtctttagggtatggctgaattttatacaaagcctatttataaaccactgcaagtgatacttgcattcatcttacactgtgacatcatttcctcatcaataatttaagcataagaaatggattaaagggactctgaagggacttctcacacagggaaaaacagaaaccaattcaactcttcaaaatactaattcagtcctcttaccttgttctttgatctgacgaatttgcttcacagtttcttttaagattgcacatttgtcaggtttgaagttaaagttgtctatatcattaaaatttgcaaaaatcaactctgcaagttcttctatatatttattttcctgttcacgattacgtttttcagtgttccttttggggcttaaaagaagaaacacatttttatgatgtatttgaaaaagagctattgtgaaaaaaatgaacgtgttaaacaagtttaatacaaagatagcaaacaaaagctacctatataaacacagaaatacttttgggggaaaaacacaattttccaaaagtgttccatgtttttttaaaaaaatcaacctaagcctagtttgtaatgaaactatctgttcaatgtgtttggcgtctcccactggactgtccacttcacagtgacctggactgtgctcaccactgtgcttagtgcagtacttgaaacaagtgggcaccaaattagttgacaaataaaagaatgtttcaaaaaggtaaaggaggttatattttaaaatttatttaagattagtaaaagaagagaagttaacccagttaataacaggaataaatttcaataatttttggtaaaacataaaaaataaaaccagatatttataattttatagacttcttcagaatgttagtaagcaaaccaaacagcctttttaggtaatgcaaaaagtcacaatacagctagaaacaaaagcgaaactgacccaggaaatttgttaactgtccaagctgaatgacatgcaaaatataaacaaacagtccaatttcaactaaagtttaaaaagttaatggaatggaaaaatatcaaaagaggcaaaatcttccattagaatgtgacaaaatagtaaactgaaaagttccttttcataataacagcatacaattattttctcaagtgcaaaggggggcccattaaatgacattcaaaacaatacaataaggaagaaaagcaagttgcttaatgtagcagctttctgtatttttatatataattatttgtatataatactaattttaaaatttctggattcacaatagactttcatatatgcatctctaaatatgtttgattttcataaatacatactataatacaatgtctctattttatagtgtttatacaatttgtccaggatcaccccacgaattactggcacagtaattcagaatttggttttttttctaagtctcatttttacccgtagcttctgtttttacagcaaaaggtaaagagtggctggaatgcttagaatagcccagttcccattctgaccccctccaccaccctccacccatgccctctcaccctctcacaaggtaagaaataaatgacaaataggtgagaaaggggagttgtgttcaaaagacccctgagcgccccagagggagggctcagagacctgccactacagcccacagctgaaacagttcccactttctcccactgcctccccaggtagggctcctgactattaaaggcagtctgacagacagaagtttgtggtttaccaggaagtagtagggaacctagaggagctgggggctgggatgtagagagtggagatttattgggcttgatgttttgcttggcaactagaaggggaaaagggaatataaaatactggtgttttgccctttctcctgctctgcctctcttgatgacttttcctagccctcttccctactatttcatgtctgatgcttttactgtccattaggtagaaggtgttgtttttatttaattcttaaaattatttatatgatttaaaacattgaaaaagtgaaaagtctctcttctacttttggtaactatttgcccagttctcatccaccgaaacaggtagcaacaattattgtttcttgattatcctaaaacaatacacattcttttttcttccttgtttatacagatggcaatattccaaaaacattttctaaaccttgctttttgtctgtaacaatattcttaagagatttttttttcatattaacccataaagagcatcctcatctttatcctagctgaactgtgttccaggttctagatgtaccacagctgtttaacagacatttaggtttttccgaatcttttgcaatttgagtaacctcatatacacgtcattttgcatgtgttaaagtatataataggaaaattcctaaaagtggaatggctagttcaaacaggatatgcatttataattttgatactgccaaattaccctacatgggcattataacaactcatacttccacccataatatatgagatgaaatttgctttaaaattctttgttttattcactaaagagccacaatctttgttctcaactcagaagtacatgggtttaacattttatgtctttaaaaataaaacaacaaaaataaaacccattataaaattaacggcaaatcctttttactataggatcttcttgttataatattgtgtaatcaaactcaatattattaaataaattgattctaagagtcaaaagatatcagaagtttacagctttcctctttttgtaaagaatacaatctgtaactgatttgcatattcaaaatgtaagcaagtacatattcagagatttaactgttaaggagaaaaaccaactcaatatttgaatcagcagtaaaatcaatgctaaaataacaaagaagcactcatgtggctttaacagacaatactgattccttttctcagcaagaatctaacctgggtccaagttggtcaggacattccttgcgctttcttgtctctgccctggaggggtcagaggtattttctcccatcccactcatcttgaacacatatcagcaactaaaacagaaaacagagaagaggaagaaaaaaatgaagagagctgatgatgaagtgtctgatcattttaccaacaataaaagaattttgactccaatcagaaatttgagaccagtaattaacattgttttatgtgcatgtataatttctaatataaaagccgtctctttaaaaaaatcttttaagattaagcaaatgtaaaggttaacatttaagaaacaaacaagcctacctcattgggcccaaattctttaaacacgagttgtatttcaacagcaccatgaactacaatctaccagctctgggtttgggctgccagcctccagtttcaagagtgatcttgcaccatgtggaaactacaggtgttgtaaggggctcctcccagtctctgttttgggttagccaatgtgaagtctatgctgcaacagctcacccacaacagacagcccggggaagagccagtgccaggacacgaaattgaaggttttcaaatttaactaggtacatctgacacccctgtagccccgagttcctgcacaaggcctcttaatcaatgccccctagtgggggatcttcctggcccctcgggaagctcctgtgcctggctctcctgcagcagctgcctggctgctcctccatcggtgccctctctctgtggcagctcgcctccctgcacacagcatggtcacttcctctctcacatcctgccgcctccaaactttccttccctcagctggttctggctgctaacgccaaaggtcttaagatatgccccagaagtcaggggaactttactgacccccaagtgggaagaaccatgatcagctcctgcttgctgaattcctctcagtaagaaaataaaaaaaaatgtaagaaaatcagtgtgctcgtcatcactaacataatcaaaataatatttaggtaagcaagaacaagccagtgacagaggtttacgtactgaaagagctaaacaaagagacttacaaagactgtgaggaaaccataaaagactgctactcaaggtgttcaataactgcttaccaaaagaaaaaacaatgcagcaggacaagctgaaatctgcatttaaagtctttcctagagctcctattcgatactacttccccttccttctggcccccagacttctaaatcacctttgcccctcctttactttttgtagtggcttcttttcttttctggatagaaaaaaaaaaaaatcaaagggaaggtaaagtgcattagaagacagagaacttaaggaagatgacagaggacaatcaagagtaaggacaaagagcaaggagggctaaggaacataacgcgtaccagtcaaaccgccaggccacttcttccctgtaatctgggctgcccagtctcagctgtactacaataatttcttctcgccacttctgatacaatagcgcagtggagttagtttttttttttttttttttaaagagtcatatgtaagcagaatgaagaaatactgtatccgtttagggaggctgcaccactggtacacatttgattcaagaggtgacacagaagggaataattctcaaagctgatacccaagcttcttgctggttagagcaatgcaaccaagtcccaatgtcccacactgtggtcacaattttggcctgataataagtataatctgtatttatttactatgagagaggcagactatgagaggcaggatagcagagaagtgaagggccagtattcatgtccaagcttcaccacttttagctatgcgaggctcacttgagaccaggagttggagaccagcctgaacaacgtatcaagatcccatctctgtaacaacaacaaaaccctaaattccagaacccttctcagatgataccttatagacattcactttcagtacttctctctgaatcacaattcccatggtttcaatcatgagatgtaagaaaaaacattacacatccagtctaagtaacctttcaacaaatgacctaggagattttcactctgaaagcagctttctagaagtcatacaaacttaagaaagtttctatcattacaatatagccttcaatatacagcatagcaaaatgccctatatagtaggtataggtgacaagtttttttgttaaaatggctattccccccctcaaaagcaatgccacatatactaaaatgtatagtattatcagaaagatcagaaagctttcaacagacaattaaagtaaggaactgttttacctaaagtcatatacacccagtttgaggatgatttaacattatatatatattatttgcatcatttacctgtgaatattctaaaatacatacacgaacaattgtaacatatgagggacagcactgggacatagggaccagagggagagagaagaggagccattttctagtctaagtatagtaaaatcatttgagcagactgtttataatttgcttgtacctactcaaggttggcttaaaaaccactctatttgtagactgaaaatatcataatttcctcttgaagtaagttatttaaatgccaagtggttttcccttttattatgtagtggtatcttaaacacatttcctcaaaatctgcaactttcggcttgatgaacataattgcttccttatatttttgtgtctactgcacatgtcctcttctcagagcaacattcctgggctatgtgccccagtacacacctccaacccacctttccaccaccaaggggaaagtggggtggagtcggggatgcctggccaagccaaggaaggatggctgcctcctggtaacctccaggaagtgccaacatgcaaggatgccctgtctgaatcactgcaaatcacccataaaaacaaaaaggagacagacctgagaccaaaagtggggggagcgaatgtaacactgacacaggaagggcaggaggagggtggagggggggcagacagctgcagtcttagagcagacacataaatttatgccctgcattttagtgggagagccgaataaataacagaacctcatgaatgaggtgctctaacctagtggactgtctgatatttctaatgcttatgtgaggaggctgggctggcagcaagtgtcagtatttcacactggaacaggaggtggggccaggtgagttcatttttcccccaactcaaaatactgggcaatgcagaagtgacacaaataaaaaccagagagagatagataagttataaaaacgactttcttctaagttatataaattactttttctatacaaatgtacattctagtgtatagtcactcatagagaaatatctaaaataaactctatggacagaggaatttttatgcacttttgtagatcgaagttaaaaaattcatttccagtgtaaaggtaggagatggaaaatactaaagagcagcactgaaggttctaaaatttcatttggtgaccagctctaaattaatagtttcttataatttctgcacactcacatgaaattaaaattcttaagcatctcactctcaatgctgaaactgtttaacgtaaatcacaaaaactgaaaatgacacaagtaaactctcaggctgtatttgatggtaattacagtcattgagagcaaaccagtttctaccagatgttgggggttgtgaaaggacaagtctgaaaaaaaaagtttcaaatcatccattcttgttatctgtaacaacacaatagccctgttttcacagtgaccatacatcctcccttacatcccttgatatcagcttggatgagctagacggtagggaagagttatagccttacgattagtaagttttatctctaaaaagtaacaatattctgggaggggtgaacaaagccagttgaatccttagcataatgacagaaagcaaaataaaatgttaaacctcaacacaattcaaaaatgtactttcatggaattcaccaatataatttataaggtaacaaagctgttgctctcaatacaacctcataccattaaagcttgttaatcatccataatttatgtaaacgataatatgcattttatcttttatcaagacagcctatcttccaaacaaggcttgtaaaactgccagatgcattatatacagaacaaattcagttaaagaataaggatactactgctgctgaactccaaacataataaagtgatcgaacatctgatcctgactgctagctccaataaatgttcttaaagttaggccttctctgaaattccccaagttagaaacgacacagaaagagctactgaaaccacttctcttatgaatgtctacttgaagaggacctgcctgataaatcatctagctcttgttatgagaacagaaagacttagagatttccgaggttccttctgagctctctttacgatagacatatgaaattgtgtaatatgtagtctaaccctttacaaacttttaaaaccaagaaatgctcaagcaatattaaaagtatacataaaacctcacttaaatacccttccatttctatttaactaaactacagaaggataatcttttagagcccactgtttctcagaatcccacctcaacagctaaagctgcatccactattgctttatcacaaatgaaaacatttgctcattctaaactggtaacagtttctccttcaaagtacactgtgttccaagagcgatccctttataaggataaaagcaaaatttctgggccaggctctgataagtctaaaaaacatagtatctaatgcttcaataaacaaaatgtgctttttggatgtagatgcctgagaaagaaaagaaagtaggccaaacttgggaagtcagtaagatgatacagaagacatccagttgctagaggaagggaaatacctcttttcaaatagggttaattggtcgaaattacccaaagcagacattattttggcaagatcccaacttctggcaacagttgaataaatattctatgcaggaaatatacagactactcaaggatataatgttgattcatacaaagaatcatcacacagacaaataaaacagaagtagaactatgtggatttactaaatgctgggatgacagcgcacagaaaatcaaacgttgcttcccattggcaaacaagtaatgcattcaacagtgatagaggacatgacacaatatttttaaaatttttacctagtaaaattatgtattatttcctcccaagtgtcattactcttttttactagatcataagggctcttttaacgtcatctttacgtaatactgtagtgcttcttggttttcatacagtaaaattttaatttgcctcacatactatagtctgtatctacagattaatgtacagaatcaaaaaactgtacattaattcatatagtaacaacagttaagttacaaagttttagaggactcacttcaaataaatccagaaaaatctagaatttgttttcaaataagttcaactttactagtttagagcagtttactgtacatttgccttttaaaaataacaataagatagacacaaaccactattattaggatatgatttttcaatactaaaacactagccatttattgttaggtagaggattaaagaaaataacatatcctgcaaccacaactagtctctaggtaaactggctttagcacctaccttctcttatgctgtgtcttagtccaggaacagtaataacagtatataaacaaatgtttaagctaaaaattccttcctctcagtatcgtctgctcttagattacttttgtataatggccttaaagtggtatattagacagtaactagaagacatattccattttctgactgaaagccaataatactcatgaattttttagctgaaagacacttcaagatgccattgggaagactgtaataaacacattaggctgcaaatgggcagtagcagctctttaacacatgctgcaataatcaaataaatggctacattcatgttcactggttacacaaatattttgctgcaacatatccatcatctgcatctgtcctaaagaaggggaaaacctccttcaaagtcttatcttagcagaattcaggccagaatacataagtagcagggagctgttctaaactatcattaccaacatgggcgaaaatgtctagtctgacatcagtggcacatgatggcttctactttctaaattctcataggccaagttccttaacatagccagttactggactgcttatatatcgacgtcagctggtgcgaatatggccaggaatagcaagactaggttttaatgaggcctcagatgagaaaacatcgcaggaagaagctgcattccttgcataacgtaagcattttctctccccttcaagcagagtgtactcagtgtctttttattattctgaaaaccagttttcaccaaaggcttagcattctggaaagaagtcatcaaatcaaggactacaatgtagcacttgtgtttgagtttcataacttgtccagactaaaattcaattatctttcttcattctgaaacccattttaaattttgttatgagattaaaaaatgactttctaattcctgagaaagttaactggcaaggtcaagacagtctgtacctatacaaagagtgtttttatcatttgagttgtcaacagttcttaaataaatgagagttctctctcacagcataatatgttgtttggtttttttgctaacatttattgaagacttattatgagttaggttacttagcacatatttccttgcttaaaagccacaatttgatatgtatgtatatatacatcttatagattatctaacctctccgacctgtttcctaacaggtcacacagatcacgggtgtaatgataataaccatcatccatggagtgtttctacattggttggcgttttctacgtactttacctgtatacactcctttagttcctgtaacagcctgattatcaccattgtatagatgaggaaattgaggtacacgagaaataaagtaacttgaacaaggccacacaggaagtcttggagctcatgaatccaaacagttcctcaattcttaaccactgtaatgtgggcattaaagggtcctatactttgacactttcactgaagagagaaatttataaactagtatgtattacaggaagcactatattttaacttagtcaacagtgactatgtaatttgaaagcacttttctttttcttaaaaacagtatcactgtgaaatgtaaaacacttctttctgttaaacagtgcatatgttagaatcatgtatccatttattcaatatataactaatgctccaggcactgctgcagacactggagagaaagtcatgacaaaacagctaacagtccctgtcctcctgcagctcacattccagtgcagaaaagatgtcatgctcagctcatgcacaattattccccgaagataagcaaatatttttgttattactgaatttattatgaagctattaaataagacaccaactagaaattttatctggcataccaagaatgctcagtttcacttaaaacagtaaaagccttttcttctgtttcagaaatggtaattggttaatttaaaaagtcagttatgaagggtaattgtaaaaatgatacatactacaccttaataatttccttttaattttaaacatataaatgtaactttgagtctcagtctccactggagtttcacagtgtccttcttgcataaatcatacctatacctataatttatcatctaaatagtgggcaataaaaacagtgtctactctccaatttctgtttatttaaaacagacctagaacttatagacacttagatttcttaaaagtgcttataaggtgcagatttgtatgattttttcccagtctattagacatgtgttatgtgtcctatacacccatttggcagcaatgtttcttcatttcactttgagtcttagttttcacagaaacaaatgtatcttttcaaactcacacttgatacgttacatatatttaattaatttattatattacatatatattaattaaattatgtcattataataagaagtacaactggcaaaaactgtccaggaaacaagaatctggctcttggtaggcatacaatatcatggctaggcgcagagtgccccactccctgccccgctcctccctgtcctcctgctcctctgttcccctacccctctcctctcctgtccagagtctcagtctccactggagtacttaagttgcccatcatcccgagactctcagacagcggcagcaagaggacatgatctattaagggggaatgcagatcacaacaaatattagtgaatacctattatgcaccaagcaaggttctagttattggagaatatagcaataaacccaatagaccaagtcactgactcttatattctaacaggaaagtagggagagggtggggaatagtaaaacaaacaaaatatttaccacatcagatagtgattagaggtataaagaaaaacaaggtagggccaggcgcagtggctcacgcctgtaatcccagcattttgggagccggtgcaggtggaccatgaagtcagacgttcgagaccaacatgaccaacatggtgaaacccgcctctactaaaaaaatacaaaaattagccgggtgtgttggcgcatgcctgtaatcccagctactcaggaggctgaggcaggagaatcgcttgaaccccccaggcagaggttgcagtgagccaagattgtgccattgcactccagcctgggcgacagagtgagactctgtctcaaaaaaaaaaagaaaagaaaagaaagaaaagaaaagaaaaagaaaaagagaagaaaaacaaggcagtaagattaagagagtataatgtagatggggtgagggatactattttacataggtagccagcaaagtcctctcagatgagtgttatctgagagctttctaacagatctctaagattcataatataatttctttaatatacaaccattaatcatatgaaaagcggtacaatgttgtggcctagatcacattctctggtgtcaactctggctggaaatccctagaacactacatatttgacccgtggcaagttatttaattaacctctttggagctttgtttcttcatttgtaaaactggagcaataatacatacctttataggcttgctgagagcatgaaatgttaagggcacagaagagcagctggcatatagtaagggcttatttaataaacataaactgttatctgaatttaatagactataaatgtttataaaataatctaaattgatggtgaatttggaaagaaaaattaatttaaaaagaaaattaaaaaattaaaaattaatttaaaacagaaaagttatcaaaatattagcagttaaattatttcaatgggcattacggatgtaatttaatttttgtattttccaaattccctttcattaacacatcagacttttgtgagtttataataagaaggaagagggaaagaacaggagggagagaggaaagaaagaaagaagaaaaggaatgaaataaagctgactgtgctgctgggaaaaacaaacaaactaaaacctaggcaaaccaaacggaatttttaaagtaacctgctctttggaatataaactgtaagtgtatgaattgtttacatgcttattttcagaaaaaatcttgcaacaactgagggaaacctatactgtactaagtggcacaaagactgcctacaatgaatgaaatgagaaatcaaatctcattttactggtattagcaatgaaatttcaagtaaaaattattttctttggtaaaccaaaggataattctataacaatttccaacctactaaatctgtataactatacttaaaacttatgttttaattatttatatatatatatatatataaaactatacttaaaacttagggtaaacttatatttatcctaagttcttctgtataatatagacagatacttagatattttagagtcattagcatatcatatgttctttaactatatggacttctcatgttttttcttctaccaactctttcagagcaagaaatatatctaaatcacaagagctttccagtaaaggttactaaaattgcccttctatctcagaaaaatctggtctatccttccaaagcagctcaaagcatactccctttacgcaggcttcacagattccaccaggaagaattaaaggttcccttttactttttccaagcccatggtatgttaaagtgaaagtaacacttttttaaatgcctcctgatcagctgcctctttcccaggagagggtccacggttttgttggcacccactgtcaccatgaggcagccctttgtgggctccaggcaggctcatgctgctgcctcccactcgagtgtctctgtcagggatgggccttaagaaactcactccttcttcccttttgtccactgtcactcatttaactccaaactttcctgtgggttctttacctcaatcaaacagaaaagcacagttttgcctctgcaaaactttcaagcatgttgcatgaaaaaagtacaggacccaaatttaataaaggcttgtggtttgataagaaataagggacacagttataggctgttttggcagtgtaaataatgcttcctttctagggtgagtgtgtaagaagtattcttctgaaatacctttttatgctcttttctctgttttccaccacacttctacagtggtaaaaaataacaagaaggaaaaatctagtttggggggacctctgaatcattttcttaccatacaaattcctaaaaacttactcttcgtcagatcattacaattattctgaacactacttgctatgaggcaatggttgacattaataatgaaaatggcagctctagattaacagaagctcccctgctccaaaaagataccaattttatctcataaaaataaaccaaattaggccgggtgcagtggctcacacctgtaatcccagcactatgggaggcagagtggggtggatcaccggaggtcaggagtttgagaccaggctggccaacatggtgaaaccccatctctacaaaaacacaaaaaaattagccgggcatgattgcacgcacttgtaatcctagctacttgggaggctgaggcaggagaatcacttgaacctgggaggtggaggtcgcagtgagccattgcactccagcctgggcgacagagtgagactccatctcaaaaaaaaaaaaaaaaagccaaattaagcatttttatttgcaaataacacatccctacagaatgtttactgagaattactagaacttagaaagtcttttttacaaacggaatttgaaaattaccttggcacctaaaaatgtgaatcaaaacccttaatttaacaattttttctccctcaaatgatggattttggtaatcatcaaaaccagccattctgtaagatcacgatttatattttagctattttaagtttcaaacttgagacacaggcaagtagctgtcagcaaaagcataagcatattgctatcattgggattgtacagtggagtccaattctctgacctcagtgtcagagactggggggaccctctagttttggcagacaaactttgtgaagagcacagaatagccttggcaagctgccagtggagggttttctcccctttatagccccagatggagaattattacgctttgtggaactaaatatgtaattggattcaagaaaggtagcttctagttatcccttgagtagttaataagggtggtctacagtaggcattaaaaagattaaggaaaattccttctattttttatgttgctctctacctgtttcttttaaatagtcctaagacgtttttccactgagagaataaagaacaattgtttataaaagctacacctatggataaagatctctaagattgctgcaccctatttagctataactagcaagtaataagcatggaatgaaacttgaaagaaattgagataattgcttgacgcctcagagacagctagctatattatattccttctgcctgatactaaaatgaaattgataataatccatcaagctgaaatttaaaccctggttctagttgggatagaatgacgtggagaaaactaagctagctctcagagacaccacgacacagtatatacgtgttcatagcacaaatatatgatttctttagttggtattttctttcaagtcaatgtttctgaaccaagagcagtgactattatatttagggcaaaaatatatttgaacaatctaatgttatatatggttaagtttctaattaaaacaggtctcttttggtattaaaatacagcctaaattacaggcttttaacttaaaaatctatttgcatttattttcttctgatattgaattcaactgtactgataattattgagtagctgctaagggcaaaatgctttgctctatggacactgcaatacagtcactgagtaaataacagaatttgatctcatgaaatgcaagacttaggaagaagatacaagtatggaattaattaacatacaagacaatatacataaaaaatacaaagtgctaacgaaggaaaaattacttccttcatttggaagagtaggcaaaggttttatgaatgcctgagctaggttttgaagaatgggtataattttccaaagtgaaggggagatgggtgagcatgtataagagaacttcagggcaccaaagtggtacagttactaaagagtgagacaatgctagagttgttgtggggagcctgcatgctgggatgaccatgggatccggggatttgggagtgtgggtccttcccctcctcactttcctctttcccccaggttactgccaggccctggactgagtgctgactgcatcctacctgagccagcacgaccccagaaccatgcttatcaaagggtcacctgagaactgtcagaaatgcactctctggctctgaccagacctgctgaaaggagacttcggaggtgaagcacagcatcagcttgccaagccttccccatgattctgatgcttgctgagatgtaagaaccgctgccctaaactttagaaagaaattgtcttgctctatgggtgacctgaaatctgactaacacatagtgttatcttcctctctgagggagaaggaaaagaagagataaggtagagtatatttaattcatttagttcatttatttaccaggtatttagttaggcacttactttgtagagtctgaaaaccttaacccccagaataaggaatagctcttgtcaatttaataaactgtgagtacaatgaaaacttttgagctgaagatggtaaagtcacagttacgctagaaagattagcatggtagcggtctaaatgacgtttccagcagtgtagggaggagatactggagactcattaataggatactgcaaaaggccacatattgtatggctgcatttatatgaaatgtccaaaataagcagatccgtagaaacagaaaggagattggtggctgccaagggctggagggaaggggaaatggggagtaactgttgagtacagggtttcttttggggttgataaaactgttctgaaattagatcatggtgatggctgcacaacttgcaaataaactgaatactcctgaattgtacactttaaaaaggctgaattttatgtgaattatatctcaagaaagctatcatatgaaacaaaaagaacaaaaccaacaggcttaacctggcaacactgtgcaacagataaatagatagtttgcaagtatttagaaaacacactggggattactatgagcaaggacttctctagcaacattcatcccaaatgagttttccttattctttttgctaaagagattagagtaagaattttaattttttaaagcttactttttgcttaataaacatgctcctagtatacaatttagaaaaatacaaaaacacaaaagaatagaatagcacatattcctaccacccagagaacaatcaataacttaaaaaatttcctgctcagtattttaaaatgtaagtgtgtatacaatcaagcacaaagtgtatatataattttatagctgggtctttgttttcttaatgttatccaccatgtcattaaatgtctttataattttcaatggctctgtgatatcccatcatatgaatataccatatttaaccatttgtttccatttttgtgactataagtaacactgattaatatcttaaatatgtcttgatccacatttctgattatatacctacaatagtcttagaaatgtaattattagatcaaagggtctgaccatatttaatcctatttatgtactgtcaaactgttttccaagaagactgtattaatttacaatccccttagcagagtatgcgagttcccttctcacaattcacaacgagtattaagatgttttaaaaatgctttgctaatttaaagattatggtgtgacactgtttcacaatttaaactgattcctagtaattgaatatctttgaattgttttagcacttcatttctactctgatgaaagaatgccgagtcaggtatgccataggtgcaatatgttgaggtcagctaggcatgtgatgtaatgctgttgtgcagatgaaagcaaaatgtgggttccactggtggtcttcatctttggccactaatcaatcacccaaggagcttttgaaaccatagttttcctggctccgccccagaccaactaaagcagaatcccttgaggaaagaccctaggagatcagctgaaacctactgggctagatgacaatggaaaactgagttaaggctggtggaataacctgctgggtgttaataggatattaatcctgtctggttctcctgacaggccaccacttccctgcagtccactccagtagaagctgctgtcctctcattacacgtgtagtggggatagtaggtggggtcaccctctcctcactccattacaaagatgcccttatatagaatctttcctcctctgaaaaaaccctctctctaccagtaccatagaacgcctctatctatcttcctaagttcaccaacatgcagcttaatcccccacagttactgaagcattctgccatcagactagcgcttcctctctagctcaaatctggtcatcattctgagtaatttcaaagactgtgtggatgaactaatgagtatcccgcaggtccttgtctgtcaactccaacgaagttcacctcccctccacttcggccgctgccttctataatcatgccctgaaccttgttattacgcagtactgtttccatttgaacaccatttttttggtccacaaactcctagcacactagctttcatactgtcttcctccccaacagtcttcagtgtatgccagcccctgcccctttccgtcattctcaagctagagccacctccccacctgcagccacctcagttctctttcacaccaccctctcatagaattctttctgcaaaacttcattcccaagtctttccaccataaggggaagctgagcactgatggagaatatcaagcaacaaggggcagaggggccccaaagatttcagggtttctaaaattgcccaggcccttagtcctgcctgtcaatcctttactttgttctcagcttgttctattgacctcaacaattatttccagcttttgccacttcagtaaatacccgttcaatttgattttcctcaacttcccttcttcctgcttagaaagatagccaactccatcttcaacatcacttctggtgtctcagagaatgtgtgatccttctgcctgtaaacactaactactccaaccccatttctattcccctcctcaccttgggagaccctgctgcaatatttcaacctcttcctctctacttaatgcatactcaggtcatttccatcctttaaaataaaaatgtttcaaggatgagcttaaattcctctccaactaccattcaatctcaaatcttccttcacatccagacctgtctaaagaatacaaaggtctgggattcctttatccccaaacactggggaccatatgatttagaatttacacacacacacacacacacacgtgcgtagatatacatatatatatatttcattctagaaagataatacatgtcggccaggcgcggtagctcatgcctgtaatcccagcactttgggaggccaaggcgggcagatcacaaggtcaagagatcaagaccatcctggccaacatggtgaaatcccatctctactaaaaatacaaaaattagctgggcatggtggtgtccgcctgtactcccaagctactcaggaggctgaggcaggagaatcgcttgaacccaggaggcggaggttgcagtgagctgagatcgcaccactacactccagcctgggtgacagagtgagactccgtttaaaaaaaaaaagataatacgtgtcatataccatatttcattataaccccagaagggtctacagaagcattctataatcaaattcagtattatttctgcagtgaaatgtatgaatattcacactaaatgaaacaaatgattataaatcatctcacatccattcaggtcaggttttactgccaaatgaattacaaaacacctttccattttcagtgtgctgaattttgagattcaaataagggaatacaggcatgtagattattctcctattcccttccactcactctatgacccaaagatattgtatctcttcccatattaccccattaaatctgccctccctagtcttccatgacattcaaatgccaacctacagcaatttgggcatactgtatgttgttaccaaactttctgctgtgtttaccacagttaaaaatcacaccccttccgtggttcctcctttaacctctccattttgtggctttcatgacacaacaatctataggtcctcctcttacataattattctttttcaatctcttttatgggatcttcttcctttttgaagttatccaggtttccatctggctagttctctcctcattcatctctattttaaaaattatttttaacagctttactgaggtcacatgtcgtaaaatgcagcaatttaatatatacattaaaaagtagttttagtgtatatacagggttgtgaaaccatcaccatatgtaattccaaagcattgtcatcaccccaagaggaaaccccaaactcatacaattaatccccattctctcctctcccagcccctcacagccactgatctactctctatctctatggatttacctaatatgaacatttcatataaacagaatcaaataatatgtgaccttctatgtctcacttgtttcaattagcataatgttttcaaggctcagcaacactgctgcatgtatcagtacttcatttctttttatggccaaatattccattgtatagctataccaaattttgtttacccattactcagtgaatggacatttgggttgtttctactttttggctattatgaataatgctatcatggacatttgtgtacaagtttttacacagatgtatgctttccattctcttggatatatagctaggaatggaatcggtgagtcatatggtaactctatgtttaactttttgaagaaatgcgaaactacttcccaaacttgctacaccattttacattcctaccagtaataaacaaggattccactttttttttcaaatcttccccaaaccttgttctttttgttttctttttaagttatagccatcctactggatattaagcagtatatctcattgtgggtttgatttgcccttccctaataacaatattgagcatctttacttgtgtttatttggctatttgcatatcttctttggagaggtgcctactcaaatcctttgcctgtccctaaaattaggttctctggtcagtgattcttaacagcttttggggttatgaacctctctgagtacctgaccaaggccaaaaagtaaaagcacacacatacagaatatgacatacaacttttccaaaatgtcactaactcactaagaccatttatggatcctccagattaagaacccctgttctataccataggttcccaaccatggctgcatagataaaaaccatctgattttcattttccattgccatacaatccatcaattctacctccacacccaaaagatgtgaactttatgtgcgactcagacatatgtacatccatgctctaagcagcataataggtgaataggctttgctaaaggtgaaaacaacccaaatgtccatcaacatatgaataaacaaaaggtgcacacacatataatagaatattattcagccttaaagaggagtatcgtactgatacatgttaaaacatggatgaaccttgagaataccctaaatgaaagaatgatttcactaatatgaggtacttagactggtcaaatttatgagacagaaagaggaacatagattatcaggggctggggagtgggagggaatggagttattaatggtttctatttgggatgatgaaaaagttctagaaatgaataatggtgatggttgcacaatactgttcatgtatttaacattcctgaaatgtgtacttaaaatagttacaatggcaaattgtatggatattttaccataataaaaaatttaaaaaaatatttaaaaacatccaagataaccaggtaccactccagacccatcagatcagaaattttagaggtgtggtatgaccatcaatacttctcttaggccaggcgcggtggctcacacttgtgatcccagaactttaggaggccaaggcaggaggatcactcaagcccaggagttagagaccagcctgggcaacaagacaagaccttgtctctacaaaaagatcaaaaattagctgggcatcgtggtgcacacctgtagtgtcagctactcgggaggctgaggcaggaggatttcttgagcccaggagatcaaggctgcagtgaactatgatcgcaccactatgctccagcctggacaatagagtgagaccttgtctcaaaaaacaaattttttttcttaaaaattttccagataattctgatgttcaactaggattaagaactgctgctttatagtatctttggtggtatcagttatccctacgggtttcccacatctttccagccttcacctctcaaagctttcaccttaaaaatcatgccgcctgctaagtgactactcagaaaattaaacacatccatttttattccccgcccccaaaatgccccatgtgtaagatgtcaatccactgaacatcctccttatacttctgtattcttgtcaaatcatcaataagatatctgtgcctctccaatatcctcaagtctctcctcttatcactttgctaatcactactacttctattttaggtctttatcacctctcacctggattatccaaaataagtctccttatttccagataacttccttgattaaaatccttcaatagtcttcgctccctccaagacgaagtctgtgctttctcaaacgtaatacaaggtgccttatgatctagcccatacctctgtctccaggttcatttcttgaccttttctgtttgcccgggaactataaatgcacatggttcctcacttactacataccagctcttacctaagttcttttgcttgtcatatatgcaataagccatatatcttgtccttttgggtaactcccactcatctttaagacctagctcacattgactcttcctcccaagattaaattcccctcttctgtcttctaaacgcctatacagctggccctctccgtatctgtggttctgtattcgcagattcagccaatctcaaattggaaacttaaaagaaaaaaacaacaataaaagtaatacaaataaaaaagcagtacaatataacaactatgtgcatagcatttgcaatgtattaggtattgtaagtaatctagagatgatttaaagtatatgggaggatgcgcattatatgcaattactatgccatttcatataagggacttgagcattggtggacttgggtctccactgggtttctagaaccaatcccctgtaatactgaagaacagttgcatataactctaccattaatcatgtatatcataactatcttatttatgccttttccctaccatattttaagctctttgaaagacagaaaggaagtatttctcattgtaaaaaaatcctaggcccttattagaatgcctgatgcacaagtacttaatattcatggaataaattgctttacaaactgctatcgagtttgaagctacttcaccaaaataggtagcatcgttgaatatttactatggtatagtagtatacttgtattatcttatttgatcctcacaattaactgtatgaagtaattattattattccctgaatgaaaatccaagtaacatgactaaggtcaaacacagccaacagctggcagaagcaggatttgaacccgcgctgtctgactctaagcctgtactctttacctctaggacactgcctcattatttgatgcactgctactctctcaacttcttactgtgcatgtctcatctcaagtaaataattccatccagtattttccttttttttttttttttaagtataaacttatagttttgtatctgttaaaatttagggccaggtgcaatggctcatgcctgtaatcccaacacttcaggaagctgaggcaggaggactgcttgagctcaggagtttgagactagcctgggcaacatagtgagactctgtatctacaaaagaaaaaaaatacaaaaattatccgggcatgctggcatgcccctgtagttccacaaaccagggaggctgaggtgagaggactgcttgagcccagaaggtggagactctagtgagccaaaatcacatcactgcactccagcctgggcaacagagcaacactccatcttccaaaacaacaaaagaagagtttacaaagctttagcatattactacatactcttcatagccagcagaactactccaagaacacacacacacacttgccattaggttgaaaaaaaaaattaactgtgtgacgttctaagtaagggaaaccaaagatgacagtcatttaagtcaaaataaccaggggattttaggtgattgcaatttaatatgatttagccaaatgacttgatactaaaaataacaaatgtacccacagaccacaaaacaaaggcaaaattaaacatatgtgattaagatagaaatatgagattccatgttgctccagaagacagaaatgacaggttcatggataacttagtcaatgaataagcatgtgcacacgcgcgcgcgcgcgtgtgtgtgttttaaactacttaggaagaggaaacatacgtaggtgagaaaatacaccacatgtgttaaaggaatatttcacagacaagagatgccacactgacaaaatatgcagtttaaaaaacaaacaaaataacaatatattaggtgcttagtaattagtatagtgttgaagaatgtattatgcatgacattatttgattctcagagctccacaatgtaaatattgttcctattttacagaggagaaaacagattcagagaagttacatgaccgacctctccaaggtctcaaagctcttacatcacaggacaaggcttgaaaccaagctctgactgcaaatgccatgctctgcacaattcttcccattgtctaagaaatgccattaaataactatctagaaatacgtaacaggagaattgccaacaacacaaggaaatgatctaggtaaaacatatttgaaaagacgaacatgtcatcctcaaagtctgtggactgtctgtccctggagaccaaggaagtatgaattttccctttacccaaatcttccttgagttatgtcactggagtatggtgacttgtgcttctgttcatttctagcacccaaaccgttctcagcagctccaggtgctgaccataaccaacagcaaatatggtacattacttgaccaaaccacaaaattatacagaacttaggtggtttagacattcaggacagattcaggcccccataagctcaactgtgtccccatttccctccatatctgcaatcttgacccactattctagagaaacaatagatttttgtgtctcacagtagttgggttgatttctcttactttggtgtgttctgctcacattaacctctgtataagaaaccaccttctgtttacatccactaccttgccttttcctactgaatcctaggtactctgataacatttctaatcaactttagaagactgtgttccagaatataatttcaactgccttgagtttacctgggaattgaaatatctggaggtgatgggagatcaaaccgggtaggacagaaggggcctcaaacaggtcattacaggaattctgtttcggccttgcaatggcaactgaatatatttgaacaatggttcattctgataaacatatacaacaacttatcatctaaatgaaagactaacctctaccaaccaccaagcagaaaaaccagagaatttaaattggtcttcaaattttaggcatgaagaaacacaagacctacagtctttgttgatcttcttggtaaatgtcatgtagtacaagactccactgcactctattctggaccaaacaatccattcccacagctcttcctaaggacccacaacctgctgatataaggcagcttttctccatctccttacacagaagacaccctgacaacaccatgagacactgcccgccccccagcacttgattcaggtatccaatctacaggttgccagggtctagagggatggcttggcacaaaagttctatccagacaaagacaatggtgattggttggctcaatcaggttctctcagtctttgggataattaagagagagaattgttcagtgagaagagaaaacaacagctaaaaagacacataggaagaaaccacaagataataaagttacaagaagaaatgaatgagccaaagttacaaggcagagaaaagatacacagtgagagtgtgaacaggttggttagctggcatgacaggcagagcagaagcagactgagagaccacctttgctactacagtcaacaagttcatgattctccaacctctccacacaggaaataatctcttgtgcccaatccttccagatttccatatctagactatcacacagacacaaaggctttggggaaatgtggccctctacccctttccaacaaagaagctctgttgagaagggcagccctatttgactgcatctcctaacacggccttgaacctccagataataacaagcttcagtgtcatttcttgcttccaccatttactagctgcacaaccttaggaaaggttcttaacctttcaaagctgtttccatgtctgtaatatttgcagataacatttacttcacaagtttgaatgaaaattaaatgagataaagcagaaaagtacatggcctggtatacagaaacaccctcataaaaataagctgccttcactattattgtcattattatctgaaacacttggcccattgtaggtactccacaaataacactccctattcaaacaggagatgctctgtcttgtttcagatctcatactgtaaagcaattatctttcttcagtctctttagggccacattttttgcatttttgttcttctgatgttgaaaatggcccccaagcgtgatgttggaacgctatagagggttccgaagtgccagaaggctgtgatgtgccttatgagaaaatatgaatgttagacaagctttgttaaggcaggagttacattgctgttgactgtgagtgcaatcttaatgaatcaacaatattatgtaacttacatattaaataagttgtctttaaacagaaatacacataaggttatgtattgatcagatgactaagatgatgtgaccagaggcctgcaggaacctagccctcaattttccactaggagccatgcctcagaattcgccagttcaatgtttcccacaactttataaaacataactcctgtgaaatcaggagaatcaatgctattacattaaaggtagaatatgggactaggtgagaatctccaagtgggaggggcaggtccagatagtgaaagaggctcttatgtcctaccaaggaaggtggacttctaattgcttctaacatgtagttactgattcaaagactatgggcttgggaagggtctgtataccttcctcctctttatggaatccctggtatctgtaaacaaggatctttatttggattctctgtggtttttatacctgaatgctccatcatagcaatgcagtgagtaaaggaccttggaagcagcaagttctccatttgccaagaaaaaggaaaagaaactaagtaagaaaatatgcaacacacttctttcagatcccagaactacaaagcttctccccacccagttaatctcatggcaattcatagtcactctgttttaacaatctctgctatcccaattttaatgctctccttcattctccttcctctaaagcagatttctgaattagctgggagttaatgttcatgaatatgtttcttttcaatgcggaccgaatactctttaaataatgtcttactcttaacatacttgaaatgaaacagaagttcactaaagtacaaacattaaaaaacaaaaaatcacttcaactgtaatagttccctccttgtccattatgttcatcctgtcctcattctagaataaatcagcaaatctaactgaacccagcatcatctgaactcaatatacatagtaatttagagtgtagactctcaaggcaaactacctgggctgaaatcctgcaccactgactcattagctgtgtgagcttggaccagtgactttacctctccatgtctccatctcccaactgtgaaacaggaattgaattaatatatgtaaggtccatagaacaggacctggcatgtaagttctacataaaagataagctttaaaactaccgttaattgttttgcaaaagtcattttcctcatcaaaagaaaaagtaaaaacaaagcctttaaaattttatttttaataagcatatgtaaaaatgacatataaaaatggacattttcacattaaaacatgaaagcaaaatttggaaaaaccaattaatgtagaactaaaaataaaaaggctattacggtttcaatactatgtttatttatcattcattttgactacagtctaaggacttatagaaacaaaacaggtaacttaaacataagcctcatagtatgcttttatgactattctagccaatcaatttactattgtaattggatttgacatctaaaatgatgaaaccaaacatctagcttctatctcaacatacttcttaatcttgactgacttttaaagaagaaacaatcattcaatgtcaagattatagtgtttggtgtttcttataaaatctttaataaaacatacatagcaataaccatgttatctttaacattaaaataatgcaaatgtatgtttatgttgtactatattagtgattactacaagccataaccctgcatgttaactgtgaacctggtgaaaagagccatcactactaaaacgcatgctaaaaaatgcaaagtcttacctttttaatgacaaggaccaaagcacctgtgagagaaatggataagccaactgattctaaacctttttctgcatttctgaatgataatttttagagcaaatcctataagaggtaccgtgggaaaatttgctggctgttacacaggcttttccacttcctgaatcttatattcccttggcttccacagaattcaaatgtctctaaaatatagccccgtactttaatcctgcctaaatcttcccaaacttttaccttctcaaaaaacaaaaaggtcctatgaacacatttcactgagttttacaacactgaatactaagatcacacttaattctactttttcttaccctatctattctacaaattaaaattcgttccaagaaacaaaccccctcagcctgacaagatcagacccgattataatatttgtggttaattactgtggttggaattctgaagtgtagcaggatttgcaagctagacatctggcttgtttacacgctacctggacttcaacacctgcacctcttaactctgataataatactggggtgcttcctcactccccaacctctaaaagtaaatactgtttgtttagataactcaatatgttaatctgtttatgaaaatactttaaatttgcaaaggactgatattttatgtcctaggggaaaaacaaaaccatcaggaataaaaactactctagctgtagaagattatttaaaaaacaaaaagtatttctgttctgaaacaaaggaaaatgaaatggcatggatgcagaccagttaaaactaccatccaaatctgctcatatgaaacgtcattcacaaaatcagagaagtactctctcaacagtcagataagttttattccttttagccattttaaattcctataagatacaggataattacatttactgaggctggattccaacgccagttataagttaacttattggattaaatatcttatttgtcttcatgttcccatattgtttcatacagtggcttgtaataataataggtgctcaataaaaataccttttaattattacaaaagtcttggctcattcaaaggcttagataaggtaacaaaataagatttaaaaataaagaaaaacaaagaaagctcaaataatacaactttgaaacttttattattcaaaatatttaacatatggtgctagtgctttctgggcggaaaatggtatgtaaccctgaaaatggtatgtaaccctgtctcacagactacttacaagaacatgagagttactgaaagagcagtgaaaataaaaaatggaaaaaaaaaaaaaaaaagaatgtgggagaatacgatagttaaaaaaaatcccaaattaactgcttatttgaaccaagttgtttttctatgtaaagtgccagtgttgtctgctttttaaaagaaaatcccatttaataaaattaatgatttattaaactatactgtgctaagatatggcttgtagatataaagaagaatctcctgcacttagtataattaaaaattatgtttgagttgctctcatcttttattagaaaagacagcgagaattaattgttaaactgtctatacaccttagaaattgcctgatacattccttacctcttccaacctcaatttcaaaagggaactgtatacagtatagtttagtttcaaaatcatatgtgatttggaaacatacatacacttcagcccatctgctctagaagttaaatgaaaaacattagcaaaatcattctccgaatatatgttgtgtaattgttaacccttttcagataatgcttctgattatctttcaccaatctcagactttcaagtgctacattttccaaggttaagagacaggtacagactgctatgagaattaatagcattaacatgagcaaaagcagacaagtacagtctgaagattaactgtatgttatttagctctctgcatacagtagcataagatcaatctgagaaagttaggtactatatataacaacaacaaaaaaatcactgaatcaaggcctccaccaaaaataaaagctgtacttatcatgtaatcaaaaattaaataatttcaaatttatcacaaagctcccctttaagcttgaaattagaaaaggataaaaagtataaaggtagaaagataaagcttatagttatatttattccttaataattaagatttgcatctaaaaaattaagattctcctcctgaattttagaaaatgcttaccaaaatatttcctacaaacaagcgtgacactgtatttggctacataaagaaactacaaggaatattttaaaaacactacacaaacacaaaagaaataaggaccacggaatcaatttgggtcacactgtatctatgtgttcctgagaacattatcactgcctggttgtcacgctcagttctcccttctacaacgcaccgcacatccaatccacaagcacacagaattccaagaacattaccaaatattaagtcagagcacttctgaaacacaccttgtaactgtccacagcttctgcagttcatattagagctcagcagcttctctttatcttcaccagtgatgtaaatacaaataccatacatcactcatcaaaacaaaaacccccacaattagcaataaatttattgcctcagagataaatctcctctgttaacccaaaccaacattacatcttgatgtaaacctaagcacatgctgagcaccccgccgcttatctcctctatcatttgtttctaacgatagctgacaaactagccacacaaatccttttttagctgctgatcagacagatccccctttgacaatccagcatggtggaacactcgaaaattcttcctgcttctattctattgcttgctctaaaacccggtttccttttcattgagataatagccttttctgcagtcacatgactcagaagctacattagcagagctttatgataatagactgagtaagcctctacccctcctgctattaagggaatgtctttttcttttctctccctctctctccctctccttctctctcacacacagtctcagactcagtctctcactctctcacatacacatacacacgtgcatgcaatgtacacatgcactcacatacgcatgtctaaaattatttagtcttggaatgttcataataaataaaaaatatataccctaaaatgaaaatataatttctagatctgctgctaaaaataaatgctcaaaacaaacattctgatgcatggtcttcctttcactaggatgtactacactggccatgaacagtgaggggcagttaaaagcaaatatatactctcttgagctttgccctcaatgatataaatctgacaaatctggcataatgaacactttggagacattatagctatccacatactgagaattaattccctgtattagtaaaacacatgtaaacatactttttaacatcaaaatgtagtcttgttaagaatatatccttattaagtaatttataatttgtcccaagaagaaaaatattcccatggccaaagcatcttaaaaaataataatcagaagttcctttaaggctggttacctttgtccatttctgataaataatcaactctgaaaacacatatctggaaacaccagcacagtacctgacacacagaggctgctccatgttttttttaaatgtccttagtaacaagtagaagcaccagatcaaaagaaagcagctgatcacattatattcctactttatctttggttatggtttgtttcacattaaaaattgttcttaatccatgaagcaagcaatttgaggaagaagtttaaatgtgagagtgctgggtagttgaaagtggggaaaaagatggtgtaaggaactacgctcaagtgcaatgtgcaaagtgaagaatgctgtacacgaggagactaaaagaatgacagattctgttaatctgaagtcaacagaaatttaaactatattttacatttcttggttgtaactggcttcctcatctcataaatgcaaaacatatttttaatatatatattttacttttaactgtggtaaaatatacataacacaaaatttatcatcttaaccatttgtaagtgtacagttcaatagggttaagcacattcatactgttatgcaacagatctcctgaactttttcatcttgcaaaaccgaaactctacacccatttaacaactcctatttcctcctcccctagcccctggcaaccaccactctactttctgtttctatgagtttgagtactgtagatacctcatataagtggaatcatacattaattttcttttgtgtgtagatacttcatggattattttaataccagatcaagacagagagttttcatttcacaaaatcattttacataaactgcattattcataagtaaaccaagccaaacttatattctttaatacagaaaaaccaagaattattacagataccagaagggattattatcatataaaagttatctatacaaaaaattctctaagttctcagaactcaaagaatttaacaactccaattccaaaactcctagtttactctaattaaccactcaacatagaaataaataggatagaatgagtgtttactaattctctttaagtcactgaagggaaccatggccactctggaagacaacactaacaactaacagagcctgaaatgattagtgaggtgtcagggaacataagtttccataaagacctgagcaaagaaattcaattaggaaataaagtaatttcagagatgaagaaaataaacataaaaaatttaaaataccagcctatgccaacacctcataatgaaaacacaaaaaagcacaattcagaatttttaagataatgttttaattgctaaagaacctttaaaagttataatgatttttaccaccacctaaatattttcattatggacttaaaatctaaaatcaataatcagccaaggcaacatatacaatcaatgcaatgcaatgcaatgactaaaatcaataatcagccaaggcaacatataaaatcaatgcaatgactgcagttttaaaagactagcaaaaaactgcagggggtggtttgtgaaatccgtctacccaaatgtgttctttttctgctcacaaggtcatgaaacctttggcaatcttatagatcacttccatagagagagcgtgaggtcacagacacgctaacattaacaccatgtgtcctttattaactacaacggcgcttttacaaattatttctcagccagatcatgggcagcagcaaaatgctgtgcattccctgaccagatcaatcgcagctaagataatgccttctgccaaacaaatctaagtaaaatgtcttgatccagattctgtgcttacacttcaagatgtattgctgttagcaaatctgtccctctctcatattttctgctggcatacacgaattggtaaaattgcctaactctcctcctgagtgcagaagatagcaacagcagattttatcattagcaattttaaacttttttcttcaccaaggcagtagtgtttacaagggaattagactagataatttgtcaagttgtttttagctttaacattttatgatggtggttgtatataatggtggttcatttcttaatccaagagtctggtgagaagtaaaacaaggattcaatagagtaatgttttcatttttaaattgaggtacaatttacattcagtgccatatacagatctaaagagaagagtaaagttcaatagttgagacaaatgaaagcatctctgtaatccaggctcctatcaaaatgtagaacacttccatcactctgcaaagttctcttgtgcctgttctcaggcaaactccacatctcctcatccctgccaacaaccacgatactctgattttctgttaccacagattagttttgctttgtctagaactttaaataaatgaaatcatacagtaagtactctatgtcctggctcctttcagtaccaagctttcgagacgcatccatattactgcatggtcttgggggattgcttccaggagctccccctggataccaaaatccatggatgctcaagtcctggatataaaaggtatagaatctgcatataatctacgcatatcctctcatatacacgaaatcatctctagattacttatgatacctaataaaatgtaagtgctatgcaaatagttgttatactgtattgtttcgggaataatgacaggggaaaaaagtctgcacatgttcagtacagacaaaatttttttctcccgagtattttctgaggttggccgaatctagtgtgcagaacccaccaatacagagggtgactgtatagtaacaatttgtcccttttcactgcttaggatattgtatgaatataccacagtttatccattctcctattggtagacatttaagttgtttccaattgggagcttgtgatgaacagaattctgacgtggttctgcaagattctccaccccccggatggacatgtcctgcacatttcctaggactgtaaatatgacagatgtttttacctctatgattagtttatgttacatggcacaactggctctaagaaagaaagataaccagggtgggcctgagctaaccatgcattttctttgttagtgtacccgatggggcaggctcctcagcattagagcactgacattgaagagcagacaccataccttttatccctctaacccacagcagcatctgtcctagtgctgcttctatatgatacacggtcaaaatttacatactgatatttctttttccttaaaaaggtgattacgttgcaatatgaaaaaatgcttttgaagaggccactttagagggaggaaagagcatgcactcagagttagacttttgcccgaatacatatgccagatatgcagtgcctgagcaagttacttaacctccctgtcttaggttccttatctataaatgtgtgtctctggggtagagaggatgtttatactactgtattgttattgtgaagagtctatgaattatatgtaaagcaactggcccagtgcatagcataggaagacatcaattgatggtagccaccattagctcttagtttgatatcatgttcagcaaaaagaagaaacagtatctgtatatcaaaactgtaggccgggtgcagtggctcatgtctgtaatcccagcactttgggaggccgaggcgggcagatcacctgaggtcaggagtttgagaccagcctggctaacatggtgaaactctgcctcaactaaaaatatgaaaaattagatgggcgtggtggtgtgtgcctgtagtcccagctactcggaggctaaggcaggagaatcgcttgaacctgggaggcagaggttgcagtgagccgagatcagaacattgcactccagcctaggcaacagagagagaatctgcctccaaaaaaaaaaaaaaaagaagaagaagaagaagaagaagaccaaaaaatgatgatgagagttaaactgggtgagaccagaggtcattttcatcctaatttccaaacttttagtaatgtcgttttcatcatttaaaaacatggcaaagaccaggcacggtggctcatgccctgtaatcccagcactttgggaggcagaggcaggtggatcacttgagctcaggagtttgagaccagcctgggcaacatggtgaaacccatctctacaaaaaaatacaaaaattaggcaggtgtggtggcacacacttgtagctccagctactcaggaggctgaggtgggaggatcatctgaacctggaaggccaaggtctgcagtgagccatgattgtgccactacactccagcctggttgacagagtgagaccctgtctcaaaaaaaaaaaaaaaaaaaaaaaaaaaaagtcagccgagcgtggtggcacgcctgtggtcccagctgttcaggaggctgaggcaagaggatcatttgagcccaggaggcagaggatgcagtgagctgagattgtgccactgcactccagcctgggcatcggcgagaccccatttcaaaaagaaggcaaaaatgtttatataacttctgaagctgggtatgaagggtacatggaagtttactatactattctaaatttctataatacaaatgttaaaaaacagagtccactgttccaaaaggtgacaaatctttaatctataaagatttcttctttacacactatgaccacatatttattaattaaaaatgagataagctctgaaggtgacatgtttaacaagttgcagagtgtgaacttttcagtcatttgtaatattaatttgtaaacccattagcattgtaattccatactacagctaaatatcagatttttaaaacctgataaaatatcatgaaataatttatatgttaaatacatttttaaatgcagtgagaaatacatttcataaatagtaagatagtaagggaaaaagtaatactgcccatttgaatttattgtttccattaggcatagatctgcatagaattaagtcacttgggcctctgacctccttcctcaggtgagccagggataaagaaaagggccatctttgaatctcctgcttgtgggtatcatcccactaacattaactagagagttttttttcttgatgtgtaggaaaatgagccttagaaaaggcccaactgtgctaagctagcagggactgctattttgttgggttatttccaataaaaagcttatgcaaacagcagtgcataaatgtctatgatactactgcagtagattatacccacacaaaagagggctgaggagaaggactatagagtgcaatcacttctaaatacgactctgccaagttaccacttcatgaaatggaataatatacaaatagcatactacatttccatctcagcatttgtacttcatccaaggatttcagaggcttgaaatgactgagttaaattcttcctaattagcacactgtaaaccactctaaagtaagtcgcctttaaaaatgtatttactccttgaagtcagtggagtatcactaggttaaaactgaaattcttaagtcatctgttaaccagagttaatgagaaccctaatggtctatccaggttataccttataaaccttgggcttccaaaaatgccaaaggctcagagaaagatcccaagaatttgattcagtattaatccagctctttgagatcagtattactcccaaataagtctctgacagttttaatgaacaactagaactttaaaaggggctaaaaagaatgtgagagccatctaggcctgggaatctcaaagtcatccgtttcaaattctcagacttggataaccattgtctctggttagacttttccagtactgtcattccctatatccacagggtattggttccaggacctcccatggatactcaaatcctcagatgctcaagttcctgatataaaatgatatttgcttataacctacacacagactttaaatcatttatagattacttataatgcctatacaaggtgctatgtaaataattgttatattgtgtttttaaaatttgtactatttttattggtttttaaaaatatttttgatccatggttagttgaattcaaagatgtgaaacctgcaaacatggagggctgaatgtgcctagctttagaatcatttacgtactaagtaaggagaatctcccaaactgttattaagtcaataagtaactgaaagcagagagaagatcatactacttaagtagtggtagttagtggctggctgcagtggctaacgcctgtaatcccagcattttgggaggctgaggtcagaggatcgctcgagcccaggagttcaagaccagcctgggcaacatagtgagacactgtatctatttttaaaaaataaaacaaaataaaacgttagagggaatggaactttcagggtacaacatatgctctgaccatgatggcttaatggccctacataacttcttcccatccttaactctggtgggttaaccagatttgctcttctgactctaccattctctggttctcctatgtattaacttttcccaaatagagtcaaaagaaagtgacaatcacatacgttagggccctgaagaaacctggctcctcaatgcatcaagtattacacaggtcattggtattaaggtttttatgtctttttttggacagcctactttgatgaagattagactaattaatgttttcatttattcgcagatttgaccatacaaatagaattgtcgaagacaaaaggctactctttgtagagatgttatattctgaggcaaataattaattattcatctattccaaatttcaacaggcacaatagacacttgtgacaaaaggtgctagggaacatgtgttttaagttttgtctgcaagactgcatctctcacagcatatcactgcttcttagcaccttcagcctgttctgactcaacttcaagtgtactgttaaatgcttttgaatgaggtttatttctttcacctttcctttcctttcttctgttttctacttattcttgtcttcctctcaaatttttgtgaagattatttatccttgtaaggaagagggtgataactgcagtcacagtggcaagcatgggaaaagagggaaaataccattagcagaaaaaagacatatttccttaaaggctcataagccatagtaatagtttataataatgaaaaagtactttttatacctaacttgatgtcttctagttctttctttttttagctctaagttaatttcatccaacaaacacatattcagtaccaatgacgcataaggcactaggtctccagaacaaaatccctgccctccagggactcataatcaaagagggaaaatagaagagcaggcaaaacctagaaaacataatcagaatgccagagtagaaatgtatcaaaaatgatacttgaattagggacaatagttaggaagtgtgcaatatcactgagaaatgatgaaactctgaacttaaccttaaaatgtcaaataccgcccagaaaaaaacaaaacaaaacaaaacaaaaaaacctctcacatatatggtcaaatgatttttgacaagggcaccaagaccattcaatggggaaaggatagtcttttcaacaaatagtattgggaaaattggatatcctcatgaaaaagaataatgctggagccttaccttacgcatacaaaaattaactcaaaatgattacaagatctaaatgtaagagagaaaaagttaaacaatacttagaagaaaacacaggggaaaaacttcatgacacaggatttggtatttcttatatatgataccaaaagcatgggcaataaaagaaaaataacttggatttcatcaaaattaaaaattttcgggcatcaaaaggcactatcaacacagtgaaaaggcaacccatggacaggcaaaaaaactgcaaaccgtatatttgataagggattgacatccagaatatatgaagaactcctacaactcaatagcaaaaaacaaggaatctgatttaaaaactggcaaaggacttgaatacacatttctccaaagacgacacacaaatgggcaaataagcacatggaaatatgctcaacatcactaatcattagggaaatgcaaataagaagcacaataagatactacctcacacccataaggatcgctactatcaaaaatatagaaaataataagtgttggtgaggatgcagaaaaactagaacccttgtgcattactgatggcatgtaaaatggcacagccactgtggaaaacaaaaatttttcaaaaaacatgatcctgcaattccacttctgggtatgtatccaaaagaactgaaagcagggacttgaatagatgtaagaacacatgttcatagccgcattattcacaatagccaaaaggtgaaagcaactcaagtgtccattgacagacgaataaacaaaatgtggtacacaatacagtattattcagccatgaaaaagaaattttaacaccagctacaacataaacgaaccttgaagattatgctaagtgaaataagccagtcacaaaaagacaaagattgtatgattcctcttacatgaggtagtcaaatctttaagtagctacagcaattagaatggtggttaccaggggcgggcgggggtgggggcaggtaggaatggggagttaagagtttaatgggtagagtgtttaacgggtaaaggaagatgaaaaaattgtgaagatggatgttgttgatagctgtataacagtgtgaatacacttaatgccacagaactatacatttaagaatggttaaaagggtcaattttatgtatattttatcatacttttttgaaaagtctaatataaatatttctttacttagcaaatgtaaaaagtgcctctcaaatttttgcttatactttcaacattctaactcaatgaaagagtattctttgtcagctgccaaattaggaaagactttgattcacaagaaggaaaacaaaataaaatttaaaaaatacttttatacctcaatggttaaactgaggattacctctgacccataaggagagaagccaagtggcaacagacacatgaccattccttaaggaaagagatctctggtctgttctacaatgattggaacccccgagtctgtcacaaccacctgttgtgtgcccaaggtttcaagcaactcatgttaatttgtcagtagtttggtaagtgaaattacccaagaatttaaaagtattttttgccaaacttaaaaaacaggagatcagaatcatgtatcaactaaacaagagaaactcacaaaaagtgtagaaaagtataggtaattttatttcagaaatgaaagaataataatttagatccacgctttaagcaagccatgaaaagcatacataggtaattctatataacccaagctaaccgataattcccagtttatttatattttactgtgtaatacagtaatatgtacataccaattcaaagacaaaaatacacagacacaaaatgtgactttgaatctctcaagggtgagccctatcgtggaatctatcacgttcggcacatacacaacacatatgctgtggttacctcctctcccctcacacagcagacattgccaattaaatcacttttaagcctgtatgtggcctctcaattctcctcaacacagcactccacacaatcactataatcaataggaactggcaccagagattgaagcatgcttgccaccccagcaccaaggtgagagtcgggggcagattaggcataacgatgaatcacacacaaagaagatccagtagaacctctgctaatggaaagaagatctacacacaacagcttttccaacagcagcttgctacatgaatggaagctgaatctgctgacttgaagctgctacctttccttcctaagtctgttttggatgtgaataaagattcagccaagtcctcagtgatgtaataagctctgtggttctttacatacagaaaccttttacccttgacagaattaacgaactgagagacacatttaaggatatgttcttatagttttgttactgctactacagaaaaccttccctagcaagaggggaaggtttccagattggccagccactcaccacctgtccctctcattttgctgcttcctcccaggtttctactcaaactacattcctaaccattcctagagaccagctgacagaacgggaggcaaggaaatggaggcagatttgcaagtgacaaaaacatttttcagagacaagctctcaaccaggctgccattgctagtagtaagtgaatcttgacaagaacagggactaaaggacagattttacagtgctgctgcatggaagatttgggaccacagctgccttacccagtcaggtcaaaccatgaagaagcagtagtattgtttttgttgtttcattatattttccaacataaacatggccgacttcattgtaaaggtgccccattctttataccatttgacagactgaagagaaagaaaaaagcaataaaggcatactattttattattttttaaatcaaacacttttagtgcttaccatatgccaaatattggtctaagctttttattaatattcacatccatttttttcagagtaccatggagctggtactgttatgtctcccaatttacacatgaggaaactgtggcacagaaaagtcaagtaaagctaaagtaaatgggttaggattggaattcatgcagtctggttccagagtctgtgctctcaatcacaatacaaaaacagagggcacctgtgcctactgtctcattggttcctccaaatctcatgagattggtttcatcctccccttttagagatgaaaaaacagtgaagtgaagtaaattactcaaggttacagagtagaaagactgcaaaacaccagttatttactgggcacaaacaatgtgccagccactctgataggcgtcatcttctaatcctcaacagccctatgacagaggtactagtttagtccactttacagctgaagaaaatagggctcagagagaggtctggtagtttaattggggccaaattagtaagaacagaagaaatttaaactcacaccagttgagtcccaaatccttggtttttcccttctgatgctgctataaataaaacttcatatatcagttacaatacatagggttacaaagatgattcagttccatttaagaagcttacagtatattgaaggagaaaggtcagttattcaaatcactataattgccatacatttattcaggaaccattccttggggtccttcctaaatgtagggcactgttctaggcactgcatatagcagcaaaccaatcagataagtatctttgccctcctgacctaacaatctagagacagacaataaacaagataaataaggaaaagacatagtatgtaagatgatgataagcactaaggagaaagagcagcaggcaggaggattagagaagagggcaggaggtggacatctgagatggggccgtcggggcctcccctgtgctttgctaaactaaggcagcacgcctcacatcgctactgccaaaaccacccccgcccctttccaaatgccatagggtcactggcccttgagaaccacacagagactatagtttcctgccattctctgaagtcttgtacaacttggcctctaccagaaaactttttccctgttgtcccttggcttcaatgacactggcagtatcttgcttctcccttcctacctccctgatctgtcttggatctgcgtctccctgtcactgagccccacctccgcaacaacagcaaaaaaaaaaaaagaaagatgagcatgtcttttttcttttcttttttctttttttgagactctgtctcgctctgtcacccaggctggagtacagtggcacaatttcagctcactgtaacctccgccttctaggctcaagtgaccctcccacctcagtctccccagtagctgggatcagaggcacaccaccatgctcggctaattttttatattttttgtacagataggatttcatcatgttgcccaggctggtctttaactcatgagctcaagtgatccgccagcctcggcctcccaaagtgctgggattacaggtgtgaaccacctgtaatgcccaatgggcatttcttgaataacatccttgccctttcttctcactacaaagctgctccttgaaatcttgtctgctgatgcagtatcaaagatcatattcatgtaaatgagacccaattttcatttgtagcttcaggatatcaccttagctactaccgtgcccaactttcaagctctcataaacgtatctccctaaatgtacccaaaattgaactcctcacctttctgaggaagtttttctttatctgctatttttttttccccaggagaggggagataggaaatctgtatctgctacttttcataagtcaccagcaaatatttttaactccttttttctctcaatcttcaaatccaatcaatttccaagacctttagattctacttttgcagtttctcttcatcacatcaccttctttccaatccctctacaattatcaagatttctttctcttcagtaaccccaccaccaataacttcttctcatgccaggtctctcccttactcaatctatcctataattagcaccaagttattaggttacaattccctcatgtgtaacatggagatagaaattactgtacagtactgatttgaggattaaacatgattatattaaccatctaacatagttcttaacatatagtaggaactcaataaatgtcacttctctttttcttactctctgtgaaatcaaaacagtgacctggcattcaggggcctctgcaatctacccagttccctagctctgtccatcaaatattcccctagctgtatggtgcacgttccaaccaaactcatactgtgtgcagtattctttgacttggcctggcatttttatgcagacagatcactgctcatgctttccatccttacattttgagtgacctttccttccatcttccgcctaagtcttactgaccctcaaaggtttattatctcaatagctgctgcctcagaaggcctttcttaagtgcttcatacaagtgagaccttcccctctctctcaatcccctgaaaccaatggactacgctgacagagccttttggtcagtctataaatatgtgcctgtatcaggaaataaggacaaaaaagtagaaaactattcatgttatatcatggttattactgtctatgtacttattttgccctaagtatattataaacatgaaatagaccagcatagtgattctattactcatcttcgtattccctacaggacttattatgataccttggtacataatgtaaacttaaatttgatggtagtcacaattattttgttatacttcaataacattttattccagagaatcataaagggtttcatagagaaaaataattattactaaaagacatggaagagaaattactattatttgtaaaatgttagatgaagaaatatatatagagcaattatgtacgtaaaactttaccatgatttaaatatataaaactagaaatagaatttagagtcttagacacttaacctcaaacttcagttgaaaaaatattatcaaagcaatgattaaataaaaataagaatcactcaataaaacctcaatccttatactaaatgttattacaaacttctgtgttttgttattaagagagctctcgcacataaaagtcttataactgggaatcactatgccatatgtaaacagaaattaaaatggctgaataaagaacaaattcactgtactgagtccctgattcggtgttaaacacaagggttattagccagcaggatgagtcaaatacaaagtgtaaagaaaatctgacaacaagacaactcctctaactcatcccttcctggtcaacaccactaccaggaaacaaagttacaaccataaccctccttaacaaagttaaagcaaaatcaaataaagatccattttccagtagcttagatgctgtcaatgtatgaatatatgcttagacaatggaagtgagtttctgtgttttgctttgtttttttgagacagggtctcggtctgtcgcccaggctggagaacagtggtgttatcacagctcaccgcagcctcgacctcctgggttcaagtgatctcccaacccagctaatttttaaattttttgtagagacaaggtttcaccacgttgcccaagctaatctcgatctcctggcctcaagcaatccacccgcctcagcctcccaaagtgctgggaggcaccatggcatgaggcaccacgtctggctggaaatgagtctttaacatctcaaatgtattatttcttggcctgaaacttccaaatgaattttaactctaaaccaacaaggtagagtctaatgaggatgaagggtctatctacatgtggggctaaggtaggcacatacctaaccatttgctttaaacattataatgaacaaattaactgttcaacttctagtgttaactatcacaagcacaattatacagtcaatttaaaattactgaatagtacactaacatccatgttctactcttaaagatactaaggctgtcaatttgttttccttaaaagcaggaacagtaacacttattttaaagggaatctattccttaaaaaatggactgtctgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactttcacactgttgctgggactgtaaactagttcaaccattgtggaagtcagtgtggcgattcctcagggatctagaacaggaaataccatttgacccagccatcccattactgggcatatacccaaaggattataaatcatgctgctataaagacacatgtacacatatgtttattgcggcactattctcaatagcaaagacttggaaccaacccaaatgtccaacaatgatagattggattaagaaaatgtggcacatatacaccatggaatactatgcagccataaaaatgatgagttcatgtcctttgtagggacatggatgaaattggaaatcatcattctcagtaaactatcgcaggaacaaaaggccaaacaccgcatattctcactcacaggtgggaattgaacaatgagaacacatggacacaggaaggggaacatcacactctgtggggtggggggaggcgggagggatagcattaggagatatacctaatgctaaatgacgagttaatgggtgcagcacaccagcatggcacatgtatacatatgtaagtaacctgcacattgcgcacatgtaccctaaaacttaaagtataataataataataataataaatggactgtcaagtaaaagtttctagctaaaaaatgattaacaactaaaacatttacaaaacgcttaccaaaaaagggaataatcacaataattactgaaacataaactagtgagtgaacaaagcagacattttactgggaaatgccacaccacccgagcccctattataggtgatagtaaagataaaacagcgtattacataaaaggtgactcttcaaagctaaccctctcccttgcttatatgacgatatgcttttatagaaaaaaattttaaaaagtacaaaatggtaggcatgctccagatgaggggggaaaagtggatacagcaaacagcgaatatgatggccaaccactgcagataaatctaagtcttcatttaggaaaacatgtaaaataagttaaaaatttaaaacttcagtatatatagaagatattataaaataattataatataaaaaattagcaagcacctcacactctaataccatctcaatatcaaagcttcaaattaattttgagaccagcgaatatttattgagtgcttattaagtgctaagcctaatggtaaacactttatatatatctcctttaacaacatccctatgaagcagatatttatagtatcccccattttatagtaactgtcagagcttgatttcaaacccagagtctcacttggttcttttaactgttatcatatttactgtactaactttcatataattttaatgattaagcacatgcacaggataatcaacatgtccagtcctctggtcctacaggagttaccatatggatttttaaaacttacacaccttaaagtacctttacaaagaggagagaagatgggaaagttgaatcagggttactcttaattgcagttccttgaatcatagcccaaatacgagcttggctggtactgctgcgggaaagattcaaaggcaaaatcaagcacccatgctgccaggcaaggccaggtctctcaacaagtggaataccaacttttaaacaggttggacatttaatagaggaaggacaatggggccagtggacacaaatgctaaaaaaacagtggcagtcaatgtgggaggaggcaagaaggcctgagaaggctgctataatttcagccttgatgcaatagagattgtatttcttttatctttagggaagtgaagtacagtagtccccctcatcctcgagtggatgcctgaaaccacagatactactgaactgtatatacaccggtttttcctatgcacagatacctataaagtttaacttataaattagacacagtaagagattaacaacaatagttaataataaaatagaattataacaatatactgtttacaatttcagatagaaaattcattattactacagattttggcaacctcagcctatgattgtttttgtcaataactttcactttttcacttaaaggaagcactttacagcttctcttcagagtatccaaattgccagcatcaatactcttgtgccttggggccattattaagtcaaataagggtcactggaacactagcactgcgatacctagacagtggacctgataaccaagccggctactagatgactgatgggtgggtggcacatagagtgtggagatgagggacaaagggaggattcccctcctgggcaggacagaacaggatggcgggaaatttcatcacaatgcccagaaccgtatgcaatttaaaactcatggattatttctggaatattccatgcaataaatttgggccacagttgaccgcagataactgaaaccacgtataagggtgcacaactgtagtgaccaaacagattactccgtttcatgtaagtggtatgatcctttttccaaaaaaggtcatctttttcaccaaagttgatctgatatagagttctatcatattaacagagctagttaaccaagggttaaaaattccacctgaagtatttggaatacacatcaatatctgtaagtcaatataaaaaacatcaccgggaagctgaggcaggagaatggcgtgaacccgggaggcggagcttgcagtgagccgagatcgcgccactgcactccagcctgggcggcagagtgagactccatctcaaaaaaaaaacaaacaaacaaaatcaccctacagttaaatgggcaaaatatattaacaggcaattcagaagaaggaatcagaatggccactgtgcactgtgtaatctcaacagtaatcagaaaacgcataatgaaactgaatagtgaaataccatttcatacccctcatgttattaaaaattaagtcttaaaaaaaacagtgggccaggcgtggtggctcatgcctataatcccagcactttgggaagccaaggcgggcatatcacttgagattgggagtttgagaccagcccgaccaacatggagaaatctcttctctactaaaaatacaaaattagccagacgtggtggcttctgcctgtaatcccagctacttgggaggctgaggcaggagaatcacttgaacccgggaggcagaggatgcggtgagccgagatcacgccattgcactcatccagcctgggcaacaagagtgaaactctgtctcaaaaaaaaaaaagggggattgactgagtgcagtggctcatgcttctaaccccgccactttgggaggctgaggcaggaggatcgcctgaggccaagagtttcagaccagtctgggcaatataataaaataattagctgaacatggtagtacacacctgtagaatcagctccttgggaggctgaggtgggtggatcccctgatcccaggagttagaggctgcagagaggtgtgatagtgccactgcattccagcctgggcaacagaatgagactccatctcttaacaacaacaacaacaacaaagtcttataccaaatgtcaacctatatacttcaggctccaatgtaaattggaataaattgaaaatatttaatgaagctaaaaatcacatacaacccagtctagggatattaccctcataggtaatactctaaagaaactgtcatatctatgtaaggtatcatgaacaaaaatgttcactgccggaatacttgaaattggaaaaaattagaaacaacctaaatgcagatcaagagaaaaactgataaattgtatatgttcacaaaatggaatactgcacaacatttgactgacttgcaactacatagatattatcaccaaaaaaaaacccataatgttataggaaaaaaagaagttgcagaataatatgaatagtatactatttaactgagctttaaaacctaaaaaaatactaaatattataaacaaatacacaaagagtaaacttttttttaaatgggtataatacacaataaattctggatagcacttacctctaagaaaagaagagaatgatataaataatccaaaaagggcttaaaattacatgtatggactcaacgtctatggggcacaatattcataaattgaagtcctgacccctaatgtgatagtatttggaggtgaggtctttagggagtaattatgtttagaggaggtcatgagaatgggatccttatgatggaattagtgtccatgtaagagaccagagacttccccttctctctttctttctctccctgccatgtgaggatgcagcaagaaggccaccatgtgtaagacaggaagagagctctcactgggatccatgctggcaccatgatcttagactccctgcctccggaactgtgagaaatgaatgtctgttgtttcagtcacctagtctatggtattttgttatgacagcacgagctgaaacagttaagtgttatatttttcaacaggtaaaacataacaaaaaactaaaatccagattaagtgaatgacatagcatggcagttctcaattagaacacactaataagacactagttctcagagaacaactttaagactattatcctatatataattctattttttaaaaaaatactgacttcctcttcttcaaaacaatcagtaatcaggttctgacaaatctttttgatgtcagagacactcagtccatttggaatgccatccctactgttctgaaccaacgcatagcctctctcactagtcttttcacctctgatctattttctctccaatttccaaattcaccctgtgtaccaagagcaaaccagaaacttcagttttttgttgttgttgttgttgttgttttgtttgtttttttaaagagacagagtcggctgggcgtggtggctcacgcctgtaatcccagcactttgggaggctgagggatcacgagatcaagaatttgagaccagcctggccaatatggtgtaaccccgtctctaatacaaaaatctctaaaaatacaaaaattagctgggcgtggtggtgcatgcctgtaggcccagctgctcaggaggctgaggcaggagaattgcttgaacccaggaggcagaggttgcagtgagccgaaatcgcgctactgcactccagcctgggtgacagagtgagactccgtctcaaaaacaaaaacaaaaacaaacaaacaaaaagagatggagtcttgttctgtcaccgaggtgggagtacagtggcacgatcacagtttattgcagcctcaaactcctgggctcaagtgatcctcctaccttagccacctgagtaggcgggactacaggtgcaggccaccatgcccagcttcaagggcaaatcaatctacataaaatgttactttggtaatgtcacttgttagctcctggaatttaactctttgacagcagccattgctgaacaatacaatgaaaactccttaatctagcatgtaaaggtctttaagcctggctcaaagcggttatttctaactgtaccttccattactctatataaatggctccctctagccaaactgctctattcaaagccctgcatgggctttgctccttctcacctcttctttggtcatcctgtgtctcctgtttggaatgccatcctctctaacaccacctttctcacagtatctaaattttagttgtcttctaagaccttgccacacaagtcttatctaatccataaatgcctccctaaccaatacactctaatttagactcattcattcaatcaatcaatatttattggatgcctagcatgtgacaggagacacagttctaggggcactcacagaatgcctatatatatactacgcatgaattaaatactgttttgctctttttgttaatgtatatgtcaacctcaactacattatgtgcttcttaaagacaaggagttcatttattccacagggcaataacgtagtactttgtgtttagggttcaacattctctggctaaatgaattttgaaataagttataatcttctaattttttgacccaaaataatcaatgcctatccttggaactttgaacaattacagcattttcttgtgatgtatatatacatctatacaagaacaatggacttggagtcagaaggtctgtgtgaaacctgggctccactgtgcaccacctctggccatattactttctctgtacattaatctccataaaatgagaatatttacacctacctgtgaagatgttcatgactatgaggcataagtaaattagaaaaagacgtattttattgtgctagaagcatgcctcgcactcattcatgaatccaacaaacttttactaggttattttcaacagatgccaatatcctcatttcccaccagaagagctaataaagatctgtttcctttctgttttttttttttttttttttcctttgagatagggcctcgctctgtcacccaggcggagtacagtgacaatcacagctcaccgcaggcctcaatctcccagactcaggtgatcctcctgcctcagcctcccaagaagctgggactactggcatacgtcaccatgcccggctaattttttattttttattttttatttttttgtagagatggggtttcgccatgttacccaggttggaagatccatttcctttctgctaggtgatggaaatgctgtctttgactagtaagtgaaagaaaggaatacctacagaaatattcaaatattcaattaaaatatttgaattacatattaaataatctcaaggccataaaattctatttttaaaatgtctttattctatttatcacataaggcacaaacgttaggtatttataaccttgctaaaagcaccaatgaaaatgggatttggaaaagaatagagaaattaacaaaattgctaattataataaatatgatcaagaaaactttgaattcctctttcacaaaatcgtttttcatatttgacttcctatttgaagcaggatatgtgggaattcattattgatcaactagctagcctacctggtttttcagaagaattatcaacctctgttaggaatccctgctgctcctgctggatgcagttgcccacaagagaagcagctgcttttaaaatcaactttagattgactacaatttggagcctacccttgggaccttcatttggagctcattttttaaaccacaatttggtctctatcctcattgtctttatatacaaggctcatctctcttaatccacagtggctcgaaatctctcattatctctctgtttcagctacttgagaagtccactgcccatctttgacatccaccccagaaagataatttcaagtagaccatctagcttacattatagggctcctcatgtaccctctaaatttaatgatactcaatctagccatttttacatgacatggcaacaaacagaaatttgaacatttaccattcagtttacaggcaaaatcttacattaggtacagtttgactatttttatttgactatttttccctttatttttctttctaagtcaccttttctataccataacataaaatttaggtaattactatataatgcttaagattataggctcttgtgtgacactagttcaaatctgggctgcactggttattagctatgttaacttaaaaaaattactaatatttttaggccccaagagcaaaaaccatcactactgcttcacgggtttttattaatattaaatgagttagtacaagtaaaacagaaaagcacctaacatgaattctgtacaaatcctgcatttttaacatggagtaacagtaacactagttactggagtaataagctataaatatactttcaatgcttaataagactgagcaagtatcattttggttagtaggctcttttgagcttgaaaaattataaacacaactttcccagttgtctccgcagctagtctgtaaagataaatatttatagatttttctccctcaaatttattattttaatacagaaagtggttactagaaaaagcgtggaaagtaaggaaaagtgaagggggggaggacatgcatatttccactatatacactatgtgatatatttacttccaagaattttatatcaaaaatgtaattttttaaaatcagttatataaaattaaatcctaccatttctacctaccagtaccatggaagtatttttccttgttggttcagcctttgacaatataatttttaatagcagcataatatttcaagttgaattcacatattctaaagcaaacgtgggcaggaccttcttgtgacaactgcaagcatacttgccataaaagaatagtgatggagggcctaggtgcagtggctcacacctataatcccactgctttgggaggctaagagttcaggggttcaaatctgggataaggaccaggagttcaagaccagcctgggcaacacggtgagactctatctctaaaaaaaatttaatttaaattaaaaaaagaaaaaagaatgtcagtcgggatccacagtcatgggagtgcaaacttttttctacagcacacacactggcatctttctagtgcttagtatagtcaaaacaatgatggtagcactaagctaataaatacaggaagaaaaaatatggaacaaagttgtggcttcaacttaaatgttaattttcattaaggagcacttccaatttttcactaagacaaactaacaacttcaatcaatatacaaaatatacatgtttgcattccgacttaaggcaagtcaacctaaattcatcaacagtaagaaaaattcatagatgtgcctatgttgaaacttaaattttccatctggtagcttaaggatactttaggttatcagagattttaaaaatacatataacacacatttactgaaacctaattatgaattttgccagattcaacacatactactttaattgactaacggcaaccagtaaaaatgtttcatttatttaaaaaattaccagcttgggcaacatagacctcaactgttaaaaattagccaggctcatttttaaattttatcctggcgcatgcctgtagtcccagctactggggaggctgcggtgggagaatcacttgagccagggaggtcgaggctgcagtgagcagtgatctcaccactgcactccagcctgggtgacacagtgagaccttgtctcaaaaaacagggagaaaaaaaaaaagaagaaaaaagaaaagagaacattagggaagcagcatgatttgatgaaaagagtcactgaacttggaaggcaaaaacttggattcatgtcccagcatggccctcaactatgcaacagccgaaaaattgtttactaactctaggtcctaactttaaagtgtagtccttcaatgatgtgattcctactgtctcttccagctctaaagtaaagatgctaagaaataaagatgataatgctaccattatctggcatgcaactgacggccacgggacaggcgacttattgatgtacatcaaatcctaaacctgtaattttgttcagcagtgtcccagacagtgtgtgctgtagtcggggtggctggcgggggtggggggatagcaggtaggcacagtggccactataatcccattatttgttatataaatgtattgttttctttaaaagtaaaaaaccataaaaaaattctgctttagtcttttctgctaccttggttccctatccctttaacaataacaacaaccagattgaaattaaatatttgagttgctctcattaaagaaacttccatttactttcctggtacacaaggaaaacgattttgaaatctgcctaatcaacagacattaatattgtctgttgaaataaatatgtttgcatagttattttaaaaacaccatataaaatcatgcttaaattcatttattttgaacacatacctatgagcaattagtctaaatataaagaaaaagatgatgaattatatgaattttcaaagcacattaaattagcattgaaattctatgaacatactttagaatgctaactttgttaattttttgtttgtttgtaatatgcaatagaggggaagatatatgttgaaaatacatcttggctcattaaaaacgcaacacaggcatatgctcttttcaaacatctttttaaaccaagaaggagatctttgtttgccatctttcaaataaacattcatttctggtcctgattctaagcaagatacagtatagtaaatgacagatttgctatgtctttgagttaacaaaaaataaaaaacaaggtaagcaccagagtactgtggaacacactgagattattagtattaatttttacatatttcaactgactaaatgtagctataaagggtaccctgactgtaaatttaaactgctatgtttatgtgaagactgtgtaataagcagtcattatgctcttttgtaatctctaatgggaaaactaagaagttcttcctcctttaaaattaaatgccttaataaagtaagatttttaggggaaaaaacactcaactttttaagttgtaaattactgaaagttgctctcactagacttgactatttagaaactacagtgattaaatgctttccagagcttacatgttagtgctttcaacatcaaatgtacaatgagaaacatgtcagcactctgctctgcgaagctttggccttcagtcagcaacagtacaggatggccaggtcctgcacgactgagatagacagaaacgccttagcaaaccagagccaccagatccatcatttgcttctgacagcttgtgcctacatacttgccctcaacccacatgtttgcaaacacaaccttctacacattaaactaacaggctattcctttgctcctgaatcacacaggctgcctaatgaagttcctagctaaatctctccactgaaattactttccataggaaaaactgtacagatatcccagtaaattgaataaagagattgaaaaattgtaggaattcttcacacatgtgtaattaccaaagtaaaagaaatattttaaagtacgtatttattgttgactgatttccaacttacagaaatgtacatacaaacacttgaaaaataaagcttcaaaagtacacacttttttaggattttggaatgtgttcaaacttggcagaaactgtgggatccttgaaacatcaaggtttttcactttttcttcttctttttttaaactgcctgtaaactttcatcaccagtattctgctacaggtatagacatggctaaaatgcattgattcatcctagaaggagggatgtttacagaaattaagccagattcactcaaagcaaagcacaggcttcaacatgaaacccctacccccacctaaaaaaccttctcagcagtaactatctaacttatctacgtgtctcctctactcttcccttaattcttctgtgtcatgtttctggttatactatcatgtgcttccaactttttttcctttgataagagtaattttaagaggctaatttttttttcttaccccacagcagtctcttaactgattggtctgaaattcctttgctccacctcctaacatctgtcacaaaagtcagattataagtcaacccaaaggggagcaaggggtgtgcacgtaagagggaacaccagaaaaatgaaacactagtggttagggcatcactagaaaccataatatagtttctattctttatttgatacaattgtacaaaaggacaccatgttagatataacattaggctgaatgttaatttcctaaataaaaattctctttaaagatgtaaaataataatccctttattattcaatatgtagagatttattaaacacttataaagtaataatttaatatttacagtgaagaaaactaactttcatcttcatttttaaagtaatctctaatactatcagaaatattaacagtgaaatacattaattacaagccaaattatacattgtatgtagctacttaggtattttactaagaaaataactttatctttgatatttcctattttaaaaacttatctgtgaattgatttaatgattgtgtatataaatctgccaaaattatttcaatggatgaaacaatgaatcagtacctatttatatgctgccaaggcacacctataattttttaaatgatgataagagtagcctaaagcagtgagcagacatctcagaaatttcagtgtaagtggttttaacttgcaacatgatgccaaaaaacttagaacagggagctgccatcttgcatccccgtgtgtgtgcacctaatctcagctggttcccccgagaccccctgagcaccaaccctagtcccccgcgcagccccttatccgctgcgacaagatgaaagaaacaatcatgaaccaggaaaaactcgccaaactgcaggcaaaagtgcccattggtggaactgctcacagaaagaaggtggttcacagaacagccacagcaaatgataaaaaacgtcagttctccttaaagaagttagaaatctctggcattgaagaggtgaatatgtttacaaaccaagcaacagtgatccactttaacaaccctaaagcccagacatctctggcagtgaacactttcaccattacaggctatactgagacaaagcagctgacagaaatgctacccagaatcttaaaccagcttggtgcaggcagtctgactagtttaaggactggctgaagcactgtccaaacaatctgtgggtggaaaagcaccacttactactggagagaatgatgatgatgaagttccagatcttgtggagaatttggatgaggcttccaagaatgaggcaaactgaagtgagtcaacttcagtgactcaacttctgaagacaaaacttgaagaagttactgggagctgctattttatattatgactgctttttaagaaatttttgtttatgggtctgataaaatctagatctctaatatttttaagctcaagtcccttggacactacagctcttttcagtttttgcttatacgcaattcattctttgcagctaattaagccgaagaagtctgtgaataaagtttgaaacaaaggttaacgaagttctttgcctagtatacagttttattctttatttcattgacaccgatctgtacacagtaaatcacagtgtagtgtaacacaggtggtataaagttctcatgtttggaaaaaaaaaaaaaaaaaccttacatcagggacacatttaactaaagcaacaagaaaaacttgttttttggttaaaagtgcttggtggttctctgatacatatgagcacctgaaaaataattcagatccatatctactccattaggatactgaagtttccaaagcctacagagcttcagctaattgtaattgctgtgaagggcgagaacctaccatgtgctcaatcttgccatctgtaagtgctttacacaactccagggctttttaagtagggtcaaaaatttacagttatttttttaaactaattaccaatcacaaaattcttttgctttatgtcatccttgaaaaattctctgaataattttggtaatatcccatcataaatttgctcaacattagctctatccacaaatctgttttacattcatattacaaatacagtctttaatgatcaagcaaatatttattctcatatttagcaaaatgattttcttccaaaataactccgaaagatactgcttatagaacacagcaattattctaagactcctttacaaaatcactggtggcctgcaacgcaacaatcccataaaatatgaactgaaaagtattcataatcaggacctcaatctcatcgctactcgtgaactctgttaccactgaagatgctcgctcactccactgtctcacctcttagtgtccacaacagaaacactgaggcatcatctcccgtaattaagatttcggctagagaagtggcacagtaagttataccatttccagacctaacagatttacactacaattaaatatattaaaatttctgcacataaaaaactcatatatacctaatcaaaaggcatctttacccagccagtaggttcatctgtagttctgattattttaaatgagcagatattccaaaaatcaaaataagtacaaatatgccatcttctaaaattctctaattctcaagttttatttctctcatttagagttatcaaactttacttgcaaaactgtattcttaattaaccacaggaaatttccagtaaactgaaatcatcaccataaattcagtaggtataatgagaaatcatctaagagtagaatatagtccttaaaaagaaataagtacttatatatagttgttcagcttattaaagaattgtattcttaaaaatactatataaatcatgtaaatttgaattttattttcaatatgtgaaggaaatttaatatttaaaaggaaacctgctgagttcttttttaaaactgaataatctttagcaatacaaatgatcaactcctacttaaattattttatatgtaggaatctgataccttaaaacaggttgtctatgtagtattactctaattaaaaaaacaaacagctaaccaaagaagaacaagcttagcggagaaaatatgaaaaaaattttgaattaatgtttctaattagcaagggctttcacaaagacataaaagcaaattttgctttcctgattaattagaacaccaacacaaagaactagactctaattggcagttcttctagagaactaggatggaacagatgcaaccaacagtagaatatgtgttaatttttaaaagtgcactgaaaatcttgtgtcatagatatatagatagacgatggttcttatgcttaaacactttcaacaactataaaggctatgtagctggtagtatagcagaaatagtttggccaaaaaatactaaactttgcaaagtttttgtccacttagctgtaaggtaaaatattgactgagatgacctttgaaaacatctagaattgttcctctttctatgaatgattccctaattatcagagacatatttcaatatttgctgttaattttaatggaagaatttcacaatacactcaaagaataccaatttcttcctccaagataaaaggaggcacagatcattaatgtaaaatgaatatgcctaaattaaatgaaaagagaaaaagaaattaaggaagaaatttgggacaggacccataacagcactgcaattaaaaagataaggaaaggaaattctcaggaaagacaaataaatcctccagattccaagatgagaaacttgctcttagggggaaaaaaagattaacattaaagaatagcaaattgaggcgatttaagaagtaaattcaaaatatggcagcaaaaacttctgaatgccaaattttaagtacactgatatagtttggttgtgtccccacccaaatctcatcatgaattgtagttcccataatccccaggtgtctaggagggtccctgtgggaggtaattgaattgggaggtggtttcccccatcctatttttgtgatagtacgttatcactgagatctgatggttttataaggggcttctcccttcactcagttctcattcttctctcgcctgctgccttgtgaaggaagacatattttcttccccttctgccatgactgttaagtttcctgaggccttcctaaccatgtgaaactgtgagtcaattaaacctctttcctttataaattacccagtctcgggtatttcttcatagcagcgtgaggactaatatatacacccgttagtctcaaaacaattctctcaaattctgatatacagacctttaaaaaacagacatcatctacatggcattctaaattttctgatattttcattctttactagccactttcattctgctgtctcattgtctaagtaaaataatttcagaatgaataacataataaagtgtaagtatactaaagcacaaatactttctcttaaaaaacaatttctaagaccccatttaagcagaacctagatttctccaccttgtgttttatccttcattccccagtcccaaccatgggcaagctctttaattttttttccctcgggttcttcatctaaagcaggcgtttttgttttttttcctaattgcttcagtgattacgcaaaaacaaaatgagacaaatgcccaaaaatggtctgtataacatttctgcaataaagcacaaatgacagaagtcactaaagcttgagtgatccttaactgtccaatttccttctgaaactttactatacattactactatctcttgccttttctgtttttccaagtaataatctcttcttttctctatttaccctaaccttaagaaactcacaattcagatgagaaaatatttactggttcttctgtaaagatgttctaaagatgtagctatatctttcggttaaatgaaactaatcctgaaacttttttaaaaataaaatccctacattttaaaataaaatctttgctaaagtacatggtttctttaccttcctaaatggtgttctttggtaatgttaatagcagtattaagggccagacagttgagtaaaaaaaaattacttctaaactaaatgttcccacaaatgctatttttaggtcacgtttatacactattcatacttttatgtgaatttcttaattatcagggtactcactgtcattttttaaaaaatgaatacactacaatttatccatccttctgttagacatttaaattttttccagttttttgctatttccccactgtcgtttttgatgtattccatatgcctgattctaccagccagttttctgttttctagactttactcccatattcatatctttataatagctttaatgatatataatttacatgccatacaattcatcaatttaaataaaatgtacaatagtttttagtatattcagagttgtgcaaccaataccacaatcaattttagaacattattaacactataaaaagaaaccctatatccattagcactcactcccattttctcccactctccaatcccagccctaggcaaccattaatctaccttctatctctacagcattgcctattctggacatttcatataaatggaatcatacaatatatggcctttatgactggcttctttcactaaatttaatgctttcagggctcatccattttgtagcatgtatcagtatttcacttctttttattgccaaataatattccactgaagtatatagcaagttttacttatccattcatcagctgatggatgtttggactgtttttattttgggactattatgactaatgctgctatgaacattctcatattcacgttccatcaatatagaaagtctactaactagtttatggtaatgggatgatgtggatcatagggagcctggatatccacaggagaccaaaccaggtcttttgtaagacctggggtgactcctccttcccttagaagtcagtcacttcctagaatccgcttatcttcatcccctctgccactacccctcagttcacatctcatctggatcacttccacaggctaaacccgcctcagcctccagtattgccctcctctagtccattcaccccaggacagggcattcattctaaaatgaatgaattggcttgggacggtggctcatgcctgtgatcccagcattttgggaggctgaggtgggcagatcacttgaggccaggagttcgagaccaggctggacaaatggcaaaaccccgtctctaccaaaaatataaaaaatagctgggtgtggtggtgtgcacctgtaatcccagctacaaggtaggctgaggcatgagaattgcttgaacctgggaggcagacactgcagtgaaccgacgttgtgccactgcactccagcctgggcaacagagcaagactcttgtctcccccaaccaaaaaaaaaaaaaaatcatttcatttccctgtatcaatccgtcaatgaatccctatggcactcaagattaaagtaaaatggcttaccaagcaaaaggcccttggatgatctcgccttaccaatctccataatcctgacctctcgctatttctgctgcacctatgaggaacaactggagttcattattccaaaggccttgctccctcttctcaccactgaacctttgtacatgctgccctctctgcctggaattacccgcagtaggtgcttccccttatgatggaactgtttatttcctacctttttttcaatatgccatcacctccacaatgacatacactccaagtgagtgaaatgtgtcttttctcattaccagcggatctagtacaatcaatggcatagagtggattttcaacactatttgtggctctcatgaggaaatgctatgcttattagtatacctgaataattcctgagtaagaaggactttcctaggctctggggttgataaaaagctggtaaggaaatacaaaacacaaaccttaaccttggcttacccctctacaacacatgcaagcaaccctcccctgtcaggtcacatggttcatgatgagactaatatccctacttcctcacagcctctagagtgaccaggactagccaaaatgctgtgccttaatttcagccccctggcaagattggctcaggaacaggcaggtaatccaacatggaccagtgagagtcattcctgtaatttttttttagagctatcaggaaagatccttttgagaggggattgttgactgttaaaatgacataaggcagagctgctaatgaccttctctgccatgacgtaaggtcctaattgaaaaaagccaacacaagaaagtagagaaaaagagaaggtcctgatgacatcacttaattccttccatccagacttgccctgagccagttgtagctttggacttcccacttacaaaaggtaataagttccaggtttgcttatactggtttgagttgcatttctacacttgcagccaaggagtccatgactacacacatcaagaatctatcttcttgtgttagtctaccttaggcattaagagactatacctacctttcaagcatctgccattctgcatcaccatttatatagtttaaagctcagacaaagcatatgccctattcttagggataccttagtagaagccataaccccttgcctcagagctgagtttctaccatttcctttggtgggtaaaacaatgaaggtaggctgccagagccagggtagaatcctaagaccctgggaaattgtgacatctgaagctttcaacctataatggggaaaatgataaaagacagcacagaattggaccaactgaggggcgatcgcaattctgttgctttcatccttagagacgtaagataaatcaaaattcatctgttttctcagaaatcaatttgctgaaattgaagggtcaggtttggttgtatagaattcttccaaatttcatgtaagatatagaaatactgacccatacacaatataccaactacttccctatgggtggagtaaataggatagaaccagtttttctgaatatagtgttcatgaaatgttacaaaattgagtgttaatctaaactagatttcttggtgacaggagaagatactgaaattgagacatcatctgtgtcctcagtgactggtatagtacagtagaaagaacgatatgaccaagaataatcagaaaattggagtcaagcataggatctacaccaagcagctttggggctttttcctactagttagttatgcctcatagaaatccattctaccccttacttccaggctctttttccaaaagaatgactttgcataacatcgttgagggcttcccactcatacacgatcttaagaatgggaggccagtgtgagctctgtggagagcatgtcacacgagataatgggcatctgcaggggaaggcagagggctgggaagatgtggtgtacacatctgcatcctggctatggaagcttctaatgtgaattaagcactgggaaccagttattaaaatttaggaaaaaataggctgggcatggtggctcatgcctgtaatcccagcacttagggaggccgaggtgggtggatcacttgaagtcaggagttcgagaccagcctagccaacatggtgaaatcccgtctctactaaaaatacaaaaattagctgggcatggtggcacacacctgtagtcccagctatttgggaggctgaggcaggaaaatcaaccttgaacatgggaggcggaggttgtagtgagccaagatagtgccactgtattccagcctgggtgacagagcgagaccctgtctcaaaaaaaaaaaaaaaaaaaaaaaaaaggaaaaaatacattagaaattccaggtatgaaagactctgcagttgcattaacttaaatctctcttccacttagggagcataagcagctggtgatacagaaaagattatgctgtggcctcttgtagatcaagggaaaaggtgaattaagtacaagtggctagggagcattcccagaaaagcctctaaactaggaaactcatcaccccccacctctttgttttcttggatagtagcagcaaaagtaacaacactcaacagaatcagaggcttccaggaaaagagaaacatagccttctcttccacatatcctgcctgaacaccatgcagcagtccgtggccaagggtcaatgctcaagagctgctcacagtaccagttttgaaaacacactaagctttagaatttcagatctttacacctgcaaaatggagattctacaacaaagccactattaatcagaatactcatgagataagttacgttaccccactatcaccaccaaatgtggttcatcattatttattattcaaagccttcctaaaagtgtatgatataatttcctattttagtaaaatataacattcaaaatataattttatctttctctacaacttaagatcttatagtctgtaggaatatcattctgaatatttgataccaacacaaaataatgaaacctaagaggtgagagataagaccaaatgtctactaaccccaacaaattagtgtgtacatatatatgctgatttctaatttcctgagattcaatttaacagcaatgtaagagattaaaatgctatttatttgagcatctcaatatggggttcatgttaatccaagttcattatatccaactagatgtatacagattgattataaagattaataaagatatatgatcatgcatatatcaaggactacaaaaacaactgccaacaaaaagactgtgcaggcaacaggataaccttattatgggtcccgtcttttctactaattaattacatgaaatcagccaggccataaggccgggcacggaggctcatgcctttaatcccaacactttgggaggccgagacaggtggattactggaggtcaggagttcaagaccagcctggtcaacatggtgaaaccccatctctaccaaaaatacaaaaaaattagccaggcattgtggcgcacgcctgtaatcccagctactcgggaggctgaggcaggagaatcgcttgaacccggaaggcggaggttgcagtgagctgagatcgtgccattgtactccagcctgggcaaaaagagcaaaactgcctcaaaaaaaaaaaaaaaaaagtagccaggctcctggacttgtttcttcccaatcataaaattttcctgtcaaaaattccatgattcgttcaatattgctaataagagagtcagctggatactactagggttggtgtaatattaaacccaagtgacaggacccacatctgatgtgcaatgacgctccagagtgatctcagtgtccccattttctaaaatactaatgtactcacagtgtgtgtgcatgtgagcacacatatgaatgagtgtgtctgttcacaaaaactgaattttcattttagtaaacatccagaaggccacccacaagcagggctaaacactgagaataaaattcagtacagacagagcttggccccaggactctggttcatgctgacttaactcaggatctactagtttatcttctagtgaacacattctgtaattcagtgctaacactggtatcttccttggtttatccacgaaattgaagagaggcttccaacagatattctaggcaaaaatcagaaaactaatggggaatttaaactttgccatcgataggtgcgactagttgttcttagggacattagttaaattgtatcatttttttccttcactctcaaagtggagatgtgtattcgtaataccaaaatgatgcatttaaaatggtcattgatgagtttttaagtgcagagtcacaacagatttctagaagcaatctttcagactgctttcagtattgagtccaggcaacaaatacaatttgcacaagatctcacagctaccacctgggaacaagtgggtgaattaccgactcactgactcttatgcatgtttggttcacttacacctttttctgatgtaagacacaaagatcaaagagcccagccttaacttttatttgctatagtaattggtagaacaatcagtaaagaggtattaaaagtctttatgttgtctacctaccattatacagtattttctgataatatgtcaaaataatacaagataagtgtcccttacccaaaatgcttgagaccagaagtatttcagatttctggtttttttcagattttggaatatttgcattgcactcgctagttggcattccaaatccaaaaatctgaaatcctgtacgttccagtgagcatttccttttgagtgtcatgttggtgctcaaaaagttgagattttggaggatttcagatatgggatgctcaatctacatttatttgtctaattgaatgatttttcttccccttttctccaggtttacaataacatatttagcaataacaatgtttagaagtattcctcttgaataaataagcaacattcccctccatgttagaaacagccccctctcctcactagatgactgccaagaatgacaacaccccttgaaaacagcaaggtgcactagaaatgggatgagagaggctgaagaacacaaatgatcatctgctggggtccacaggtaacatgcttcaccacttttataactctttttagattctcatcctcagaatctctggacggtgctttcaagtgagaatttgtgtgaagccctccttggatacaaatttgaaaaataaatgtcctcctctttctctttcactcctattctccctctaaaaggaggcctgacagggtggaagtagatggaggcaaggaagtagtcacaaagaaaacatgtattaaaagaaaattagtagaaatactcagtgattttcaagagagcaatgtcctagaaaataaattttgtagttgtttatcctcactttctgaaggtctttagctctcatgatactcatttgttcctaaaaagctagaaagggaagactataatagggagggactttaaccctctcagccaccttctcccatccccctttgttacaaactgcctatcaggtaacttcagataatctgtggctaacttaatgagcatccattcttaagggatggtatatacaaatgagggagaacgtgtgtgtgttgtgtgtgtgggtgtggtgtacggaagagagtgtgtattactgaaggggatttcaacgtatcatgagattgttaggaaagaagctttgcctctaccctctggcagcataagtgaagacttttaaggcacaatatggagagaggagacaggagagagggagaagggagaagggagaggggagacggggagagaattatctcaacacaaaaaccacatactagaaaaagaacagatgtcccacggagcagggaagtagaatctatacggggagaacagattagactcaagttggtatcaagaataaaggaccctcaaggtaggctttacattatatgctcaataaaaccagacctgctctacactttccatctgatgtagctacaggtgactacctataaaaaggacatggtcttataatatccttatattcatgatagcttttgagagcctcatgcttaaccatgttttatacttcttcaactagaggtattcttcaaatagaaaatatatcagatacaatttattaaggtctagtaagaaaattaaaaatcaacaagaatttacttagagtcctgtagatacccaagtgttatgagttcctatcatttagcaaataaatttactatgtagttagacaaggtttagaacacagcatccaccattaagtgctcacatacttcagctaagatgataaccaagagtcattttcctaccttttggcacttgagtcccattaatcaagattccccttatttctgtgtttcatttctaactactcctgttgtgatgatctaaaatagatggcaggttgtagccttcatagcaagatacgcacatggcgaagaacactgagagacagacagccatgggcacagtgcccactgcccttcctgcactctatgcctactacattattgtacatttgttgatacactgctttgtaatcccattcacgtaacttaatgtttgccatttctcttactacaccgtaagatgtgggtaggactatatatattgcttctgtatacctaaaacatgactactttactgcatgcactatcattgctccagaaatgagtacagactaaattgaaaaatgctaccggttggatggggaatgaaaaacaaatcagggctttcatgtaatcaacaagttccatttgtatcactagaggaggctctatgtcatatcagaaagagatttttggaaatatatagtttcaggttcaaattccagaactacctacctgacaatatgatttaattcatctctctataccttagtgttttcagctaaaaatggggtaagttctctctcccaagctactggtaagaatttgatgaaataaaaagcatattatgcctagcagaatgtaggtatgcaagaaaagtttccttcttaaatttgcacttctttatattctaatgtataaaaaatatttccaggctgtgtacagtggctcatgcctgtaatcccagtgctttgggaggctgaggtgggaggatcacttgagcccaggagttcaagatcagcctgggcaacataacgagacttgtctctacaaaaaaataaaaaattagctgggcatgttgactgagggaggaggatcacctctgcccaggagttcaaggttgcagtgagctatgattgtgccactgcactccagtctggtgacagagcaagaaaaaggaaaaggaaatatacatatatatttccatctctgttttaaaaagatgtggtcaaacccttgctagaaagtaaatgaaacaaacttttcaagagacttaaccgtgagctacaatataaatactcaaagataaaattttaaaggtggatttaaccagtgatttaagaaacagcatgaattgctcaaacactaaaaacatatttcacattattaattaaattatctttactatgtatgcttagaaattgctttaaaagacaagagaaaaagaaaacggcagttgtgaataaagtaaattctaggtagtaagcaattaaaacctctttttgtgttcatggtaaatactgttaattatatcacagatactcataagcaaccaaaaaccctgtgtattgattgtaaagagcagctgtaatttcccctatatatatttaaaacaaaacaaaacccggggaaatctgagagaaaggatggcctatttttcttaacattttataaaataaaaaggccatgtctgttaaggtatgataatctgaaatatagtcaaaatgaaacaaaaactgtccaatataaattaagggttttttggccaggtgtggtggctcatgcttgtaaacccagcatttagggaggcagagatgggcggatcacttgagcccgggagttagagactagcctggccaacatgcttaaatcctgtctctacaaaaaaatacaaaaattagccggatgtggtggtatacacctgtaatctcagctaatcaggacactgaggcaggaggatcaatctagctcgggaggtcgaggctgcagtgagctatgactgcaccactgcacttcggcctgggtgaaagagcaagatcctgtctcaaaaaatatattaattaattaattaattaattaggtttttaaaagtaattgaaaggattctctagtcactcttagaatgtagtattttctcttttttaaatttttttcttttcactgctggaacaaaagaatgtactcttttctaaatcaaagctgaaatttgctttagaattgaaaactttcttcaactttgcgtaaaaaggtcctatataggcttctgattatgggaattctaaattactttttaagaatttttttactgaataaaacttgtgaagtcatttttaaagagacgaatcaaagggagtagggctgggccctgtttttccatctttcaaaacaaaataaccatgttaatagaaaagctaaacacacatcctattgaaagcattatctgtgtaacctcatttgaagccacgaaacagcataatatcatttctgtaacctgcatttcctttgttaattaatggcagattatcatgtctgataaaataggcaatttatcaacttcatggacttcagtctagctagtagccacaatgatatgagcctgcagaccctcactgtagagaaaatggcatacacagcattaagccttgtcacagccttacctataatgacaaagtcagcctgaaactttattttgaaaattactagttaattcttttttggctttctccgtcttttgcttgtttgtttgtttgttttaagagaaccaagtttcacaagccaaaaactgcaaatgccagattgggctggattcccaatttggcctctaactggctaattaggtgcaaatcactgggcaagttatttaacttctcagtgcctttgtctacccgtctttaaaataggatcataatagcagctacatcataggtttgaggattatgtgaattactatgagaaaggcttagaacactacttggcacatgataagcacaataggcatgctagctattataaatgatctttcagttccaagaattttttattcactatgatgtgaaagaggaagggttattttttttccttttaaaaatatggaggaaataggccggtgtgtggctcatgcctgtaatctcagcactttgggaggccaaggtgggcagatcccctgaggttaggagttcaagaccagcctggccaaatggcgaaaccccatctctactaaaaatacaaaaaaaattagccagcatggtggtgcgcacctttagtcacagctactcggggaagctgaggcaggagaatcgcttgaacccagaaggcagaggttgcagtgagcggagattgcgccactgcactctagcctgggcaacagagcgaaaccctgtctcaaaacaaaaacaaaaaaaaaaaaggaagaaataaattacaatattggaaatagataaacacagggcacacacattacggtttaaaggaacatgcttctgcatttaggatatgttaaaaatacatttaaaagataacagcaatattttacaaaaggctatcatttcctatttccaaaagatactttaaagaggaaatttgaacctgactttgatacgcaatatgtcagcgcacaagtgcaaatagtttatgtgtcagacaataaagattttatgaaattttgtgaatattttgaagcagcagcaacaattaaacatctaacctctatattagagaaaaaatttaactgttcccaaagcatctagttacaaaaaaatctaaattctactcagttaataaaataaaatctactgttttatattaataagaaactcatcaaaccaatttgtccaatagatgtttaagtcaaagaattttatatttctattctattcaaatataatagcgtaagtaatcatgatacagtttcaaaatacatgagttcaaaactatcttctattttcatactctgtcttataacccaggaaacagaagtgttttctggactgtaataaaaccgccacttaaaaggaagaattagtaatctagatcaaatagcctttttaatgacaaagaattgaaaagttgagagatgaactgttttcactggccactactctctatattctagaataagctaccaattcaataattatgacacagctgtttcttttaaagatagtcttttatagtctaggtaaagatttaaaagtctcagtactcatatccaacactggtaggtatcttaaaaatttccccattcatccttccactgaaactctggcctatcacatccttgctttcccagttcttttcacttctcagggaaacatgataaaaccatgctggggttctgtcatactgatagttaacaaatttccagaccattaggttgacactaatgtgtgacttctgcttgtaaaatttatgtaactggcaccaaaaaagccaaaactgttggtttaaaaaaaggaagtccttaattctactttttaaaaagtagtgaaaacaaacaattccatacacagtggcaccacaaaagcaaccttgcatggaagcatgcagttaaaagatcctcctcaaaattggactacattgatttaaactgtatgttgactccctacttggccattattaagtgctacacacttttttttttctttaagagactggatcttgctatgtcgcccaagctggggtgcagtggctattcacaggtaatcaggacacactacagcctccaactcttgggctcaagcaatcctcctgcctcaaggctcctgagtagctgggactacagaacacgccactgtgctcagctaaatgctacccctacgtatacttcttactttctctttaatctttgtagatgagaaggcaaaatataatggtgcctaggcctcagctaaatgctacccctacgtatacttcttactttctctttaatctttgtagatgagaaggcaaaatataatggtgcctaggccaaaaaatacatttccattgattttttttttttttttttttgagatggagtctcgctctgttgcccaggctagagtgcagtggcgcgatttctcggctcactaccagctccgcctcctgggttcacaccattctcctgcctcagcctcccaaatagctgggactacaggcgcctgccaccacacccggctaattttttgtatttttagtagacacggggtttcaccatgttagccaggatggtctcgatctcctaacctcgtgatccgcctgcctcggcctctcaaagtgctgggattacaggtgtgagccaacgcgcccggcctatttccattgattatagacatccatgaatcattcatgaaatagcaaacaaggcttagacaacctaatgcatggaattaagataaaaatcataatttgcaaagcttactgttaatttctctggttttctcccattatactgagtctcaagctagcaatacaagtcaaaataaatagaaatacctatatcctaatgctaaagaatcacagtaaaataaaaaaaacttaattgcatggctatggataattttataaatgcttaatttagacccttgtatctagatgttataaatggttcaaaataacatgtatgaatttcagcttaaaaaaaaaacaaaactataaggtgtttgatggaaacagcctgactttacttgctattttatctttaaggggattctggcaaagttagctgactcaaattcagcacctgcctagaaaataacatacatctggcatttgccttccaaagtgaaagtgaacagcctagctaaaaatcctactaactgacccaaatctaatgccaagtatttcaaaagttactgtggtggcatttatgtgaaattctacttgtcacagaccttctccctgaagctaacaactgtaccacccagacaagtggaatattcaagtttgaattgaaccctaaggaccaacaacaaaaacaacaaacagatatgtattttattaacaatctattaaaccacttatcccactcctatgcataaatctctcctgttttctagtacagaaagcatagctgagaaattatggcccaccctaactttctcagaatattctgacaccagtcctacctcctctaaacatgctaactcaaaagatttacacaagatatggactggtaatacttttcattttaattactttcaaagaataccagctatgccaacagaggtcacacttagaaattttcaatttaaaaaaagttgctcccacagtaaagtggctctaagctaaaattcaattctcttatactccaagaaacaacatccttgtgcattctgaaaaaaaaattaaattactgtctaattctaaatacatgatttccaacatcattctacttgtctgtccatatgaagacagcaatgccatcatgcagaatgaagattgcctggactgtgatttgttcaacctcactaagcaagacacacctaccttaagaggtgcgtgtcttcctaagagcacactctgagagctctgttaacactaagtaataaacaaaacatttactaatgatagcattttgttgttgttgctactgctttaacctcgattcacatggacagattaagactttgaataagttggccgggcgggcgcagtggctcacgcctgtaatcccagcactttgggaggccgaggcgggcggatcacaaggtcagtagattgagaccatcctggctaacacggtgaaaccccgtagccgggtgcggtggcgggcgcctgtagtcccagctactcgggggctgaggcaggagaatggcatgaacctgggaggcggagcttgcagtgagctgagatccacccactgcactccagcctgggcaacagagcgagacgccgtctcaaaaaaaaaaaaaaagactttgaatagggagacatataattcagaaatcagtgccctgttttttgtttgtttgtttttgagaggaagtcctgctctgtcgccaggctggcgtgcagtggccaggttgcagtgcggtggcgtgatctcggctcactgcaacctccacctcctgggttcaagcgattctcccacctcagcctcccaagtagctgggactacaggcacacgccaccatgcccagctaatttttgtatttttagtagagatggggtttcaccatgttggccaggatggtctcgatctcttgacctcgtgatctgccgcctgggaatcccaaagagctgggattacaggtgtgagccaccgcacccagccctgaggcaggagaatcgcttaaatccaggaggcagaggctgcagtgagctgtgatcttgccactgcactccagcctgggcaacaaagactccatctcaggaaaaaaaaaaaaaaaaagaatcagaaaacctaaacacaatgtaaaaatatcgaacaaggaaacatggagttaaacttgcatggatagataatcctttttaatttaataatttttggcaaccattctttgtatttcctatagcacttagcctaggctagggatggcctaagggtaaaaggaagtcaggaagagagaaaggagagttaatggtgctgaatgatttagtttaatgaggaaaactaagctaaccggttcacactaatgtgtgcacataaaaggaagaaaacaacaagaaaagagtaaactgcctgtcagtttccaactgctggctttgtgtcaacaacacccatcagaagatcatttcaatgtgagcctacatcatcctgagttcagtagtccgttctgcgtattaagtgcagaggagtctaccctgtgagaccaggatcgtgattctactctgaacagttaaatgactgagggcattttgtcaacttaaattttttttttaattctacagatgacagtgcctaccatgctgtcatttgaagaaaataccacaaaaatagtgatataaataaatatgggcagattttgcctaaagcaaaagatatatatttcagtattctcaattttagtttagattaatactgattttcagtagatagtgcccaaagcctgatacctgtacctcaaatcaaagtgcccatatcttcatggatacatatacatccagttaaatcagatatctaatcacaaatcttctcacatctatgaacaaaggagggattaaaaactccaacaaatattcatttgaaatgtatttcaaccatgtcatatccaatatggtcaaagtttctcttaggccttgatatgcttaatttttagtatatagcacttagtacacaacaacaaagtaaactggtactacatgaagtatatattgtgttttattgtacagtggagaacttctcccccatgttggtatttaagagttgggctgtacttagcatgtgtgaacaattcaccaacctaccttcaccctatcctcccacccaaatcttccaacacagagaaaacttataaataaatccaaggtctatataaatccacagtgagttcaactttctgtagtgaaaggaaaattacatttcaaagctatattgccaaatagatttatataactcttgctcctgttttgattatcaatgccaagtaaattttattggctaactttaaaaatgcttaaaatgtgagactagaacggaaatactgacctagctgtacattaaaaatcatagttcagtctgttcaataagttttgtctttttaactcaaactacagaattccatttttcatatactcaaatctggaatttgcatttacactcatagatacaactcttttggaaagtctaaggaagtatataaataataatattttcaaatcaaaatcttaaggtatattcaacaaagttgtccttcagaacattttgtccactttataaatttaagacccaaaatataataattatatttttacatagtatgtcctactcagctttgaaaataaactaagtaagagaagctaaagttctatctgaaccaactcctgatatactgcaaggctatatactaaacttcatttcttcaatagttaaagtatttttcccagagatacaaactatcaaatttttcaagataaaggttctaagtaattctatagtcactatatttcaaacaatctgttctttgcaagaaaagtgatttatccaatgaaccacagatgccacttacaatctaaaatttctaatattgcatgagagaaagaatgctgattcatattaatagcatatcatgtttacaacagaaaaaggaattagaatagctgtcccccatgcccctacccataatctgtgagtataaaatcaaagtctcagagtagaacttaaatagtttaggtaatcattacatttcaaatgagtcgtcatgtttcagtttggaataacaattacaagttaaggtctcctaatgaaatataagtgaaataatgtttggcttttaaattaattttgaagtcttcaaatatgaatatgattttcatgtactacaattgttgtcacaaatattcttgtactaggggtatttaggcagaaaatggagctcagtggttaaggtcaaggtctttggagtggcaaactgcctcttacttgatatgaccttggaaaagtcatttaacctctctgagcttcaacttccttatctgttattttgaagacaaccaaaaggcacttacataatgcctagcatacagtaaaagagcaataagtaatagttgttattagtattatcagtagaatctctgcaaattgcacttgtaaaatagatgtgaatcagaaacagctgtataatccctaaaattttactttcaataattcttaaaggtcagacttaattccttctataaatgaaaaatcctgatggcagaaagagaagcaaatgtctgaaaaaggtaagaaagaacaaaaaaataaaacgagacaagaacccaataacaactgacatcctgaagcacaaagaaaactgtcatggacacaaggaaaggaaataagtagtcagcttataaaattatgcctaccgctacctttgataatgagttcaaacacatcaatatatagggcaggaaaatgaccaaaacatttccccaacctagaaacaaaaaacgaaataagttacattttgtatcaagtggcaggtagtgggaaaatattaatttatttggtttgcagcgatataaactggacaactttcaaatctactttgctctctataaatataccacaaaacacatctaatatgttaatatgatccagtatggagacgagaagctgccacacttccttcaggtttgttctttacttgattgtaagaaccttctgggacagtgacaaaataaatgtggaattggaagagttatcttcttaattctaccctgattaagcatatttggatacacaaaatatctaatacaactaatttttcataacatttaagagctatataccttaagttcacggtataaattaatttcatatctagaaataagcttaagagtctgggcgcagtggctcacgtctgtaatccaagcactttgggaggccgaggcaggcagatcacttgaggtcaggagctcaagaccagcctggccaatatggtgaaaccccgtctctattaaaaatacaaaaaaaattagtggtgcatgctggtggacacctgtaatcccagctactcatgaggctgaggcaggagaatcgcttgaacccatgaggcggaggttgcagtgagccaagattgcaccactgcactccagactgggtgaaagagcgagattccatctcaaaaacaaaaaatgaaataagcttaataaactatttctatttgtatttacaaagttcagtgtctctgaatataaatatattcttaatgtttattacccgataattactttaacaaacgtttatttagtctttactgtataccaggcaccatcctaagtgttagggatgctgttttgaacaagatagaaatggtcccgatgttcatgaagctagcagggaaagttgtaaagagtaagtaaaaatatatcacatgatcataaatattgtgataaaaatcaatttcagctgtgtgatacggagtgcttgagaagctattttacacaggttggacaagaaaggttggctcattgcattttataacatctacccctgtaagtctgagatttgctgctaaaatctgtagtaacttttcttttctcctcttttatgctagtttgctaagaaatgagaaataccaccactcaaatttttacatataaaaataaatataataaacattttgtcaggctatgaaattagaataaactgtaatcaactcatccaatgggtataatgtaaactcatcccaaatagatatagtaaccactgataaacagatatgagcattttacctttaaatgttatttccaatacatttgtaaggaactttcataataaaaatgaaatatagacaaatatacagtttattgtttttatttaaaatcatcttatttacatattttcctaaactatataaagaattttaaaattttaattaaatatcaaagtatccaatatgaagaattcaacgttaactcacctgtgcctgtaaacagtgcagaagatctataagtgtgtagccaaatccaagagaaatctgtaatataaacaaacaaataaacgtgaataaaatctgcagaatcctaagattccttagagcagatgtgatttttataaccgattttcaaagtaatacttgttaattgccatcaatacacaagtaatatgcattaataacatctcttattaaatcgcatggtaaatcaagaagtagacttgctgcattacttttatttgtacaaggtaatgtaaaatatataaggctgcatttcattgtgaattatgaagtgcctacaaattctgagtggccgtccttatactttaactgcttgtctaaccaccagccttccctatgagacaaaaagctgagtaaaagcaggaggccctagtgacctactcccacactgcattcctagggctgtgcccagcacattgtaacaggcagaaaatgtgtgctgaataaataaagaaagttcccatgctaatcttaatttaccatgatttacagtttacctatatggaaccaaaaggcctgaatgactaaataatttcttatctcaagaattatcttttattttccccccttcagagacaaaatttcgttctgctacccaggctggaatgcagtggcactatcacagctcactgcaacctcaaactcgtaggctcaggtgatcctcccgccccagcctcccaagtagccaggactacaggcatgcgccaccacacccagctaatcttttattttttgtagtggtagggtcttgctaagttgcctgggctggtctcgaactcctagcctcaagtgaccttcctgccttggccttccaaaatgccaggattacaggtgtgaaccaccatgcccagccaaggacagcctttatggcagtaaaaatgatgttataataaccaagataatttgcaagagaaaaggtgaataagaaaaggaagaactgaatattttcaataatgagggcaactgtttgcaatgtttcttcagagtctgtgtctttgtgaacaaagtgcttcgctgtaaatgagcctgcagcttttcgtctgatccttccactgcaccaattaagtttgttcccaagaaacacaatgaggaatatgaaaacaagaagtatgtgcttacggcattttatgtatattaatatttactgcttttgtatattttatggactcaagaaaagtggcttgattgctactagtaacgatactgaaaatgtatctctttttaagaataatttttaaaaaacattaaacactactagatttaatcagctccaaggaatgtttttataactaagctactagatttttcttccttcaaatgacatccatcagtaagaatttacaatttggattatcaaaacttaaaacattactaattcctttaagagccctttactcgttaaaacagtaaatagaatccaatagcacaaacaagttaacatcaatttaatatcaaaattactatttttcttggacactagaaacatctgatttcataatctaaaaggtctacaggggagagaaacagaaaaagatggcattttgatttttaccaagacctggccagtcttgaactcatcatatataatgaaatgcagctagtgtattagtcagagatacttcatgaaaaacaaacaaaaagaatctatatgcaaataagaagttatcacagtaaataaaatgaatggattccactcaagtggcagtcagtgaatagtgtgcaataaacttaagtaataggagtcatcaactctttctaacactactgggataaatgtattcattatgctggcctacttaagcccgttataattctataccaacaactaatttgctcaaggacatcatattatgcaacaatcaggagctgaaacttgtgatattagtaggaattatattaaatgattactgttggctctatactattcagtaagcttttattaataagctaccataacatgaggcaaaagtgtcaatgcacccatgctaaagaaagatgttagccgggcgcggtggttcacacctgtaatcccagcactctgggaggctgaggcgggtggatcatgaagtcaggagatcaagaccatcccggctaacacggtgaaaccccgtctctactaaaatactaaaaaattagccggccgtggtggcaggcgcctgtagttccagctactcggaggctgaggcaggagaatggcgtgaacccaggaggcagagcttgcagtgagccgagatcgcgccactatactccagcctgggcgacagagggagactccaactcaaaaaacaaacaaacaaacaaacaaaaaaaaccagaaagatgtttaggagatataaagatactaaaatttccaaacatctagataccttggtgtaacattttaaacaaaaagaataaaatacttccataaaaacagaattacaaacttttttataagttactaagagaaactagtagtcatttaaagcaaaagtggaggtaataaaagctctataataaagaagcatctcgttactgctctgtcccgagagttttcacaaagcccctctaagaatgtgtttcaagggaaggagtagggataattttggggatatctgcaaaataattatctgataaaggacacatatctagaatatattatataaggagctaaattatttgataaagggcatgtatctagaatatataaagatctcttacaacttaataataggacaaataattcaattatttttaaatgggcaacatattctgcaactcaccatgagatatacaataaggaaaagtacatgaaaaaatactcaacatcattagttattaggaaaatggaaattgaaaccacaatgaaatattctacacaaccagtaaaattatctgaagtgttgacaaggatatgaagaaatcagaaccccttttaatccactgctggtagaaaatgcaatagtacagtcatttgggaaaacagtttggaagtttctcactacacaatgcaattttatccctgatgttttcatttctcttggggaagagatatccatacaaagagctgaatggaaatgttcacagcagttattgtccacaatagccaaaaattgtaaacaatacaaatgtttatcaagggattttcttaaatgctgtacatccatacagtggaataccactcaataaaggggaatgaattatcaatatgtgaacaacacagatgaacctcaaaaacattatgctaaatgaaagaagactgacacaaatacaacacacactgtattgtatgattccatttatttgaaatttctagaaaaagtaaaactataaagacagaaaacaggctgatggtttccagtgtcaggatatggaaatggaaactgactaaaaatggacacaagataactttgtggggtgatagaattgttctaaaactgaattgtgtcctaaagaagatgaataacagacacaagatatatgactgcaaaaatgtactgaaactcctgctacttaaaatgggtgcattttatggtctgcaaattatacttaaatttttaaaatgcaaaaaaaaattttaatgttaaaaaatattttagtgatttttcacaaatgcacctgtgtgtccttgctctttcttgtgtgatagctacagtttccgcgtgagtagggatctaagggtaaaggtagttctagctgcatatggtggtgtgaacacctgccaagtagagcatcaactagcaggtggagtaacacctcacgagtctgaggcaaaaagcagtcaggactgaatctacaccacacataaataagacagctggcagcattagaactgtgtaggttaatggcagggcgtgagagagaactgaagaagatatgctcaatatttcattttatttattttttaagtgaatggatagaaacagacccagaggaagcaatggaaactgggaagaaaatgaaatgacagctgtaatactggctaaaagaacattttaatttataactactataataagagatgtgccatactttttttggcttaacaacaatgtaacaatagcatcaatagcatttattgaatgcttattctgtgagagcactgagtagagaactttttgtgtgttacctaatttaaccttcataacaatcctatgagggtaggccctgctactatcatgtccaccttatagatacagaaacctaactggggagtgaagagctctctctaaagccagagagctgatgaactagcaaaagtctgggttctaacccacaagagtctgactctggagttcatacatgatcttacccagtaggctgttacagaaggtcactgttttgataatgctatttttgccaacttgatttgaaaaagcaaatggcagaaatgtgaccaacctgaaaactgccttcttgaggtttttggtatagtactaacaagaccagcaaaaggtattccctatatcttgcacctttggcagacactattattaaatcttggcattattattttctcagcccaaatgtaggcctcacaattttctcaaagctgctaccaatcaaaggatgcaatcactaatagagctggatgtaaataaagatatgtctgttgcagggcatggtggctcccgcctgtactcccaacactttgggaggcttgagcaggcatatcacttgagcccaggagttcgaaaccagcttggggcaacaaggtaaaaccccgtctccaaaaaatacaaaaaaattagctaggcatggtggcgcatgtctgtagtctcagatactcatgaggctgggatgggaggatcacttgagcctacggatgtcaaggctgcagtgagtcgtgatcacgccactgcattccagcctaggtgacagagtgagaccctttctcaaaaaaaaaaaaaaaaaaaaaaaaagaaagatatgtttgtcaactcaaaacaaccaagtcaattttttcatggacaactgaaaacatggaacaaacaggctgttggaaagagatgactaaacaaaagggcagcccaacaactatcacacttcatgtttcaggccagccagcaccaccttaatcaagccagccagacagactggcaggaaaaaagagaacgcacagggaacagaagaaaaagctaaggaagaactgctcaaattacttaagatttttcaatagttccagccaagcacatgtgaatttatacccatagtgtacactcataatatatgattaatacaaaatttatttttcccttttttttgcttaaaagcacaaactctcaaacacaaaaaacacctttaagtcaccacaggatataaccccaagaagaaagtcatactttcacgacttacctttgaaaactatttcagattattgaacatgatattgttattatacaaatatattacatatatttgtaatgcaaatgtgtcctaatatatagccttcatgtgaattttaataaaatagtaaaattccaaagtttcactgcagaagacttaataatataaagaatgaggactagacatgcaaagtaaaattgtttcccaataagtttgatggtgctaataagcatctagacctcagaagaataatttataaattgactgattaacttctatatatactgcagacaagctcatgatttctttctctgtttaaaaggctatacctccactgcagacaataactcttaactaatgaaaatgtttaaaggtaattttcattctccaaagtcctctgtaaggtcaacagaatcatggcaaaactcccttaaaataacatttagccctgataacttacaggtaaacattaactaacctcctacttattctttccaactactcattttgcctattaaggtatacaaattaatacagataaatttttaggttaataaaaccagtgcttaaagttaactgaaagtcaatcttaagatgttcttttgttatttcaactcagtttaataaaaagcttctgaaagtacaattagtcataagttaaacaagtagagatttagatatacaatttaataaattttcatcctcactaaatgtaaaaaaaattcataggccataattataacagatatatagaaaaaatatatcagtttaaaaattcttaagctacagttacatacacatccactatttacatatatgacacagtgaaaaataatatatccatcacactcacggatctcattatgcccattcctttccatcttgtctcttgcctaccatggtcagaggcaatacaataaagcaactataataaaacagcaactctgtaaagactagtattcttgcccagagatagacctagacaaccaattaatctcatatctgtagttgaatgtacaaagttcaaatttggaaaaggatgaaagatactaaattggcagcccttgacttgaaaatagcacttgaatccatagaaatggttaagatttctttggcagaaaatataaagaaaggaggatgggagactggaactaagtcttgaggaacttctacaggtaaaaactatgtagaaaaggaattgaccaaggaaaatgagaagaaattacctaaaagacaagaggaagaccagcaaagacaagtactataaaattccagaggagataattccaagaaggagagggtggtccccattgttcaatgacactggaaattaagatttctacttgatgtggcaatcagaaattactggtgccctttataaggacagtttcaatggagagataaagatataaatcaggctagagaaggttgaagtgttgacatgtgaaaaggaaataagaatttggatacggcatgtacaaatgattgctgtcattatcttatactaaaatttatcttctcctctagactgtgagctgtttgagggcaaggatgaggttgcatccatctttgagtaagacaataacctgctgctggactagtaatttttaaacaactgcagaagtcctagggcttttattagggtgctttgccaaaaaactgacaacagtctttaacagaattacggcggagggggaagataagttattgggcagaaattaatctttcttaaacagaggtaaaaggctcagggatagttccccaccaagactagagcatgccaccctaacaaccaatccacccccacctcaagtaaaaaggccccaacacactataagtagaatttttattgtttttctcccaatagtgtggataatttttagattataaactcccctcagaaattcatcttctccttagcttttttcccctaattactgttgcaacgaccattctgacacaactgagcctagaatcattccttttatatcccttgggtacaatacagacgagcctataaaacacttcaagattctgtataatatacagtcatgcactgcataacaacatttgtcaatgacacactgcatatcccatagtggtcctgtaatattataataccatatttttactgcacttttttatatttagacatgtttatatacacaaatatttcccattgtgttacaactgcccacagtattcagtatagtaacatgctacacaggtttgtagcctagaaacaatgggttacaccagatagcctaggtatgtagcaggctagaccatctaggtttgtgtaagtacactcttgcctaatgaggcaatactcagaatgcatctaagtgatgcgtgactatatgcatatttttttttttttttagacaagtcttgcactgtcgcccaggctggagtgcagtggcatgacctcggctcactgcaacacctgcctcccaggttcaagcaattctctgcttcagcctcctgagtggctaggattacaggtgcccgccaccatgcccggctaatttttttgtttttttgttttgttttgtttttttgttttttttttagtagagacagggtttcaccatcttggtcagactggtcttgaactcctgagctcatgatccacccatcttggcctcccaaggtgctgggattacaggtgtgagccaccatgcctggcaactatatgcataatatcttaagactatgggtaagaaaagaaagtggaccagaagtaactagcttttttttttttttttttgagacagggtcttgctctattgctcaggctggagtgctgtggtgcaaccacagctcactgcagcctcgacctcctgggctcagttgatctacccatgtcggcctcctgagtagctaggactatattaggcatgcaccaccacacctggctgattttcatatttatttattcattctttttttttttttttttgtagagatggggttttgctatgtcgctcaggctggacttggaactcctggcctcaagtgatcttcccacctaggcctcccaaagtgctggttttacaggcgtgacccaccaccccagccaacattaacattatatatgtaactacaaagggcagcggcagtctttaacttccaacacctaaagtaccctcaaagacagcctcagaggaaccagcacaaacttgccaccaaaggcacccttccccaaatgatggtcactgtcaattctcatctcctacagagaggtcaaatctatcaacacaacatgaccgcattaagatataatcattatttcaatacaataaagagaacattaattttttaaaatgcacacaaagcatgtacgagggcaagagaggaggtgtctccttaaaaaggaagacagtaaggtaacacaatttatctaaagtcaaaaaacttaaaacggacccggatgtcaaacccaggactgcccgagcacaggacctgtatttttactgctctgcctgcctgctaggcagcaccgacccaccaaaacaaaggatagcaagcaccaaatgaacagtattttaaacagaaaaaaaattgaaaacagctcacaagtgtgtataataggtattcatagccataatgttttaatcaaacaaaaataagtttattttctttgactcaaattataattatgtattatgcgattaagtatgtcaatattttacagagttgtagaaagaatgtagtattccaaaagctagcaccagactaagagaaaagctttgcaactcactgtgtaggacagtgaagaactttacctgtggagtagttagtacctagccacattttaatcaactttctgtattttactgagtcatcccatggatccaaatgtcactcagaagaaatgttatcagaaaacagatttcattagaaatgtggccctactgtgtgagactatatagagttttttgtcctcctaaaaaactaaaaatgggatttttcattttactaggtgcctaggttctaacaaaaacattgaggaatactggagaaaactggatcctatggcaacagtaccatttcgggaaaaaattgagatctagagcaaacttagaaatcacgtttcaactactgagtttcacagatggaaatctggggctcaaagagattagtacctctactgatgacaggacttctcccagtcctcatgactaacagagtttctatgaacccaggaacaaatatatcattaaaacttgggcctcactatcctatcttaaccaattgctattcaacctccacgtcacagaagggcactatgtacatgaaaaggtgtgaaagggccttctaacttagttgtgaagctagaatttattgataaaatatctaacatacaaaacataaataaaactggatagatcttgagatgagcattccaacaccctaagcatacagaataacaggagctaccttttgttatgaaacagatgccagttcccctgctataaattttacatgctggtcgggctcagtggcttatgtctgtaatcccagcacttcgggaggctgaggtgggaggattattgaactcaggagctcaagatgagcctgggcaacaaggcgaaacgtcgtctctacaaaaaatacaaaaattagccaggtgtggtggcgcgtgcctgcagtcccagctacttgaggggctgaggctggaggattgcttgagcctgggaggttgaagctgcagtgagctatgtttgtgccatcacactccagcctgggtgacagagcaagaccatgtctcttaaaaatccattttacagatgaggaaactaagagaagttaagcaatttactcaagttaaagcaagaggaagaaataccaactgaatccaggtcgttctgaattcaaggcctccactctcccaggttgcttctattactgcttcttctgccaggctcccttctctgcaattcttgctctacccaactccttattccctcaaagaaaaggatttgatatcaagaagatactttctaaaagccagccttacacagcagtcacaagcaccaacttaacaatgagttacccaaaaaggtttcactaacaagattattcagttattggctgttgtacctacataagcaaaaaaaaaaaaaaaaaaaaatagaagaaataatacaatattgcaggataaaagacagtgaagaaaaaaaaatttaaggctgtgacaaaatgagaactttacttgacacaaggaatttcattagaaaagaagacaattctgaaacctaaggtgggagacagctaggaaaacaatctattgtggctaaatttttcttcaaactgggggtcccagagaccaagaatgtatataaatgtccataaaacatccatgaaattttctaatttcatgctttcattttgatgaaaatctgaaattacttaacatatggatatgctaaatcatgtggacgaccattatataactgataacttattgccatttaatttcaggacttccatttgtgcttacattcgtgttaaagatgagtattttaatttctttgaagtcaaatcttgagagggaaagttttctatgaattcagtaaagaaaattcatgtggagtatttgaaacatcttcacacagctactagcagtacatgctgaactcaatgtaacctgagctcagcagattatacacagcaattttgttacagccaaatacgcttgcatggtagtgctaatttaaatcttatcgatttggtagttttgtttatatttagttagtaaatctatttttgttttataggtcttaattaaactaaaatcttctgtattgaaaaggaatctagtaacatactaaactggctgcttttcataggagccattaaccaagttaacattcccaattatttacataataaatatggccataaaatgtagattttaagaatcattcatgtacatgttttgtttaccaaaaatttcactgacaaatcaaaggtcctaccagtggtacccaaaatatgtctctgaactgtaactaaagaacaaagtcttttaaaactaaaagaaaaaatgtaatccttttttataaagctaaatttcagtaaatgtgaagaatctgactttattatagattatgagcttactgtttcatggggctaaattttccttttattttctgaaatggtgatgctagtaagtggtcattttcattttcatataatgacttgacaaaattgaaattgtggcactcctatgccagtttgcagatttgggaaaaatttttaaatagaaacatgaaatcataatctgggtactactggcctacaagttatctactatgaaatgaggtgtgtgtgtgtgtatctgtgagtgtatttatacatacacatatatgtgtgtgtgtgtataaatatatatatatataaaacatgtatatacaaacacatacaaatagatatagatacatagttacaggtattctcctctgggaatttctattccatgggggaaattcatttgtagcatgaactcccaattgggaagttcttatttctatcaaaaggaatctaacacccctctttctagcccatctaggacaaagagcactctaggcagtcaggccacaaactacagcatggagagaaaagaggagctattaccatttgatatctaaacacttggaaatagttattttgctagacatcctagaataaaccacagcctaatagtgttaataataatgacaagacaacaaaaactctgaacagaaactgtgaaagattaaagacagcaataaactctttgctgctactctcattgagaactgaagtgtaaccgcccttcccctgaagctggggttgccttaatgactggcttgaccaagagaatatagcagcagcagtattttgggacttctgagccttgatgcttcagcctgggactcctgaaaccctcgatcttagcattctgagctgctacgtatgtatgactgccttgaggctgccatactatgaagaagcccaagctggccatgtggaaaagccatatgaaaaaagagaattaaatgcccagccaggccccatctattatagcccctgacagttcctggtcttcccaactaagactccagatacagaagagacaaaccatccctattgtgccctgtccaaattcctaacccacagaattatgagctatattaataataaattattgttttaaacaatagatagatcaccagaacaaaaatgaatcgcctttcataaatagtaataaggacttaaaaaaaaaaaaagaaacatctcgggcagacaagctggaaaccagaatggcaacaaacacaaaaaaggattacgatgcttaaggataaataaaaattaattaattcatttacccaacaaagatttatatacaagggatatataaacagggatatataaaggctctgggaatataatggtttaaaaaaacaaaaaaagtcctaccttcaaggaacttacaagaaaacattatgtatcatagtggtatctttctatatacagtacttaaattttttttttccccacaaaaattgctagccttggccaagcgcagtagcaagcacctgtaatcccaacactttgggaggtcgacatgggaggattgcttgaacctaggagttccagaccagcatgggcaacatagtgagacaccatctctaccagaaataaacaagaaattagctgagtgtggtggtgcacatctgtggtaccagctactcaggaggctgaggcaggaggatcgtttgagcccaggagattgaggatgcagtgagcagtgatcacgccattgcactccagcatggagacagagcaagaccctgtctcgaaaacaaacaaacaaacaaacaaaaaaacgaaaccaaacaaaaaatagctagctttttatggacataaccaacaattcagatcaaatcaaaacacaggccaggcgcagtggctcatacctgtaacccagcactttgggaggccaaggagggaggactgcttgaggccgggagttcgagaccagcaagaccagcaaggggccaagatggtgaaactccgtctctcctaaaaatacaaaaattagctaggtatggtgcggggggtgcctgtaatcccagcttcttgggaggctgaagcacaagaattgcttgaatctaggaggcagaggttgcagtgagccaagatcacaccactgcactccagcctgggtgacagagcaagactctgtcttcccaaaaaaaaaaaaaaaaaaaaaatctcatagagtgaccgagagtttgagttcctctatgagaaggaagtgaagattgaatcaaaatcccacaaaaagttatttgtagtttgtagtatctaaacacactttagttaactatagtatataataaaatgtttgggttctgatttcagaccataaattcaaggcatgcgtaatgaattctttttattttttcttcataaagtatcaggttaaaatatcttttaaagatacacttacaaatgtacatagtagacctcttctattttactatagtcaagattctagggcctaaaatgggcaaagcaagtaaggtcagtagtaagctgttgttttaacaagatttatttctgtctaggtgtgctacaattcaaacaaacacactcactattccagtgactaaaataatttttaactgctccttttattaaagcatagacaatttaacctttcataatatcatcctcagggctctaaaattattcacacctttctatttgtagcatttctctattcaaatttcatacaatgccaaaaagaacacaaatagagaaaattattctacatggtatttttaaataaaagaaaatgtctgatatcacattgtaaaagaacaacacagtaaataactatgtttatggtctcttaggcaaaagaccgtagtatgtcttaaaatcattagcacctagcacaatgtctcggtagtagattctcagcaattgtctgttgactgataatacatttatttcctagtttttttttaagtgtgtccaagaaaaataagcaatcctatttttttatcccagtaatatttgaggcaaagaaaaaaaatgttttcaaaagaggtcacaaagaaacatacctgcccttttcattttctcttgaaaatattttaaaaggaatagggtgggggaaagtggtaacaagtgctatgtgctctaaatgtcagtatcgcacagatgacaatgaagcagtaacagaattataaactaacttgtattttcttttctctcataatttcagttttagcacattacatagtaatttgtcagaatttcttttttaaaatatgatgcaaaaaagaaaaaaattatcactgctaaaaagcaacttattaattttttacccaaaacacagtataaaagtcgtaacagtgtactgcacaagaacatcatcaggatctttaaaataacaataccaacattccattataaaaagttgcaatatctgggaagaagatattgaagaatgtcttacttaacagacagctcattgttctcttctagactggtctagagactggccatggcatcagaacatgcgtcagaagacctggccatcttcctggatctctgtgagacccaaggccaatcacttaacatttctagtcctcagtttcctcagtgacaaaaggagagagtggcacaattgtccctaaatcctgtttaggactaaaaaaattctaccatcctcaaataaagagccattagtctaaacaaggttttaaggcatccacatcttctatttgcttaaggtgcaattatttccttaatcttgcactaaacactttacaagtttcaaatgcctagagatagactactttcttattttatctttacaacaactctgtgaggtatgttgaccctgtaattttgatgtgcattaggaaaatgcctaaagggaggctgagtgaggtgacatggtttgattaaagtcacttagccaagaaaaacctggaaatcagatcttctgactctagctcagtgctcacgcaagagatttccagaaacaagccacttttaaattcacaagaactacaaggaaggggaaaaaatggtgtttatttttaaatgaatatactgtttctttaaatccaatgtcatagtcttaaattccctaaaacagtacaattttaggcctttatatctcaaaattattttcaagactcctggaacaagaaaatcccagtggcttaacacattatcaaaatattaccatctatcaggatttcctaaatcaatgtatctttcttggggaaaaagggggtctgtatgaaattaagatttggaatatttgtagattaataatgcacataaggtctttagtttaatctagcatttcacaaatttgctgactgatatatacttcagactttttataaaataccaacggtcattctaaagcacttttgttccaatgaacaaaatcatcttggaaaacacttctgtgtatttttaaaagatgatcatttcctaaataaaaaacaaaattattataatttttccttatttctctaacatccacattttcatcttttctgaaaaggtaaattatcttactatttgtacatttaacacgacagtgtcccttttttcatttcctgaaaagctgttgacccaatatcgtacttcgtaatcaacagcaacttggaatagagaactatggtaaaaaatcttctcgtaatcttaaagtgtactctcgtgacacaaatgacatgacatcatattaaaaggtctccttcttagctaaatcacatacccagaactaatactgaaaaatctggggagacttcaattcagatgaaatgtatactttaaatacatattagcaaagacaggtaattgggggaaaatgtacatcagagaaataacatttgaatccatcttaaactattacagagatctgtatctaaaattgggaacaaacatttacaggtaaaggggaagataaattacttaatcactgagcccattaacctacttgtaacatggaagtaactattaatataagtgtggttttgccctatttataaaatagcaaatgatgaggcaaaggctaattagctaatctgaatttatcttgtgctcatgattttataacactagatatatctatttattcccaaagggattaggcatttctaacccttcctctaggcaacgatgagttccctaataaccaaacaagtttctttttacttctaactaataatgtttagcaagtccaaaaatactttcaaatgcttttgaaaatgtaaggcagcttagaaataagctgtttttagtaatggtattttagaagtggtataacttaccacttcaggcaaagaggtatgacttgtcactggtaatagtggtaactcgggaagctgaaaagagttattttgagaaaataagaaattgtgggctctagtctcaaacctcacccttcacctcatatatatgaaatgttatgcttctgtaattcacaaatcaaatttctgtttaaaactggaagaattaacaacagagtaagttatatatttacttttaaggtacacacacgaaaaaatttttaggaatagaagtactcagtgttggctaaaagattttagatatttcagtcacttcctaatccttaaaatgtttatacaagtttctccccacttcctccaccatccccctattatatccattttataattcagaaggtgatctgttaaccaggccataaacagaaagtaaacttcaaaaacaactgctggccgggcaaggcggctcacgcctgtaatcccagcactttgggaggctgaggagggcggatcatgaggtcaggagatgaagaccatcctggctacggtgaaaccccatccctactaaaaaatatatatatatatacaaaaaattagcttggcatgatggcggacgcctatagtcccagctactcgggaggctgaggtaggagaatggtgtgaacctgggaggcagagcttgcagtgagccgagatcacgccactgcactccagcctgggcgacagagcaagactctgactccaaaaaaaaaaaaaaaaaaaaaaaaaaaagcaactgtcatgtccacaaataaatgagtaagtcatattttaaaataaagtacagaatgccacaaagactcataaaggcatcaaagtacagtatgcttcaccaacctatattatcctatttctatctatggactaaaattatataaagtgacctctctgcaagtgagtttagactccaaatgctagattaaggaattatgtctaaactacttacaaaaacaataacaaacagcatattttggaaggtcacattaaaaaaattgaactaccatctccagtgcctaaattccatgatgtaataagcctgtatgatggatataacaagaaatttacactctgcagattgttaaactagaacaaaatccctgaaacattgaaaagtgagggttttgaaatgttttttaaatatgaaaccaagcagcattcatttcctaaatgtaaaatataatttaaaaaataatgaaaaggattgttatttaagcattccaaaattgtttttcagcaactgctatgcttttttagaatattaaaactgtattattgtatgtgtgaacaagactgttgtctttctcagttatataatgaattgagaattgaaccatgtttcctaaggcctacaagagaaacgcaagtgtgctatgtaatcaatgctttctagtagacatttcattgaacttattcattttatctagcaggaaggcagaaatgataaacgctgatgtgggttgataccactcactcctacatatctgagccttttcatttatttgagtgtcctaaatctccaacatgttcaataaaatactggaaggtaaagaagttttgacgagctaaggaaggcaatgcactgtgcctcacaatcactttttgcctatgtcttacagaaatcaagtaagatacttgacactgattataaagggatgatcatctagcttgttgatgatgctgatgatacaaaagtcattctatgtttgatttcttcctcttttctttcaggtgtctttttgggcattcaacacctctaagaaaaagaaagaattgagaaaatgaggtaaaattccaacctatgaaatttcatttccagcaaaaacacttaaaaaacaaaacaaacagaataacctcttagagacccaaaagaaaatacattaaaacactaaaagtggttgtgtatggatgacgccattatggatagattctttcatgtccacgccttctaaattataaccatattattaatacttatatttaataccaaaacaataaaagcattactgggaaagtaagttaaatgattccaaacattttaactaccctgaccttatactacacaagacaaaggggaagtcgcctataaaacttgacactataaacaaatacagaagtatctcttgcttattcttttcttccctatctgtgttaacaaagggaaaaggaataaaggaaaagaaagccatgaggacacactcacaaaccaaaaccacaagaaaaataatctaaaaccagactgcaggaggcaggaggaaggcaccattctctataagaagtgattttgcaacactaatagcaaacccacattcctgccacaagcctcatccacaacctaatgctttcaaacaggccacacggctggcggccctgagagccttccagagaggaaccaagatagagaaatcaggagggctgaggactgaattgagccctaatctgattccaatgaaacactgccctgctggggtataatattatggtaggcaggaattaatagatgacggaacttctaaagaaaattcctaaaggaacactgctttgaatgtgagcctcttccattaatgatgaaacagctgaagtactgcagtacatgctttctagggagagtcatccgcacgatgcataaggtaaggaaaatgcagcatcaccttcagaaacaatacagagggtatgcctagatgaaaaatctgctctcagtaaataaactatgtttgtgtgaacattaagagtctcgtttcctctcgagtcaaagcaccatatggctgaaagcaaagtcttattagatttggagactgaactggtttatgagggctcaaacttgttcaatgagctgttttaaaggcactatgtttttaccaagtcctgggagtgtccctcatgatactacctcaaccaactccaagaagccagacaccttcctacacaaatgccaaacacttcatctcaatcccgatagaactctctaaaacagcactctggttttgtttccagatcattcaagaaattactcattcagatccagcaatcccacttctgggtattgttaaacaaaaattatgggaggccgttgttttggactgagctcctacactaggtcccaacagaccagaccaaaccaaactggaattactcatgctatgccacataaccaaacggaaacttcaaggtaggagatagatcccaaaacagatcagtttttttctgaaaatgggagattacagtcttcctgagccagtgtaataaggaagtcccctgtgctttaacccttaccagaaagtaaccgaagtaacctgatgttaaataaaataaaagccaatcaaatctataactaaacttcttgtaattttgtcttttggtagttctggtgtccaacagtgggacctgaaaaacactgctgatgacgcccgagacccatggggaatgcaggagaggtgttgcccacctcttttaaagtcccctgtcttcctcacactgttcggaaggttgtaagttcctcacggttcagactctgatctctgcgtggagcccctggatagttttggcttttgaactcagggttagtttgtgctataagagagcacatgaactcttggggtttgcagtggctagcaagagctacagttttaaaggcaatgtaccgcggttgcaatgagtggctatgattgcagagggtgtgatctccaggtttcagaattcacaaagatttggattctatcctctttgtttctttttcttgtgtgctttggtagggggaaatcactggctagtcagtcaaggggatcccagtgccaaaagtcacaacttgactggtggacctggttcaagcacttaagagctgttagattaaccagacatgaaaaaataagactgtcgtgagaggataaactggacacaaaacacagcagtgccaccaccttcaggaagtatctgcacaagaaggcacaccaaaagcattgcacaacccaacactgtggcatttccctcttaggcttttacctcagatttgagagatccaatattcaacataaaaaatgagatccttaatttctaaagaactaagtactccaccttctggataaacctgtcttttatatgagtaagtgttaggtcccagaagctacaaaatactggcaaaaatggcaaaatcacaacaaagataatttagaattacaatggccattacatggagcatttcagataaacagcactgcactttaagaagtccatttaaaaataaggagtcctaattcaggccaacccaggggcatctattggtatgtagaagcttctaaaaagatttcaggccagcacagtggctcatacctgtaatctaaacactttgggaggccaaggcaggaggactgcttgaggccaggaattcgaggctgcagtgagctacgatcatgtcactgtattccagcctgggtgacagagtgagaccctgtctctaaaaaacaaaaaaaaatgaagttttcaaaaaaaattgtttattgccacttttaagacactttacaaaaggaaaatgaaacacttaaaactagttgacaaaaaaattcaagttgcaggccatttcacttagttactacctcaccacaaaaacaaaggaacattgggaaagtcttataaaagttaggccctcaggtcaagccggtttgcttctttttcagagctttccatgctgagtgcagtcataatgcttaatcagccctatttgttaatgtgccccacctggaactcaataagccagtgaagaaacagaagctaaactgaaaagccacctaacaaaatttgtttccaaaatacgcctttctggcattcaggcggttattttgaataggcttctgaatgttctcctaggctcatctgtgtacttccttgtaaaattctgcagtgaattcctatggctttttgttgcctcagcatatcttttgaatcctcctctgtggctccctaactgacacacctgaacctaattctcctcctgctcagtgctcttaaaaagtggctggccaggcatggtggctcatgcctgtaatcccagcactttgggaggcaaggagggcagatcacttaagcccaggagtttgaggtgagcctaggcaactaggcaaaatcccatctctacaacaaataccaaaaaaattagctgggcttagtggcgcctgcctgtagtcccagctactcgggaggctgtgggaggatcatttgagcccaggaggttgaggctgccgttagctgtaatcaccactgccctccagactgggtgacagagggagaccctgtctcaaaagaaaaaaaaagaaggaggggctatctcaataggcccatcagggcaggactacagtttacagccactccccaggcagaaatctcaagaccaagtcataggaaaatacactgtatccagttttagcagaaaatgggtgttttgtccacccagatgagctctggagatattcagacctaaattttagtccacagtctctataccattgacctctgacaaaaggcaatacgccctaagctctttcttgaaaaaaacttccattttttcccagtgcctttgagaagtaaactttccacattaacattcacgcctttccaagtacaaatttagggttgcctagctaacaactgactagagcaatgaaacgggaaagacggataatctgaaacagggagagaaactattgggaaactggcatctgtacatttgtgtatgtctattatgcatgttatataccttggatgatgtttctgaaatttataaagagctctatttaggccaggcatggtggctaacacctgtaatcccaatgctttaggaggctgaggtgggcaggtcgcttgagcccaagggttcgacaccagcctgagcaacatagtgaaaccctgactctacaaaaaatacaaaaatttgccaggcatggtggtgtaggaccatggtctcagctacttgggaggctgaggtgggaggatcacctgagcccaggacgtggaggttacagtgagccgtgatgacaccactgcacactagcataggcaacagagaccctgtctcaaaaataaataaataaataaataaataaataaaagctctatttagctggcttttaaaaagtgatgcttaaataaatattctctcagaaaacagaaactaatgtcttttacttcaggtgatctgagataatctttggtaaataaagctagttttaaaattattgttaaaaatgtttttggaattgctaacatcaattataatgcaagcatactttctttaaacctagttttactagtcaaacaggcttgttatctcctagatatttaagaccttaaaactataaatccaagcttattgcagaatactcatgaaaataaattgcttgatacatgtcagacatggaggtaaaaggaagagggaaaaaccaagtttaagttattggtttctttgcttctgtgatatttttaactgtccgatttgtcaaaaaatatgatgatgggtagccttgttttccatgagcaattcaaacataactattaagaatgaataaattaggtgaatgtgaatagtataaatgtttataaattcacttttcaaaattttaaaattcctttgcagtaacgtgaaatcttaaatagatattcatgaaatgtctgcctcatttctatgtaagttaaaatgctgaaacattaattgctgaatacaagtttaaagtatatgtattttgacatcttgtttttatatggaagctatatatctgggtctgttaaaaaaaacatgaagaaactacattatgagaaaaagtgttctaaaaattttgaaacagtgctcatctacaaaatgctgatacacaacagctcacaactgcttattacttcctcagttttctctataaattaaaatcactaagttaaaaactctactatatgataattaaaactagaaataagagaaaaaactctttatgcaaggaaaggaatgtggttttttggtaagtcaggcttacatgaaagatatggttttattaagagaaaaagatagtaatttttgtcctagagtgactggttgttccaatatgaataaaaagcataggctataagaagggttgtaaaaggtttgtggaaaatgaaacttgcaaaagaaattttacatgcaatcaaactggctaaaattgcaaggaaattaaaagtttttctaaaaactgagcatatatatcaaaatacactaacacaaaacaggtaatctgatactctgttaaaaaaaaggttttcttggaggagtattgatctgctcttaataaaaaataatgaaaggtttttatcttttaggtaactggtctcgaaaacaaggattctgtgttttatcagtatgattcactgtgcatattgtctttagtaagtgttatgagttatctctattaaagaactaaggttttatctacaaatatataactttctgtatttgccttttgaaatccttttattatcacactgattaaatgaatgactactatttcgcagtgacctgtgatcctattttgatcaagtgttttaaaccttcaataattttgacaagcttcccaaaatcaaattctaaattaactttctgagctccaaattaactttgggattttcttctaggcccctggaaagcctcaatgggttttctattgttttgcattttgagatctattgtacagcatggaaagtatagttaacaacagtgtattatacacatcaaaattcttaaatttcaaatgttctcaccacataaagttttcaaaatgagggatatgttaattagcttgatttaattattccacattatattcataaaatataacatcactttgtttttttttttgtagagatagggtttcaccatgttgcccaggctaatcttgaacccctgagctccagcactccacctgcctcagcctctcaaagtgctgggattacaggcatgagcttccatgcccagccaatattcataaaatataacatcactttgtaacccataagtatgtaattacaaattgccaatttacaaaattaaaatttttgaaaaagaaattatttatccaaaggagatttcagtaggtaccaggcaggctgtgcacatccattttctttctcacagaggaagtagacttactaagacacccttcgccacacaagaagcaaaacagcattctttcctatgaggtttgaaatttctaatatatcagaaatgctttgcttttttccttcatcaagaatatattttatttataaacttgattcttaggtaatgctttcctaagtttcagaatataccttttttttttttttttttttttttttttggtgaaacagccaagtgaataaaactatctagcctaggtgaggtggcctgtaatcccagcactttgggaggcccaggcggggggatcacctgaggtcaggagttcgagaccagccaggcaaacatggtgaaacctcatctctactaaaaatacaaaaattagccaggcatggtaatcccaggtacgtgggaggctgaggcaggagaattgcttgaacctgggaggcagaggttgcagtgagccaaaattatgccattgcactccagcctgggcaacaaagcatgactctgtctccagagggggaaaaaaaaacctgtctacaaacttctagtaagttatttatttcatcatatggcactaagaaaatcatcatgtttgccattaaaactaggtacactaataacttatagcttaatatttttggcatggttcttactgaaatctgctactttcaaccaagtcattatgcctcgagagctctgtcaagacttaatatatgttcattcctatgataaatatttactgatatttcagataaatagttgtggttgctgtaacacatatattcactacagaaaactgtagatttctatataagcaagaaccaattattgtatgatcataagcaataccataagggcaatatgaatatttactagtattatacaaaacagctagcaccaaatatttggatttcagtacagttcttcctccagtacccacatccttgagacgtattaggaggtaaaattcacctaagttttagaactcaacaaaccatatctcaagtatttacttctgcctttaccatacgtgtgatcctgggcaagttagttaacctccctcggccttagtttcttcatttgtaaaataataatacaaaccttgttaagtttttaacagaacaatatattgtatgtaaagtacctaggaaagggtctggcccatagtaaatgcttgataatgacagtgattactgtaatcattgttgaaattgcagagatcaaacaattcctaataatatagccaaaaaagtgaagtgctcaggaccttcaaaaatatttcaaagaatttgttatcaagatatttttagacttgtatttctgggttctacaaagtccagatggtatcttctgtcctacacaagttaggctgtgtcgtaagactcttctaccaggtactttcttgacatctgtgagaggcaagcaggtatttccccagtacttaaacactaggtctgctaattactgagtcagatttaacgaatacgtaaactactctggctatgctaaacacttagggaggctgcatcagatttttcaacaactggtcagtatgtactgagtccactgagtacgcagctatgttctaaaaagttgcattcacatcaataatcaaacataatccctgcctgagtagagtttaccatctagaggaaacaaactaaaagaagtttaaaagaaaatgtagtatgttttagtataatggctagctaaagttgattttgctgtgttttaaaaacgagaaagaatataattagatgagaggcagttataaatataaattacaatttggatgttgaatgtagcaacagcgagaaagcacacgaacacaggatgaaacataagtaatgctgacagtgaaaagcagatttatctgaggtaggaaaaaaaattagcaaacttcaaaaaggtcattgatattaagggtgctaacagcctaatctggaaatttaacaaaatttttttaaaaaataattatttgatacattaagtcctttgctaattattgaagggggggagattattgcctggggatacttattaccataaacgatgtgtaaatcagactactgattatatgattataacattgtctcactcaataaatactatctacccaactatctccaataacctttctgacacctggtatgagcctatgtgctaattttctggttttctagaaaaaaaatagtttttaaaatgaactcccaaaaagatccaaaatttaaagaataatatgtatatacaaacacaactatccaataccatatggtaggttaacatggtatttccaggacagtcctaatcttcagtggggatgaacatgcttccctgaacagtctggggtcccatttcccaggcccagcccttcccctacccattactggtcccacataccaccttaactggttctgctactagtttttctctccctctgaaaatccgtcttaataaaggacttcatttttcaagactgacatgtatatgcctaggatacacatgttaggataaaatatactaagtaagctggtgattattctactccaaatatctctattttctccatcttatcaatatatgctatctaatccctaaagtatatggagacatcttgtcaatttgtgaccaaaatgcagtgcaaatttcattcattcattctctagttcctcatgaactcatcaagtaccaggtgccagaggatataaaaaagttgtattaatatctttgttttttttaggtttatttttgagacaaggtctcgctctgtcactcaggctgcagtgcagtgatgtgaccaaagctcgctgcaatctcaaacttattgggcgcaagtgatcctcctgcctcagcctcccaggttgctgggactgtaggcacgtgccactgcacccagctaatttttaatttattttctgtaaagacagggttctcactatgttgtcaaggctggtctcaaactcctgcctcaagcaatccacccgccttggcctcccaaaagctcacgagccatggtgtccaaccccaaaaaaaaaaaggtactcatataggataaactctatagatcaacaacctttaaaagaaaattaataaccctttcttactcattccaagaagattttgctatccttgggacttgttccaagagacaagatattaggtactgtttccaaacgtggcctcatatctgaaccaactatttcaaatgcagtcagttctacctttccccctttaatgaagttatcattcactctgatctttttaaattttcctttttatgtttactttggaaattttgaaaaatagaaaaaaagcataaaagagaggaagaaatattcaccactatctctacccccatgaagtaacttctcttagtattttagctaatattttttaatttatttctttcagatgtttttactatccatatctttaaacataataatttactacttagctatttgcccttaccattactgttattcctatcttaagaatatggcatcatgtacctaaccatttctttcctgttaaacagtgctgtttccattgtttcactgtttacagaaactgtatgacagaaatctttgaacacaaatcttcgtctggttatataattatttcctaggcattccttggtcaaaagatatgctcaactggtaaggcttctgctatacaaagccaaagtggtttttcagaaaagtagtaacaatttataccaaagactagttcctgaaaatgctctttcaatcacaatctaattaacaaagggcagtctctcactcattcactcattctactaatttaataaatagaaagtagaacataacatctttttttttttttaaacactctgtcgcccaggctggagtacagtggcgtaatctcggcacactgcagcctcaacctcctctggctcaggtgatcctcctaagtagctgggactacaggtgcacatcaccacactcagctaatttttgtaaagatgggatttcgccgtgtcacccaggctggtcttgaactcctggactcaagtaatctgcccactttggcctcccaaagttctgggattacaggcgtgagctatcgtgcctggctgaaaataacatcttaactgcaagttttcacttatacttttcatttaagaatcttgtctgttctttatcgaggctaaaatgggatctagctatcccccagaatctttcacatgggtggcccatttacttggtctgccattctgatctttctggccaaagcttcatcatctctaacctcatcacctcacaaatgaaggccattaccaccaacattctaagtagctgactgctctccctgggacacacctaccattctaatagcagaggcagctcaaatgaggccactaggaaactagcctgcactactcctcacctcttcacaactggcaagacaagccaaaaacactgagttacagtttaataggcttccaccaaaactcctacagttcttaatcatataaacacttttgtcaattcttcctagtacccatgatatggttcaattaatactattttcaaagtagtctactacatgtaatataaactgtaagtctgtgtacatctatgtatgaagtatacatcctcttaccctttataattaagtcaccatcacataaataagtccgtgtatatatgtatataaagtacatatgctcttacctttattaagttctcccatatacatgtgaaaggatacaggcatttcactgttagttcaaaatagtgacagcaataaaattaatacaaataaaatgacagaaaactaccctttctgcatttctctctctcacacacacacacacacacacgtgcacacacacacacacacatgcacacacacacacacagctgtgattcctaaaattatacagaaaacaaagtaatttggaggacatgtctttcataaaatataaaacaaggggggttcacatgaggaaaactgatagcaaatttttaatttcttacatgatatatatataacaaatcatggagatcattggtcacggcctccagtgatccagtgttgaagatttcaagctcaaaagctagcaaagtttacttgaccattatacagattcactcctagacatactggtaactcaatattcatgatcatccagatgcataaagaagaacagaaaatgtaatgagatatattcagctttcattagttttagcctttgaagtattggaaatagtctctaaattcaacactaactttacaaaatgcagaaacagtcttttaaaaaattaaaggcctcagctaccttactgtggttctaatacataacttatctcctagcttctctagagatcacactaaggacaatcttaacttcactcagtcctgtcccagtagtcctttaccagccactaactcacttcactgcctttgcttaagctttccttgcctaacttcaaagttttccattcatattcaagattaagtatattcttgaagtttgctcgaggagattaatacattcggcttctgtcatcactttccttaaaacataggcacacatgaaaagtcttgaaatgaacaaatcttcaaatgagcaacaatcttgccttgtattcatttgcattttgaataatgtcattaaggaatatatctgaaacaaattaagtaaagtgtgcctggtaacaacatactcaacagaaagcaagaatgcagtatgtattctctgcacataaatgcatgcctacatttatacatttgtgagaagcctgaaatttttgcaaaattcattaatataatccattcaaatattgtccaaaggatacctcaaagttaagtgagtaccaaaactgctttaattgctttaactgattctgtttcaaagacatttattttaagcaactcttcaatccaccttctaaaagtaaatagcagtggcataaatcagaataccaacagacaaaattaatgtagttaaaagtcaaccagttaaagtacaagtacaatctcactatatgaccatcatcactactaatcaaaacactccaactaaaacaaaaccaggaaaaaaaccgacctggatttccaaagcggtttttaatgttactagagaaagcaatcacacagtagatattatgattaaacactgatgtattaagagagttttaaaaaagctgaatgtagatagatggagagacagacagacagacagacagatgggtttttaaagctacattacctaccaagagcttccaacaatctccactcctttgggaagcagcattttaacgaaccagctacatgcatcccagaggctcaacccacatttcctgatttctatgacaaagattgtcattaaccttaccaagatcaccaggaatgcagtaccagtgtggccacacttaaataaacctttcatctactttgagcaaaacaaaaacactgtaaaactggtatggcaagttacacaacttagcactattatacattagtttcagatgagaccgtctgactaatcagcgtacctgagacacatacagaaaagttgaagacctgtaaatggcactgaacttggaaaaccaagaactaatcaattcaagaacttttcagcagaatagctatgagattatgtaaaccatcgaatgaatacaattctaagtcttatagattatatgtacctgctatatttcagtgaaagaaaccgattatttttcagctgtaaaggtctttcctcagttcttctacaagacaatttgtatgtttctacgcaataagtttgtgacattcttgggtacaatttttcttgtcctctctaggtctcctagacatcattcataaactggattctttgaatagacatttaccatcttaaattccttgaataaatttccttaaataaaattctaaactaaacaagtggtttctagaatactgaacttgtccttgttatagaagaactctattaatatcagtgattaagcaggcaatcaaggctcacttataaaaactgaggttaagaggaaaaaaactcagcaaggttcaagaccatgtacacacctattcatctgtacacacagaatacatttttcacattaaatattttttcatgttaaaaaataacttttcatttgcatttctctggtgtcaaactagataccttaccagaataaataaaattaaaaacaaagagaaaaaataggacaataccaacaagtaatgaggatgcagagcaactagaacttccacaacattgctgatgagaatataaactgatacaaccacttgaaaaactgtttggtagtacctagtacctactaaagctcaatatactttattctcaagacccagcaatttttttttccttcttagagacaggatctcacactctgtcacccaagctggagtgcagtggcatgatcatagctcactacagcctgaactcctgggctcaaataatcctcctgcctcagccatctaaggagctaggaccacagatgcacaccaccatgcctggctactgttttctggtttctttttttgagacagggtctcactctgctgcccaggagtgcagtggtgctatcacagctcaccgtagcccccaatgtgttcaagcaatcctcccacctcagcctcctaagtagttgggactacaggcgtgagccaccacacctggcttattttttgtccttttgtagagatgggagttcgccatgtggatggtctcaaactcctgggctcaagcaatcgacccacctcagcctccccaagtgctggaattacaggcataagccactgtttctgaccttttttattttttaattttttgtagagatggagtctcccaggctggtcttgaactccaggcctcaagtcatcctcccaactggacctcccaaaatgctagcattacaggtgtgagtccacatgcctcagccaagactcagcaattttgatcttgggtatacccaagagatgtgagggctcatgtccacaaaaaacacaaataggaatgttcacagcagctttattcataacaccaaaatagaaagtgacccaaatgttgatgtattcatcaataggataaataaatattaatatattcatataatggaatactacaaagcaatgtaaacaaaagcactaacgctatatactacaacattcagaaatctcatggatgcaacaatgcacagcaaagaagcctgacacaaaaaagtacgtcttatatgattcaacttttataaagttcaagaacaggtaaaactaattacaaagaacagagctctatcttatagggaccaaggtcaccacagcggttatctctggggaaatactaatggaaaagagcacaggagagggaaccttctggagtgatataaatatcctgttttcatctgggtagtatttacaaaggcacatacatatttatatatatagaaaaactcatctgagtcatattccatcttaccacttccaactgccttacctccattaagttatttaacctatctaaacctatttttttttccagtacaagatgggaataatgactttgacacaggatatgaagattataaaacactcaataaatgatgatgatgatgatgataatgatgatgatgatgatgatgatctggtttcttatttgcttcaaataaggaacacagtggaataatgtatgagctcggtacggtggctcatgcctgtaatcccaacactttggaaggccaacgcagagggatcccttgaggccaggaattcaagaccagcccaggcaacatagagaggctcctgtccctacaaaaaataaaaagataagccgggcatggtggcacacacctgcagtcccagctactcaggaggctgagatggaaagattgttggagcccaggaggtctaggctacagtaggctccaatcatgccactgcactccagcctgagtgacacagacaccatgtctcaaaaaaaaaaaaaaccccaaaaaacaaacaaaaaaaagatgaatgtcaattagtaaaaacaatagctggcagtcatagaaaaaaatcagataccagaaattaaaatttggaaaagtcttatgtcatagtacaaaagcaaaatgctgaacacaagttaacaaaaagtaacgtgcacagtatttactgagtcacaagaaaaagacaggttatgcttacgcaatcttaaaaagtatggctgtgtgcaatacacttagaaaaaatttccagttgaagtggttaaataaaataaaagcaattctaacacctacgagctggttatcttcagttatctggaaatggcagctatgcaaagcaaatagataaggaattaatatataatatttctctcctaaataagaactttcaattagctaattcattttaaagcctcccgtactcccacttacttaagaacagtcagtaaagaaaacagttctaacatggaggaggaatttatttacatcctgaaatgctcatatggtacagcttttaattaaaaaaaaagcaaattctacatttacatatatagcaaatgtatgatatttttaagatattctttactgggctttctcgtacaataatgatcaggagtaaaactgtcacctgctaatcatttctggcacatagaaacaacagcataaagctttcttactaaaacaaacaaactaaaacaacacaatagagtatagcacataatcagaaaagtaatcattttagtctttaaatttttaatacagcttttatgtgtccttgaatttactctaattcaaaattttagcttgctgaaatataaaatggtactacaaattttaagctaatttttaaattgctaaaactgtattaaattacagattttttcctttttacagatctcttcagttgcctaagagttcatagctacaagtaacagatattccttacgttaaaatgtctaaaattaatgctatgtattaatttatgtgaaacttctaaaaagtctaacattttgatgttattttagatctacattttttttctggcattaaactgcatacgaccagagaaatcaaagtaaaagtcagactttagccaacttcattttaagctaagctttaattttcatttaagctgtatctttaaatgcttacatttaaattttctaaagcaaaaatctcatattcagtgaaggagcaatcaaacatattgtgaacaaaataaaatcattaagatgttacagtcccagcaaaggcagtatgaataaatgcagtttttcacatacatagacaaactacacttttaaacaataaaacatgacttacatcatgacatgaatagagatgctgaaaatgttagaatgcaaagtaccctcaaggtcaacaggattttcttttatattcatgttacatgcgctcctttattaaggtttcaaaaacaatacttatgaaaagcagtcactatgcgatgagagaagccattttaagacttgtaaatcaactattttactaaaaacaaaagtatatagtaaacagtaacttgaattagaagtggttggggaagaagccaacaccattgcttgtagctaaaactggacaaagtaaatacatttttttaaatctctaggaattttgaaaaaggagcaagtcaactttttcagttaaaaagcaactacatttgtgtttgagcagagaatatctgtgccaagtttagcccactgtgaattaaaatggctacatttgtaagcaggtttaaaactatgcttaataattaaaagaaaactacctacacttgaatatgttccacaatactacaatatattataatatgatatttctgactctacgctgctctaaaacattttcccaacttcttcttcctaattctaaataggaaaatgggtctttttctgtggaagttgatagaaaagtctgccaaaatcccctttgactattttagtcataaattttgctgttgctgtttttaggtgggggtggcaagtggagccttttttaaaggtgcttcataatgtgtatgactgtgtattcagatgtattacaatttaaatagatttttaacagcaaattttgatgcttatatctaattatttttttccattttaaataattcacaagtgaccaacacttgctttcttggcctgactactctaagcctatttaatctttaaagatcaaactccaggagtccatagttcagagaaacacatgctttacgaaagctgggatgtggttgcttaatacagagaagaataaagcactgaagtcatcccacagtggagacaggaaataaattatttttattcatggagtacaatgcctagaactttatagtcattaactacagttaccagattaggcctgaaaggtaaatatgattactttcattttacaaagaaactgtaaaaactgggatttctcagtttctgagataacttgcctggggtctcaatgatagtggcaaagcaaggattcaaacttatgatttcattttccaaattccattctcttttcaccctaccttcatccaccccattatgtagttgcagcatttatcaaagagctggctggaccggtcttttccaactgcttgcagggcatgttcaaagactggactttttttgggcagacctgaatgaatttaaaaacccacatctaaactgaaccatgcccagagtattcctaagcattcactattacaccgatgggtaccttggggtgccaatgctgtcccatcaccctgaagctgcatcagtcccagactcccaatagcagccactgctattgaagtacatttcctgaactctgccagcaatgggcagttctgggcactggcctagagattaagcctcttgcttcttaagagcaatcattgccttgctccaacactgccatgaataacctgctgggttagattctctttcacactctgttgggcgacatgaatacacatcagcagcaaaaaattaacacaaactttcaaaatttaacagaatttgccatttatcaaggcatggaagggtgagaaccactggcctaggcacaccagtggacacagccaacaaacccagtacacgttaatggtgaccactacctgcacttgtcaattcaccagtcctaaaagccatccaagaccctccccatcagcttgctctaacaaagattcttcacccagactgttacatgacaatgccccttgcctgagcaatatacatacctattctctaagagtgggtaacactggccagttaatgtcaagcaataaatgctttgcaaataaaatatgcatcttagttgttaatttccctccttccttccttccactatttcttctacttcaggttaatcctctcttcttttggtgtctgttgctactactaccctagtccaggtcttcatgcttttcactcttcaatagcctttgaactacccagtctttctcatcaatacaattcactctacatactgctacctacctgataaaactctgctcagaactctttcaatagctctatatagtgaactcaatcaaattttaacccctatgcctaacttttaaggccaaatttatatcctccttatttatttatccaagctaatttcctacttcagatggacaccaaagaatcaaatcagccgtatcactgaacaatcacaaaatggcccatatatcaaccctcatgcttcctaacacagcatctgttggcttgaccttctgatggtgtcaatgcactgtcttcccacactttaagccttccctgtatctttctgtgtcatgtgctcaccctggatctatacctttattagctctacctattaacatccttcctctctttcaaagttccgctcctacttctttaggaccttccctggtcttccctctgagaactccatctctctagtctatgtacaacgttcttgatactgcatatcactcgactctctgtcttgcattttagttatactggtccacgtttcttatcttgcctattagagcatgaaattctaagggaagggggttgtagacttatccttacatcaatcctagtaactcacagcgcagagcattccctgaaatgatccttggcaaaaggcatcaaatactctacctgatagatgtggtgagaaatgaaatataaacaaaatgaccaaacttcaattatcaaaaagtagagactgaaaaaatggagactgataccagctcttagtaatattcattttgctctggtcagattctctctccttggctgggcgcagtggcatgtgcctgtgatctcagcactttgggaggccgaggtggcggatcacctgaggtcaggagtttgagaccagcctgaccgacacggtgaaaccctatctctacaaaaataaaaaaactagccaggtgtggtggtgcatgcctgtaatcccagctacttggtaagctgaggcaggaaaatctcttgaacctgggaggtggaggttgcagtgagctgagattgtgccactgcactccagcctgggcaacagcatgagactccatctcaaaaaaaaaaaaaaaaaaaaaaaaaaaaaaagatctctccctatgaccattttctcagtcaccctagacatgttccattcatttctgcttccatgatctctgctcacactgccccccatactggcttttccctttcttcaacttccacaacaggccttttctgaattgatacaaacacattcacacaggtaccacaatgtgtgtcatctcaaaagcagaactgagctggtttgtctttttgtctttttgtctactgaagcaacacactacaacagctaaacagattttacaccaaatctgaagggctttcttctgtgtgtgacacaacacacataacaaaaatttgccatgattctgtttaaatggacagtttagttactgttaagcacattcacactgttgtgcaaccaatctccaggactattttcaccttgtaaaaccaaaattctataccaattaaacaactctcattcctcccgcacccctgctccctactcctggcaaccactcttctatcttatttctatgaatttgactactctaggtacttcataagagtagaatcatacactacagtctgtgtcaattaatgatagggataccttccaagaaatgcatcgttaggtgatttcatcattttgcgaacattgtagagcatatttacacaaacctagatggtggagcctgctacacaccgaggctatatggtatagcctattgcttccagaccacaaacctgtacagtatgccattgtaccgaatactgtgggcaactgcaacagagtggcaagcatttgtgtctctaaatatatataaacaaagaaaagacacagtaaaaatactgtctgaaacattttttttaaggtatagaagatttttaaaaaattatatacctgcatagggctcttgcaatgaatggagcttgcaggactggaagatgctgggtgagtcagtgagtgagtgagtgagtggtgagtgaacagggatacctatgacattactgcgaacttttatggaactggcagcatggtaggtttgtttataccagcatcatcacaaacatgtgagtaatgcactgggctaagacatactgatggctatggcactagatgataggaatttttaagtacctttataatcttatgggaccactgtcgtatatatgatctgtcgctgactgaaaaatcattatgtgacacatgggtggatctgtccttctgtgactggcttatttcacttagccagtccacccatattgtaacatgtatcagaaattccttcttttttaaaggtaattaatgtttaattatatgtacgtattagcccattttcacactactataaagaagtatcttaatttataaagaaaagaggtttaattgaatcacagttcctcatggggaggcctcaggaaacttacaatcatggtggaaggtgaaggggaagcaaggcacatcttacatggtggcaggagagacagagacagagagggagagagaaagagagagagaaaacggaggaaatgccacaaaacaaccagatctcgtaagaactcactcactatgacaagaactacaagggggaaatccacccccatgatacaatcccctcccaccaggcccctcctccaacatgtggggattacaatttgagatgagatttgggtgggacacagtgcaaaaccaaatcaatgtatataccgcattctgcttatccattcatccactgatggacacccgggttgcttctacctttggactattgtaaataatggtgctgtgaacacaggtgtccactctggaggggccatgtgaagaggggagaggactagggcaccacaatggaaaaaagtcatcttccaaaatagccaaaaataagagacaataggtgtcccacaaatatatatactgacggagacaagtttatatttataaagatgccatggagcaggagcactcacaaaacaaattgagtgccaaaataaactcattaatgtttttgaatacctggtatggactgataattgacaactctaagtgtttgtacacacaatttagcctacccagcactgctgaggagtgtgtgtgtgtgtgtgtgtgtgtgtgtgtggtgtaacacagctgccacactgcctcccaaacatcaagaagagcaagaatgtaagaaactcctgccaacatgtccctcccaaggtcccttgtctggtcagaaaaagcttgagaggaaagagtctcacaaaggaaagaatttggacgcaactttccaagagagacctttctgaataggcaacagaggacagtggttaaggtcaaaaattcaggaggcaaactgctgagactcgaatagtgatcctatacataatagctgtgggaccttaggcaagttacccagcctctgcgtaacttgtataactctaccatctgtaacactgaaaacagtcaaaaccccttcacagtgttgctctcaggtttaagtaagtcaatattaacaaaggtatttagaacaatgcctagcccatggtaaacactatacaagtttctgtaaaagaaatgaggctaaagctgatcacgtaattggaataaaacactcctcagcaaatgcaaaagaactggtcataacagtctctcagacaacagcgcaatcaaattagaactcaagattaagaaattcactcaaaaccacaaaactacatggaaattcaacaacctgctcctgaatgactcttggtaaataatgaaattaaggcagaaatcaagttcttgaaactaatgagaacaaagagacaacataccagaatctctgggatgcagctacagcagtgttgatggaaattcgtagcactaaatgcccacatcaaaaagctagaaagatctcaagttaataacctaccatcacaactaaaagaactagagaaccatgagcaaaaatacccgaaagctagcagaagacaagaaataaccaagatcagagctcaattgaaggagatagagacacaaaaaaacccttaaaaaaaaatcaaccaatccaggagctggtttgttgaaaaagttaataaaatggatagactgctagctagactaataaagaagaaaatctagagaagaatcaaataagcacaatcagaaataataaggcgattatcacaacagaccccacaaaatacaaccattagagaatactataaacacttccatgcacatgaaatagaaaaatctagaaaatatggataaattcctggacacatacaccctcccaagactgaaccagaaagaaactgaatccctgaacagaccaataatgaattctgaagttgaggcagtaataaatagcctaccaaccaaaaaaggcccaggaccagagattcacagctgaattctatcagaggtacaaagaagagctggtaccatttccactgaaactattccaaaaaactgaaaaggagggactcctccctaactcattctacgaggccagcatcatcctgataccaaaacttggcagaaatacaaaaaaagagaaaacttcaggccagtatccttgatgaagagtgatgcaaaaaccctcaataaaatactggcaaactgaatccagaagcacatcaaaaagcttatccaccaggatcaaggtggcttcaaggtatgcttcatccccagggtgcaaggttggttcaatacacacaaaacagtaaatgtgcttcactacataaactgcactaaagacaaaaaacacatgattatctcaatacacgcagaaaaggccttcaataaaattcaacatcccttcatgttaaaaaatctcaataaactaggtattgaaggaacatacctcaaaataataagagccatatatgacaaactcacagccagtatcatactggaagcatttcccttgaaaaccggcataagacaaggatcccctctctcaacatttctattatgcatagtactggaagttctggccagggcaatcagtcaagagaaagaaataaagggtattcaaataggaagaaaggaagtcaaattgtctttgtttgaagacagcatgatccagcatctagaaaaccccatagtctcagcccgaaagcttcctaaactgataagcaacttcagcaaagtctcaggatacatcaatgtgcaaaaatcactagcattcctatacaccaaagacaggcaagcagaaagccaaatcatgaatgaactcccattcgcaattgctacaaagagaataaaatacctaggaatacagctaacaagggaagtgaaggacatcttcaagaagaactacaaaccactgctcaacgaaatcacagaggagacaaacaaatggaaaaacatcccatgctcatggataggaaaattcaatattatgaaaatggccatactgcccaaagtaatttatagattcaatgatattcccattaaactaccattggcattcttcacagaattagaaaaaaaaataacttttaaaattcatatggaaccaaaaaagagcccaaatagctaagacaatcctaagcaaaaagaacaaagctggaggcatcacactacccgacttcaagctatactacaaggctacagtaaccaaaacagcatggtactggtataaaaacagacacacagaccaatggaacagaatagagaactcagtaatataactgttgcacacctacaaccatctgatcttcaacaaacctgacaaaaacatgcaatggggaaaagattccccgtttaataaatggtgctgggagaactggctagccatatgcaaaaaactgaaagtggaccccttccttacaccttatacaaaaattaactcaggatggattaaagacttaaatgtaaaatgcaaaactataaaaaccctagaagaatatctaggcaataccattcaggacataagcatgggcaaagatttcatgatgaaaatgccaaaagcaattgcaacaaaagcaaaaattgacaaatgggatctaattaaactaaaaagcttctgcacagaaaaagaaactatcatcagagtaaacagacaacctacagaatgggagaaacatttggtaatctatctttctgacagtggtctgatatccagagtctacatggaacttaaacaaatttataagaaaaaaccaaacaactccactaaaaagtggacaaaggacatgtacgagcacttcttaaaagaagatatacatgcagccaacaaacatatgaaaaaaagctcaacatcactgatccttagagaaatgcaaatcaaaaccacaaggagacagataccatctcacgccagtcagaatggcgattattaaaaagtcaaaaacagcaaatgctagcgaggttgcagagaaaaagatatgcttttacactaccggtgggagtgtaaattagttcaaccattgtggaagacagtgtagcgacttctcaaagacctagagtcagaaataccatttgacccagcaatcccactattgggtatacacccaaaggaatataaatcattctattataaagatacatgtatgcatatgttcactgcagcactattcacaatagcaaagacatggaatcaacatgatagactggataaagaaaatatggtacatataaaccacggaatactatgcagccataaaaaggaacaagatcatatcctttgcagggacatgaatggacatgaagttactatcctcagcaaactaacacaggaacagaaaaacaaacaccgcatgtttttacttgtaagtgggagttgaatgataagaacacatggacacatggtagggaacaacacacactggggcctgttgggggtagcagggagcatcaggaaaaatagctaatgaatgctgaccttaatacgtaggtgatgggatgatctgtgtggcaaactaccacggcagatgtttacctatgtaacaaaactgtacatcctgcatgtgtacccctgaacttaaaaagttgaaaaaaaaaaaaaaagaaacaaataggctgggcatggtggctcaatgcctgtaatcccagcactttgggaggccaaggtgggaggattgcttgaggtcaggagttcaagacctgatatagtgagaccctatctctagaaacactttgaaaattagccaggcatggtagcacatgccagcacatgcctgtagtcacagctacttgggaggtgggaggatcgcttaagcccaggagtttgaggttaggataagctatgactgtgccacagcactccagcccaggtgacagagcaagaccctgtctcaaaacaaattaagtaaataaaaataaatcagtagttaaaattctatgaaactggccaacactacaagggcagtcaatgaagtcttgctgcctcaaccaatttataaatgtgttagttcctcaatatacacatacatagccacacagtttaattgtccataactaaagttggtaaaactgtcttgcaatgatgcatgcctgagggaaaaaagcaacttaattgctttgttaatcagcaatgaattttgttttaacaaaggtaacaaatattactcatgactgctcttatttagtacttaaaatattactgtcttgtttatactcttttaatgagtgaattctaaattttagtgtaacaaaatataacggataagctatataatcttccataatattggaagatacaaaaggaacaaaagaaagaccttaggatgaattttccaatgctcaaatgcattccatttaataatacatgttcaaaaccatgttgtctactcaatgtattttgtgcaaatgccatattccatacaaaaactttttcaatacacatctctttttatctaagacaacttctgaatataactaattaaaaagctctgaggattcttttctcctaaaaacaaactttttaaacttttaaaaaatgctgctaggatttgatgtatttttaaaatttgttatctgtactacagaactcgataatatacctaatacttccatgagctgatattacatgcgtaaggaattattcagccaaccaaccacttctaaattatttatctgttttgacaaatgaatgacattaaagtcctcatagttttaaaattcaaaatatctggattatttaaattaaccacaataagcaatcactttcagcatcttgaaaattaaacaggaagcaaaacaaaacaataaaccctaaggcagtcctttgaggcctgtagaaaatcaaagcttctcttactaagtggctttcataagtcaactttgaagttttcagaaaattcaaaagaattctataaattattaccctcaaaatttaaaacataaaaatattgccttttgttccctctaatgtttataccaatgcaaattaaattacttttatgttaaaatgcttttggtttaatactgcattaaatacttcagcttccttctctggttctacatctacaaacacatttttcatttggtcatcccaatactaagctaacatacttgccacagattgtcacatgctgaattaatgccaagcagagacattctagaatgcactagatattgcaggagtgccagaatacacattataatattactacattaccttttttttttttaaaaaggacttctccctagcccaaacttacacacttttcttcttttgcaattacacacacacacacacacacacacacacacacacacacacacacacatccctacatggttagaaaatctctcctggaattttttttttacccaagctgcaaaatttatgtaaggtagattccaaatatgctgtttaacacatacaaaatataaatgataccactagatagagtacatgaagatagtatttcagaaataatagcctataagccattaaccattaacttatattctatttcactacaggcactaaacaggaaagataaatatttagtatcctcctatggtcaataaatttgaattatttcaacagtcattgcaaatacattagcaagtgcctaaagttgtaactccataggttagtaaaaagtttcaagggacaaagtcaatagtagaactgaagtttattcgaagccttggatcaaatatccctttaaaaacttgcattctaataaatgaaatcagtgtaaaatttctacttatgccttttcaggttcttaagttccattctgtcatacataatatccttcctagaaggtcacaaaaaactaaaataatatatgaacctttccacaccagtaccatttcaaagttgatccaaaaaaatcaaataatcagtgattatttatagcactttaaaatgggtgaccaacttgaaattctaagaacaaaagatccctactttctctttcattaaggatctagtatcacttgaagctttcattctaattcagagttaaggaaaagtgaaggccggacacagtggctcatgcctgtaatcccagcactttgggagggaggccgaggcgggcagatcacttgaggtcaggagagttcgagaccagcctggccaacatggtgaaaccccatttctactaaaaatacaaaaattagccaggcatggtggcgggtgcctgtaatcccagctcaggaggctgaggcaggagaatcgcttgaacccgggaggcagaggttgcagtgagccaagatcgtgccactgcactctagcctgggtgatgaagcaagaccccatctcaaaaaaaaaaaaaagtgaaagagaagacaattgaacatgagttccatgggaaaacataatctttctagaaaaatgtgtttcaaaaatccattttaggttgactgtttagaacctgggacactcttgtgaacaatgtcataaatgattataaggttaccccagaccagcaacaaaagcctttttaatctatatattctaggaccagcaacaaaagcctttttaatctatgtattctatggccagcaacaaaagccttttaaacccgtgtattctaactgtatagcactacagtatacttacagttctacaaggactaactggcatgagcacaaacatttcagtgagaaaactcagaattccaattagggggcatcaggaatccatcgactctctaccttgctgcagtgaggcagtgcctcccactgaatgaggtggagaggtgggaaaggtttgagaatggctgaagaccagatggggactggaagtttgagggtaggtactaagcttgagagaagatagacatgggtaaggaacagagtgtgcggggcggcagcccacagagctataacagcaagcagttctcagcccaagccagccttctgcctctctttcaattcacctcatttgctacctctgcccacctcatctgctcctcctctggtccgctacaaaatagaacacagcctctcttatgtctccattaataacaaactctctagatttctaaggattttagctgcaaacagcggcagtattaaatgggccctcttatgcactgattaatggtgagctgtttctggaggaaaatgagactctattctgtgaagtggatgaaagatagatggcttctctggactagggcagggataaaagcaggactggggggagtaaagttccatgagcaggagagagagtgctccagctacagtaaatgtctcacaacatcagtcaggattatgtaaatcaaggcctgcttattaacaaaacttcaagcactcaaaagacaagagttctaaactgtatttttaaaaaataataaacacttaagtgtctcaagaagacaatttatttaatgtaaaatgtgcctcaagtggtgttcatgttaacatactctcttcaagtgttgacgcccaaactgcagttctgtagtaaattacaatggccaagataatctaagagtaatttaatgtccaaattcctcaatcacgcctggaaacatttaagcctgtcatgctatgtatgttaatagttaggaatgagggcctgtatattaaccacatctgaaaagttaaattatccttcatacaactccaaaggatcacaaataatgcaatatggttactccccaggggtaaacaggcaatgtgtgacatatgggactctaggggtaaacaatcatgccaaagacattcacaggcagttttctcaaataatttgtaaacatatcatgcaggattcataaagtttttctctgctcagagttgtcttcaaatttagaaatgtattttttcagccagataaaagttcaaagcattttcagagacatgtaattttttcccacaggattaacagcacatccactcaacaactgacccaatatgtactatcttctctcttcacaaggggtctgagggattacaaaaacaacagcagcagttagtaatgaaaccttgacttttagaagtacatataatgcttggacccattccaagtaccttgtaaaatcctattaaaatgatgaatcattcataatttagatttgttttagccataaaatcctaaatgctgcacaagcactaaatacttctcatcaacttattgtgcttagtatttttctgctactgttgctctgcaaatcacagattttttttaatcggacatgatctgaaagagcatctagtccaacaccctcaaaaatgtttaagtaatttaggcaaaatgatgccaagtgatttgcctaaaatcaaataatgcccaaaggatacaggaaaacatgatttaagttcaggcggtcagctagcagaagcagagctgaggctagaaggcagctagaaccagggtcccatgtccaacaatcctcccagcacaccaaacaggaactcccactccagccccaatacttgcctccaaacacaatgaatggttgtgattgttgtagtctcacgaaatgacctttccaggccttgtcagggagctgtctttactaagtggaattaaaatctatagtattgtatataaaatatcctaatcaagaaataatcaacttgcttgtgttcacaaacagtacttgaatttctcaggatgttttgaagtgtacagaaatctacagacaaaatcctaactctaagcatttaataagaaaatgttttatcaagagtagaataatttcacgtgtatctccttctttgaagccacaaagacagtgctcttctagccctcgtcctggccaagccaccgaacctgctatcctgacctatgcaatggcttttaataactgtttgcagccactgggtgtaaatatcaaactgcttgctaaacatttattacttctctttttcacaatatccctattgacagagataagcaaagggattcagattaaggcctgtagctgcactgagctcagtaatttttttagatagctgaagcttaaacttttcattattattgaaatgactatcaatctgaacttgagttgcctgcctttttcctttaaaaagataaacactgtcataagaaactattttacaaaacaaagaacatcatttatcacacatatccaaaagtggagtggatgctcaatgaggcagcttctgagtgtacattattcgccaatgcattgctggttctcagcctagtgcctacctcatattaccgaaaataccagtggaagggaggcagggaggaaagagtagaagttagagaaccaagatgtagctaacaagtactcaagctgttaggttgcagagaaacctaacttttgtaaatgacagaattactgcttaatgtaatttccatatgcatctgttccctgtattcctgaatcttttattatgaggacatttcatcagttcagtttgctgacaggctaatggacaggttaatcatgacttttcaactacaaaggcatcattttaataattgacaatatcatcaatgtaaaatataatggcagattcacattaaattggcctataacagttttctttaatgtgaacaaaattcaatctcttctcttttaatcatcttcattctatggattaaggaacaaactacgatagtgggatttacttcttaaatttatccacgttgaatttacacacatgtacttttatcttactagcctgggcaacgtggcgaaaccctgtcttcactaaaaatacaaaaaaatcggctgggcacggtggctcacacctgtaatactagcactttgggaggctgaagcagacagatcacctgagatcaggagttcgagaccagccgggccaacgtggtgaaaccctgtctctactaaaaatacaaaaattagccaggcttggtggcgggtgcctataattccagctactcgagaaactgaggcaggagactcacttgaacccagggggcggaggttgcagtgagccaagatcgtgccattgcactctagcctggacgacagagcaagactccatcttaaaaaaaaaaagaaaaaaaaaatgagctgggcatggtgacatatgtctgcggtcccagctacttgggaggctgaggtaagaggatcacttgagcctgggaggtcaaggctgcaatcaatgagccatgattgcaccattgcactccagctgggtgacaaagcgagaccttgtcttaaaaaaatttttagatatccagaacaagtgtagaggtagatataacctagccccgctacagcacaatcaatcaatgcctcaactataatgtctctggtctcacttcaagcagaaaccttattatactgtaagatagcacctgttagaaaagtaacacaaaacactccaagaacaagacttgtacacatgcagctacatctctaaaatagataaatttactggacttctgtattgttaatttgcattggagtaaacttcttaagaagagagtgtaggaaatttcactgaaggaaataaaaaacaactgtaatcattttaattattttcaatcaatatttcttgtccatgctaatttgctaaagcaataaaaaggaaagagctgagtaaaaaatagttcctaccccccaggggcttataatctgaaatattaagcaagtaaacaattggctacaatacaaagtgaggtaggtgccctaaaaagcataaagaaaagtgttttgtgggtcataaagcctagcaaagaatctaagagattaccctcgacaagcttcctttcaacaggcagagataagggaaatggcattccctgaagagcaaacagctgagcagaaactttaaaaagtacaatagagataaaacacttatgctagaatacaggtgccagtaaggtagtaagggaaagacaagccaagatgggtatatttgggcattattatggaagacctggaaaagctaaagagtttgttcttattttagcagctatgagaactacgtaatttggggctaaagagtggtacaaaattactgtgtttagcaaatttaatctcacctcagtgtaacagatgaactagattcaatcagacagggaggtgttacagtagtccaggtacaaagcagtgagggtctgaataaaggtggtggctgaagggatgataagggaggtcatgtatacatatagggaggttgtagcagtagaatgtacagctttgcagatgagcacatgtaagataagagagaagagtctcagaatgactgacattttgagcctgggtgagtggcagtgccaattaatagaaaccaggaaatttggacaaagaactggtttgggtggagggaagtaaggagtttcactttggttgtgctgcactgaaggtggaagcaaggagatacccagggagaaatgtcaagccagcagttaaagcttagaagaaaggtcaggttaaggttataaatttgggagctatgtaaataagagaaggcaaaagcttggattgcataagatcactaaattaaaagggcatactggcatagaagagagggaaaaaattgaaaatgtggggggcatggcagtgggggatgggagggaaaaggggaaggaaagttagcaatggacacagagaagactggccagaaacagaagaattaaagtcaaggttattcagttcactggaagttcactggagcctgttacctgtgagtattatatttgaggtaaaatgacgagtaacagtatagtccctactattaaaatgtgacgtcaagaaaatcaagcaaaaacaaacaaaaacatacacacatgaaaaatgacatcattacacccatagatacagagctgtcacaataaaaaaaaattatgaacaactttatgccaatatttgaaaatttatatatgggtaatattctagagaaacagacattatcaaatttacatatgggtaatattctaaagaaatgtatgttaccaaaattatctcaagttaaatttaaaaatctatgaatttttacctgagatcccctaacaaataaaaaaagcaaaactgtataatcatgtcaatagatgcaaactagagaagaaaaaaactattagcaaactccgtatagaaggaagcttcttccttcacctgataaaaagtattgataaccccactatacattttgagtggtctccagtcacaaccaactatacttcactagttttaactcctaagctttccataaatcctagattctgtctgacactaaatgaagatcttcatgtcattttttcaaataggaaaaaatatgttctaaatatctcagattttctttactattctattatgtatgtatcatctgtgaatctaattttcataaaaaatttgttcagtctatatcccatcttatggtactaatttccactaacttactctctaatattatatagataattaagatatttatcttaaactgacttttataaaattcctagaagcacccatactctgcccacaattccagcatgatggaatttgagtaattcatccaaggtcccattttagaacctcaattacatcttcctcctccacttcctccttagtattaaaagccccaaggaataaatatttattagtatactgttacgtagccagacacttcattatttttatttaacagaacatatagtatttatcttgggtgtgtataaggtatgattttgaataatggcaagataacttactattcccatactctcaaaaaatgtctagcatactgtggatcttcttagcacagtatccataatcatctatgatagcttatagattcttttcctgactttaactaaattcaagactcctcagttaataattataattcatgtgattttttcccccaaatataccactgaaaactatctcacatgagttcactcagttttttgctcactcattatctgcagttaggtttttttcctgggatatttcactatccaaaagagctaaaaattgactacatacaccttcttttacaccatttattaaaatgtgaaattaaattggccccaacttggggacccacataatacactttttcctctaaagagtgacagttcacaactgatgtttacttactaaatcaatgtgattccatgaataaacatttctcctccatcctatggtaacacaaaagattttattcctttcagattagaaccttgaaagattttgtaaagtttacataaattattttcactgtttctcttcaacatactccataatcccctaaataactccagtataccaatcattcaggtttttggtttacaaaaccaaattcaataatttgttttattctaaactcctgagtgttaaaaatatagcaagacaagctgacccatagttatctgtaagtcctctacaaacgttcttataatgggacatcgtcttagtccattttgtgttgctataacaaaataccacagactcagtaatttataaagcaatttgtttttcacagttctggaagcagggaagtccaatatcaagatgcttggcaactgatgatggcctctgtgccatggcagcaggtggaaggacaagagagcatgagagagcaagagacagctaaactcacttttgtaagtacccattgttgcaataacaaacccactcccacaataatgacattaatccagtcatgagagcagagccctcacggcttaatcacctcttcatgatccctcttaatactgtcacaatggcaattaaatttcaacctgagttttagagagggcattgaaaccacggtaaacatataccgacaacctacctttatatgaacatgattgatatgaagagtaataggttatacattttagccaacagctccataactctacctattaattctctgaaaactcttgagtgaacaccattttatcaactgattgtacttgtttgctaattaaacccaggatattctattctttaaagttttgtctgcttctaattctaaaagaaaatttctataaagattccatctaaacatatccctattttttcatccctgagtatataatttacacatgaatatcaaccaatttcaataattactaatgaatctttatctaggtttcttgacttgagagcatttatttgggttcaccttttctttttttccttttttttttttttttaaagtcttgctctgtcacccaggctgaagtacaagcaagatcgtagctcactgcaagctcaaactcctaggctccagcaatccccctacctcagcctccagagtagctaggactataggcacacaccaccaccccggctaattttttttttttttttttttttaagtagagataaagtctcactattttgtccaggctgttctcaaactcctggctcaagcctcatcctcccaaagtgctaggactacaggtgtgagccaccacacccagtgtgagttcacttttaatctttacaagcaactaactctggttttggctcatttaatttctagtttacatcttgcatattatgctaactgggcaattttttttttaaaaaaggaagcaatcttttacaattatgctttttttcaatttttcaaaaggtcacaaggaatttctacccatgcatgtgatttaattactcttacacttcatactttttcctggatactcaaaacagtgttttaaaatatatactagtattcaattatgtttcatacccttttaattaactgtttattaagcatctactatgttccaggcaaagtattagatgtttagaattgatccctctcttaatcgttaggtaagtgctattatgtcgtcttttttaaatgaggaatttgaagctcagagtgctgaaaaaaattgcccaatgtccagaagtttatatgggtcaagagacaaaattggaacgcagttctttctgactctaaaaatcaggctcttccatcatgcacactgatataaagctaagtccccacagacccaagaaggtcacaggcatataacaagataattccagcacaacagttaaagttctaccaattttcctaatgccattttgtgttagaaaacttttctgaaattacttgtgcaattttttcctatataagtttaaattaaatttagtgcagttgaacattcattgactgcctattatcttgaatgttctatgagctgtgctaagtgctcatagtaaacaccatgtagttaagaaatacatttcacaccatgaaccaatacatacaacaactgcaacaaacaagtaattaccgttactgcatgtaacatactgtcatcttttctattctcttctattacagttttcttaacactggtcgtgatccactaaattaattttacaacccacttacaggtcacactctccaatttgccaaacattgtcctaaataaaacaggttgaccagctgaaatcttgactttgtttctgattcaatctggccatcctggcagcagataacacccataagagcttattttgctactaccttagtagtagcataacatacagtgcctcaatccaccctatgctttagtacattctcatatttaatgctgaattacttgtgagagcttcaaatttttcctaatttgaaaatattaggttgttagagccaaactattaatgcaaactcaagttttactttaaaaacatttctttttaaaaaagtaactactgcaatctagcttaaagtcatagcacagtgacagtctatcaccattaaagaaacctctttaggaaaaccaaccaccttaagatatttgaagaaacctaaaccatccgtaaacatgtgtttgtttttgtttttttgagacaaggcctccctctgtcacccaggctgaagtgcagtggcacaatcacagctcaatgaaggctcaacttcccaggctcaaatgatcttcccacctcagcctcccaaagtgttgggattaaaggggggtgccaccatgcctggccaaacattatgtttataagccaactttttctccaaaaaaaagtttttatctggtaaatcttttttagcatactagatggaaagacagaagagaccttagaaatcaaaatgatcatataaactcatttcaaaaatgaaaaaaactaaaggtttagaaagttaagtgatttggccaaagtcatacacatctttaatggtaaaacttggactagaaccttgttacttatctgtcagcagttcagtctctttccactatgtgacacattgtccataccttccaaatatcaataccaataacaatggccaaccctgataatctcccatatctaagttctaaggtaattatggtttggcctatacgatttaagtacgcttgattatgtaagcttgcgcagtgtcctagaattgtttgctggatatacattttaactccccattaagacctttagatatgtcttataaatacactgacccttataaatggttaaatatggtaatataatttacccaataaaactacttgaaaatcagttccatttttaatctccctaattgcatgcaatgaatgccaaaaccttagctctggaatccatcagagttgtaactatcaaatgaaaccatttctcctttaaaaaaaggaactactctctttatttgcacaatctaccttctcccaagggtatgaccaagaaggtttcagttgtaattccaaacccattacagagcatcaccaataatatgaaaatgtatgtcattcttatcttttcttatatcgttagggcattgtttgaactgtttttataaaagtgatttaaacagttatttttaaaaatcaccactatgtaaccatgtgatcttttgaaataccaaatcataaatctgactgaactttataacgatttattttgatgttttgttgatgtggcttaagttatctcagaggaaaaattcatactcaactacaaatcaatgaaaagtctgcaccttctcacatgattcccccgaagatagttctaaggtagatttcaggagtatgcactcttctactttaaggcagtagcaaacattctctagaaaacatatgctttgaaaatgtgctttcttaacacagaataactattctacagtctgaaactcatacaaaaatttgaaacataggcctaacccaatgggccagggactagagaaacctggcccttcatctctgaagaaatttaacaatatgtttctaatctccaagtctcttgacaatggtatctactaggaaaatactcgtatctcttagatgaactaatattaagagtttaatattaatgatacttaagctctacttaatgctaaggaattctatgaaaaatatgtttgcataataacaatcttgaaaaaatggcagaacttcacttaagcaagactgggaaaagacatttattcttatatggcataaactgtgaaaaagctgatagtttattattctctgagatgtgaacagtaccaatataatgaatttatttatgggaaaaattaagatgatcaaagcctacagtaattaaaggtgttttggcacagatgttggtcctcgaatgtttgctttgtcagctgtctaatccattttgacactgcagtaattagcacactctgtataatattttaaacgcaaattcaaccaaaccaagctattatatatggcgaaatgaatgctgatcaagttatcaattgtacttctatctctattactatgttgaccatatgtgtggcacatggccagatcagccatgctcagtatgaagaacacagaagaacattcaaaaccagaagacagtgctgacctaagttaataaaaacacacaaacatccacctgaaggggaacagattctgactctgaaacaaaggaagcacagttacgagtccttcaagccagaatatctcgcaaacaccttctaagacagatttccactctttactttgatattgagcctacatgtgccagacactattctaggcactgaagatacagtgtgatcaataaaatgagggggtgagaactatcctcagggaacctgtattctcttagacaagcttgtccaatccatggcccaggatggctctgaatgtagcccaacacaaactcataaacttttttcaaatgtcatgagatttttttgtttttttctttttttttttctctcatcggctatcgtgttagcatagtttatgtgtggcccaagacaattcttctttcaatgtgggggaagccaaaagattggacacccctgctctaagaaatgcaaatagtttcctgttacctacacactccaaaatactgcctgaagccctaggctaagaaagcttttaaggccatgtgcaaatttcaaaacaaaagttgtaattcattagtatatctgttatggacatgctgaacagctaaagacagaatgggaacttaaatttgccatcctcattctaggaaatcattttctcatacttctacttatatattacataaaacttaatctaataatataaagttttatgctaatctctctcatgattctgaatgggactaaatggttatctccagtagaagtagagggatactacatttaaatggaactactgtctacccaagggctacacaagtattttcatacttctcagactaaacatatgattataataataatttttacctgccatcttagaatttagaaggactatggggagataattttataatccatgtctcccttataaaaagttgatcacagccaggctcagtggttcatgcctataatcccaacactgggaagctgaggtaggcatatggcctgagtccaggagttcaagaccagcctgggcaacatagtaagacccaatgtctgtaaatgataccaaaaagaaaaagaaaaagagaaagagttgattgctttttttcttcccaataagtatccctgcagcaaaaacaagtaaaatcactccactagtcattctacagcagcataggcacatagctctaatagctgtattcctaaggaaccatgaattatgacaaattgttacagaaactactgaaccaatgatttttaaaaaggacaagtggagaataaaggctagaaagtttcaaatactacatattttaattctaacggtgtgtttaatagttataaataaatatcctttttcctaaaaaacaagcagatcacaaattcctgattaaccctttaaaactactgaacatccctaaaagcagaacgcttttcctattagttgactgctacccagactgatgacgtaaaaaccacagcagaggagaaataacttcaccttacaatactgccataatgctttgacagtatgtatactaccataatgcttttacctcaaaaggtattttcacattcattctgtcatttagctaccaaaatatttgatggcatgactaaaaagactacttgtttttacataacagggaacatcattaatctagattaaagtcatcttttcttggccttctccctgcatttcatgtctcatagtctgtttcctgttagagttattatatatggttattttccctaacatagttctttgagggtagcttctacattttataaatctttgtttcctccactacctatacatgaaggtggcagtttaacaaatgcttgcttaatgagttccgcctgcttcaaacatactcctcccacattattttagctatcaaattctaatcttcaaaatttatttgaaatgccctcctctaccagggtgcaaaatcaacacacaaaaaccagttgtgtctctatatgccagcaatgaacaatccaaaaaaaattaagaaaattccatttaccatagcatccaaaagaataatatacctagctgaagaggcaaaaaaaaattttttttttttttacactgaaaactacaaaacacggctggccagagtgcagtggtgtttacaactaactgatcacaaccatttacagatttatttgtttcttctccactctcactgctttacttgactagccttaaaaagggaaaaaggccaggtgcggtggctcacgcctgtaatcccagcactttgggaggccgaggtcggcagatcacgaggtcaggagatcgagaccatcctggctaacacggtgaaaccccatctctactaaaaatacaaaaaattcgccaggcgttgtggtgggcacctgtagtcccagctactagtgaggctgaggcaggagaatggcgtgaacctgggaggcggagcttgcagtgaacctagatcgtgcgccactgcactgtagcctgggcgacagagcaagactccatctcaaaaaaaaagcgcggtggggggaagatgccgagcacagtggctcacacctgtaatgtgagcactttgggaggccaaggcgagtggatcacccgaagtcaggagttcaataccagcctgggcaacatggtgaaatcccatctctactaaaaatacaaaaattagctgggcttggtggtgtccaccagtgatcccagctacttgggaggctgaggcaggagaatcacttgaacctgggaggcggaggatgcagtgagccgagatcatgccattgcactccagcctgggtgacaaagcgagactcagtcgcaaaaaaaacaaaacagaacaacaacaaaaaaaaccctacaaaacactcctaaaggaattaaagacttaaataaatgggaaattatcctctgttcatgcattaggagacttaatactgttaaaatggtaataatacccaaagtgatctaaagattaaatgcaattcctatcaaaattccaatggcctttttaatagaaatgagagccaaccaatcctcaaattcatatgaaaatataagaggccctgaatagtcaaaacaatattgaaaaagaagaacaaagttgaagaactcatatttcttgctttcaaaatctactacaaagctatcataatcaaaacagtgtggtaccagcataaagacccatataaaaatcagcggaatttaatgcagagtccagaaatacattatctatggcaaactaattttcaacaatgatgtcaagagtattcagtggggcaagaatggtctattcaacatgtgatgctggaacaacagcatatccacatacaaaaaaatgaaattgaacccccacctcattctatatataaaaaattaattcaaaatagatcaaccaccaaaatgtaaaaactaaaaccataaaattctcagaagaaaacacagcaggccaaatctttacaaccttgacttggcactaaaagcaaaagcaaagaaaaatggataaatcaaactttatcaaaatttaaagtgtgtgtgcatctagggacattatgaagaaaactaaaagacaacatacagcattggtgaaaactatatgtatatcatagttgataagggtctagtatctaaaataaagaactactgcaactcagcaacataaagagaaaccgattaaaaaatgagcaaaggacctgaacagacatttctccagaggatatacaaatggccaataagcacatgaaagatgtcaacatcattggtcactagggaaatttaaataaaaactgcaatgagataaccactttacactccctaggatggctatattacaatttttgaaaaaaattgctaataacaagtgttggtgaggatgtagcgaaattagaaacctcatacattgctgaatataaaatggtgcagctgctgtggaaaacagtgtggcatttcctcaagaagttaaacacagaattaccatataacccagcaattccactcctgggtatatacctgaaagtgtagacagatagtcaaacaaatacatgtacacatattgacagctattcaaaatagccaaaaggtagcaacagccaaaatgtcgatcaatgaatgaacaggtaagtaaactgtggtatatccatacaatggaatattattcagacatagaaaggaataaagaattgatatatgctacaacataaatgcacctagaaaatttgtgctaagaaaaagaaacaaggtacaatagaatatgatactatttatatgaaatatccagaataggtaaattcatagagacaacatgcagattagtggttgccagccactcttgaaggggaagttacaaggaaaaactgtttaatggatactgagtttccatttgccataataaaatgtttaggaactagagagaggtggtggttacaaaatattatgcatgtaccaaattccaatgaattgtttgctttaaaaaggttaagtctatattattaactcaacttcacctcaatttttttaatatcttctttgtcttagactccttaacagagatttataccctcctgtgctggcctgcaaaaggacaaattcttctaataaacactgaggtaatcactctacattttatttgcatttcaaatatacataccctgccctaaaattttactttgaatgtggatcatttcatcttgcttaattctgcagtgtctatctctcccagttccatctttgatatttctctttctcttcctaggctctaagttttgctgcaatcccttaggaaagagaaacagatacaaaaactttgacacaaatattttgaggttatccctactctgaattaactataacaaatgcagtattttttatttatagaagcccacactaattaagctaatttataagtaatcaggtaaattttagtacattttaaatgcctccaaaatcaaatcaggatcaatgagcaaatgaaagagcctaacataaaactgtagcatacagcaagaaaaccgttgatttgtcccttttagccatatgtttagttttcagacaagctagtcattatctgagaatttagcacatatttttctggtacattttaatgaaaattcactatttataccttcatcacctttcaagttagtgaagtcccaagacaaaacaacacataaattaaatgctattctacaagtcttaactatgaatttaattagcagtacaaacagaacccttatatttaaagggtagttaattacagcacaggagattttaaaagaggtcattggaagattttatgttcatggttatttcatcccaccaagagagtttcttgcaatacacctgtttaaaagccagagttttcacaaaaccattcatttccacataaacagaagactgcaatataatctgtcatttaaaatgttatttgtaggccgggtgcggtggctcatgattgtaatcccagcactttgggaggctgaggtgggcagatcacctgaggtcagcagttagagaccagcctggccaacatggtgaaaccacatctctactaaaaatacaaaaatgagccaggcgtggtagcccatgcctgtaattccagctaccagggaggctgaggcagaagaattgcttgaacctgggagaaggagattacagtgagccaagatcacaccactgcactccagcctgggtgacagagtgagtggagattccagctcaaaaaaaaaaaaaaaaaaaagttacttgtaaaatactgatctcattgtggcctctggccaaacacactgcttaatggcaaaagctgtttttctaaaaggccaaattaaattaaaaaattaagataaaattctatgcctaaatccaccattgctaataactttgcattgttaaataaaatgaccctgatcttaatctgttatcattttataatactagcttcttcaaaacaaaactgtctctacagagcaaacatttacaatgaaaattctagctttatgaaaatgattgagggcccagcgcagtgactcatgcctgtaatcccagcactttgggtggccaaggtgagcagatcaacagcctgaccaacatggtgaaaccctgtctctattaaaaatacaaaaaaattagccaggcgtgattgtgggtgcctgtaatcccagctacccagtaggctaggcaggagaatcacttgaacccaggaggctcactgcactccagtctgagcaacaagaacaaaactccgtctcaaaaaagaaaaaaaaagaaagaaagaagaaaaacatgattgaatagaaaaaaataacatgtatgaaatcttaattcattttagatgtttacatattctaactctttaatatgcataaaaatgaggacattttgacatatattatctcctaccattattcaaaagaatatgttgtcttcagctttccctaaaaatctacttttacagaacgtagaaccaacctgttccattaatagagaaatctgaaataatccaattatatgtaaatacatttctaaatgtccaaaatggaatgccaatacttacgacgctcaatcatttatctaaatgggctaaatattttaagtctattcagagacagtttaacagtgaagtaggagttaactgtaatcagaaacctagtactccttaagaaggatcaagagaaaatggtaacttttggaaaatcccaaatattttaaacacaggaacatatctagttttgacaagccgtatggccgcagtataaatgcttccatcttcagtagctgttaaaacaagcagtcctttacaattttgacagagaacagaattcatttcctccatacagctgcattctttcaaagtccgttaaacattggtgtgacaggattgatttttttggagcacagatatttactgtattgccctaaaggacctaattttaaaataaataaggaaaatatgtgtttatgtgagcaaaggggagaatatagaaaggccaagtcaaacaatagagggaaaacaagaaaaaaggataatcaaaaccatacgtctacgttaatgcacatagacatatttagatggactttttaaaaccttttttcatatagtataaaatcaatgctcaaaacaatccatcaaagaataattgataaatgaaaagacaagccaaaaactgggagaaaataactcacaagtcgcatatctgataaaagacttctgatcagcaaatataaggaattctcaaaactcaattaaaaaaaggtttttttaacgtgcaaaagattttagcagactcttcaccaaaaaaagatatacagatggcagataagctcacaaaagcatgctgaatatcatttgtcatccaagaaaatgaaaactcaattacatatcccactatacacctatccgaatggttaaaagaagaaaaaacctggcaataccaagtgctggtgaggttcagagcaactgaaaaccttatatactgctggtgggaatgcacaatggcatagctactttgaaaactatttggcagtttcttataaagtttatgtttaacaagttaagtttacaagtaaataagcttgctgaatacagtggctcacacctgaaatcccagcaccttgggaggccaaggtgggaggactgtttaagcccaggagtttgagaccagcctgggcaacatggcaaaaccccgtctctacaaaaaacacaaaaattagtcaggtgtagtgatgcatgcttatagtcccagctacttgagaggctgaggtgggaggatcacctgagcccggagaggtcgaggctacagtgagctgtgatcctgccactgcattccagctggttgacagagttaagactctgtctttaaaaaaaaaaaaaaaaaaaaaaggcctggcacggtggctcacacctgtaatcccagcactttgggacgccaaggtgggtggatcacgaggtcaggagatcgagaccatcctggctaacacagtgaaaccccgtctctactaaaaatacataaaattagccggacgtggtggcgggcgcctgtagtcccagctactcgggaggctgaggcaaaagaatggtgtgaacccaggaggcagagcttgcagtaagcagagatcacgccactgcattccagcctgggtgacagagctagacaccatctcaaaaaaaaaaaaaagtaaacaagtttaaacttaccacacaacctagtaagcccactcctagatatttacctatgtgaaataaaaatttatgttcctaaatttgtaggcaaaagtttatagcaactttattcataattgctagaaactggaaacaacccaaatgtcttttatatgtgaatagataaaactctgatacaaccatactatgaaatactatcagcaataaaaaggaataaactactcatacacccaacagccagactcaaaagactgtaggattgttatttcatgacattttagaaaaggcaaaactacagaaagagaaaaacagatcagtggttgccaggaactgagggtagggttggcactgaccaaaaagaagcagagtaaaatttctgactacatacacttgtctacatacatcagccaaaacttgcagaattacacatttaaagagatggatcttactgtatataaactgatttttttttaaagccctcaattcaaggtcaagaagatgccggccatcctcaggagtgtatgggaaacaaaacccctctttatgctattataaaactgctattcccacaacttgaatgctatatgcagtacaggtgggatacaacaatgaaaaaaaaaacccacaaataaagactcaaagaatggaaaaaaaaaatgctgaagagaaagactgctgcgttatgggacacagtctccagttagaaagacaagaactgaaagcagatgtgactaacgtctctacaaccaggaagaatatggagaggaagcattaccttagctgttaatcccaacaccaaataaaggggctatggcttaaaacttttgagttttacatttaggactgaaaaaaaaaaggaaatgtcatatctgaaagcaaagccacaaaactcattcttcaaatacagtatgtggaaagtggagaaaaggaagaaaaggtgtatgcaaaaagcattaaaaaaattacttgggaaaaatgtttagtcaactgtttaatttgatggtaacaccagctctgactttttcagaaaaatgcaatgtttttgaagacaaaatgtggcaaactgaaaacagcaagaaacagcgtcgaggaaccttgcagaactaaatcagatgatgcgtaatgaagtctattaatggtgaagtgtaaaaatgctaataactgctattagtttagtgtactctgagctatgaaagatgaacatgagaattcttaagctagcatgctaatcccacagatgattatggtcacagggcataaatggaagagataagactcaaaaccaaatgcatctgacacagtctctcttgaccactacattattccatctcccaatacttaaaaaaaaaaaaaaaaactagcaaatttcaggagcaaagtaatatattcaataactaccagaccagttctataaagtaaaaaggtttgtttttttttttttttcccccagtctgtgcacatcagcatagagattctgtggtagagattaccatttctgttcatctactctgatgtggttccaagtgtttctgcaagtctaggagggtcttattacaatggccgagtgatgtggttaagaaatttggaaaaaatatattcacttcaatccaatgaattcttatgaagtgccaactctttagaacatatgtgtctgggctcagtagctcatgtgtgtaatcccaatattttgggaggccaaggagggtgcatcacttgaattcaggtgtttgagaccagcctgggcaaaatgacgaaaccccatctctacaaaaaaatacaaaaattagttgggcatggtagcacacctgtagtctcagctacgagggaggctgaggtgggaaaacagattgagcctgcgaggtcgaggctgcagtgagccacgatcgcaccactgcactccagcctaggcgacagagcgagactccgtctcaaaaaacaaacaaacaaaaaaaatccaaacaaacaaacaaaaaaaacaggtatgacaaccataaataatatgcccagagaaagaagtcctattctagttaaaaacaaggaatctacatatagccaaatttttcttccttctctgattatctatgtagtctctaaatcatctaattctgaaccaaattatacagcatcctactctttttcagcctaagcttcaaatagaccataggtattctttcaggagaaaatactcccatcttataaacttctagaaagttaatgattaaagctcatattttcctatggtgcccttttccaattacagacgtaaatgtttttaaaatgccttataagtgttccacactagagacaccaatgttctttctgcctataaaagccattgccggtggcagaagaacagaaaacactgctctaagttctccttcacaatgaaaagggagaaaaaagagaaagaaatgagtaaatatgacaatgaaagaagaggataaattttaaaacggagaaagaagattatcacccagcaaaaccacaggtgcaagagagccaggcccttaacaatcaccagcccaacaaacaccttcattttaatgacagaaggaagagacagtgagggaaaataatgaaataagcaagagatgaacataattattaaatctgcacctcatgcaactcagggaaaagagctttaaacaaaagctaacaaagccatgagcatgtgcttctcttaccagcattaaacactgttcattcactgcctggcctcaaaagccacaagaccaatttcgggcacccaagcctgaatctaggccaattccaaagatcccacgagagccctcctatgaccacaaggctcttgtgaccacattctagggggaaaaatagcatcccaaaagtgaagtatgtggatttgagaaaaggacacagactgatgaaagtatgttctcaactgttaaaagaggggggaaatacacagagcacaggttcacaaagcttctctagcaggctctgtacagtatctaatacaaattataaatctaggaaatagtaatataaaggttattaaatgtttccatgtgaactggctttaatatgccttagtcacgacttggtaagaccaaaatatttaatactcaggggctttcggggggagaagagttcatatatatatatatttaatatgtatatattaatgttattttttaaatctaaacctcaaatttacaaattatattttttgatataaaaggttttctttactactttggctttttccctaagaatctgattgagaattatatatccattgccggcataagttatttatctacaacattcagaaaacaagcaagaaaaccattgtataaaattaagcagccattggctttaaaaaaaaaaaaaaaaggttacttggaagcttggagtgcttattgaatgcttactgttctagaattctgattttaggcaaagatgggatctcagaactccagtagccacaattcacacactttggcagcatatcatccaaactctgacctcgtagctctgaaataaaacacgccttttacccctagatgtgctaaaggttcataaaagcagaagattcatacagaataatagtggccaatgaggatactctcatcatccacagcaacctgttcctgacactgcacagcagaaatcttctacagttctcctaaaggacaataatagcaacccgatcatgtctgactttacatacaaccttcaaaacaccctaccaggccttgggggaggaaaaattattgttttagaaataaacacaagttactagtagcccagattttcctttcaaccatagctatctcctttaatacaaactcctaagactgttctcatttccttctataatgctgaccttgtttaagtttgcatttcatgaaaagacactgaatactgttttgaaattaaataaattcaaaataacagcatttgtgagattaacatgaaaacttttgtgccaatttctgaagctctgtgggaataatagtattaagtactactatttttttccttttttcctcaggaggtggactgcatttccagatacagtgaaaagactaccaacagagtaatagttacaccaataacatatataaataggactgctgagagtataacatagattttggagttactgcacagagggaccaataatcacagtactccagcttttagtaaaaaccagttcacaggtccaaacagtttcaatttaaatgtttgatcatcagtttccgtgtattaagtagaactattcaaagtgtttgaaaattatcttagtaaaataattacatatccaagtgctaaggatttttaaagctatttcttcagaaagaatcaaagtgaaaaccaccacaaagaccctactaaaataaaaataacagataacacttctccaagccataccatgatttcaagatactattaatcaaaatcaacatttctatgactcagtattctcaactataaatgacaaccttttacaaattatttctagccctaaaattctatgacttaattctgtgtcttttttagggtttcaatatgtgtaaaatactgttacatagaagtagacactgtaggaatgaattcaacatagactcagaagtataagatgcaggcctctgctctcagtaaatttccaaatgaagactaggaaatgagagaaataacttaagagtttagaaatcttagaagacaatgcaaagtataacagcttttatactcaaagctgcaacaatttcaaaacctgacatacaagtgtgctggcttggtctggaaagttaaatgtggcttattcttctatgctgtaaagcatatataggacgtggacagaaagaaagacaaagagagtgtcacaagtgctggctagagacatctggctgaagtgcaaggccgcatagggaaatacttggagatggggctgtaaaatacactaggctgggactttaaccaagaggcaatttataagacatggaaaagttgagggaggaatgaaagcagagttttagaaaacttaatctcaaaggggagtaatggatggattatagataaaagaccaaaaaagcaaaatggtgcacaattaaatgaggcagagaaatacagccattatttagtttttcaagtcaaaatctgctactgagaccaaagtaactcgttatctatatcaatgaaattcaccaactcttcactttatttttcttataaaacagcttaagtatagtttagactgtttattaaaacctttcactgtatttcttaagtgtcacataacaaactgtatttatataaaaattcactttaatttagaaaataaggacagtattattggtcctaagcctttcaaaaggaaattaatgctgctgcacagtttcattaattctgttgggccgtaagggtgccctttgggtactgacagaaatcatttattggtcaatgtaacccctcccaaaactgcacaacttattctgtcactccctgtgggaaagtctggctgcttatgtactctgtaaatctattctacaaaaacaaaagtagcatctctgatataatggctactaaaatattaagagttattaaatgttttccaaaaataacagtaaagtctcaaaaaaaaggaaaaaaaagggataattccatttctgtcccattaactacttcattatacatttacccatttctttagagttaacagtatgcctaaaataataaacttgagcaacattttaaatgctatgtgattttctatccattatcaaaatgaatagacttcacttgaaactcagttcattttacacactgacgtagtctaaaaaattccacacaaattcaattttggtaactcaaatagtttaaacatacgaaacatttggaagatgtccatttaaggaaggctgtagtacaattggttcttttataaaattgagagacaccaatgtaaagtgaataaatatccctgattaatctggctttctaagtttggattttagattttcttaaagtgtatattctttttagatggtgctataaaaactcacttataatgaaattactcccatcataatagaacagagaaatgtaatatattgcaactcagttttctgattagtgaggcatggacccaattatccacaatgagtttcactgtgtcttgctccctggcagcatgaggcagctttaaagatagagcagaaggcacacaatctttatcatcatccttcgatttagatcctacttctgccaatgattaatttgagatatcaccaagcaatccaaacagtcaatgtatgtgttttggggggctgacaggggatgctattacctacttcctagtaatactgtcaggttttcacaagacaacctgagtcaagctctgggcacatagtagatttttctgtcccaggcacattataccttctgtgcttgcctaaggagtaagacaagaagctacaaagtactaaaggcagaatagtgcctcattaatcttttttttttttcaggattataaactgagtattttattttttgagacagggtttcattctgtcgcccaggctggagtgcagtggtgcagccttaaccttctaggctcatgcaatcctccaaccttagcctccagaggagctgagaccacaggggtgtgccaccacaaagggctacttttttatttttttgtatgggcaaggtctcgccatcttgcccagctggtctcaaactcctgggctcaagcaatccacctgcctcagtcacccaaagagctgggattacagctgtgaaccaccgtgcccagcctttaaactaaatatttaaaaacacgcaaagaaaaggcgagagcaattaagagaaaacacacaaatgaagaatattatgtccaaaaaatgtcaggcttcctttcatggagctctctagaaattatttcccacctatatgagaaaagtatattttaaatagtaacaatcatgaaataaaaacttttactgtacttccataaatacaaatcctatgtcaaaaaaacttactttttcttgacatatttatttcctttccatcatgggtttgtggcagctaaaaggactcaggcagtaggaaaatcagcacactgggtcttatttatttattccacgttcttcctaatgccatcatttaactatgactgtgtctcagccatgactgcttcacctggatatgttctaagaatacttcatatgccataagatcaactcttctggaaaaaaaaatctaaacctatgtaagaaaaataatgaatttaagatgaacacatctgtttcctccacgtacgttatttattccttatttcaaaaaaaaaatacttttgtgaacaggtgagaaaaggaaaaaaaagagaaggaagggaatatcctaaggaatagaggccacaattagaagaatgatagaaagaatatgcaggttactagtcaaacaattagagaatatttaccaggaataaatggtgtgtgaatcaacttcttagaattctagactagtgatattaaattaaagaaaactctaagtaaacccacatatcctttgttgtgctgggcaataatgatacgtgtgtttaaattaagccaccttaaaaaataaaggtaaccggccgggcacggtggctcacgcctgtaatcccagcactttgggaggccgagtcgggcggatcacgaggtcaggagatcaagaccatcctggctaacacagtgaaacccccgtctctactaaaaatacaaaaaaatcagccgggcgtggtggcaggcgcctatagtcccagctactcgggaggctgaggcaggagaatggcataaacccaggaggtggagcttgcagtgagctgagattgcaccactgcactccagcctgggtgacagagtgagactcagtctcaaataaataaataaataaataaaaataaaggtaaccacaacaatgtaaacgtacacctgaaaatggttaagatagtaaattctgaaatgtctttttctaccacaataaaaaaatacaaaataaaataaaataaaggtaagaatagcacagaataatctagaattcttatacttaacacagagacatcaaatttttaagatttcttatttaacatatatatagcctgattttatggaaaaaaaggacaagcaatttcacttacaaagatactaaaaagttttaagtgatttatagatattcctaatattctgatacaggatattttactattggctagcaatgaaaactttgatcttatgaacatgaatctacagttctgttgttgttgttgttgtttaaccacataaacacaaatgtactacacgtgggcaaacagttcagtcccaagaggacataagaacactactgcagcttttaaaatacacttacagcaacagtttcctcaaaactctaagaaaatttcttatcacttctagcctgcatcacagggatctcttaagagagctattttaaaaactgtaagtttttaaaagtgcattattagataatataacaaagtacgttcatctgatgtctaataagtaaaactcattagtttaaaaactaacaaatattcacaaatctacactgtgtatctttataatttttttacctctaaagtattagggaaaaaatgttattaggctaaaaatcatattaaccatacatggatttgggcaaggaaaagtggaaaagttagtgagctggataccgagttaatgaagaaagaaacccagaataaaacacaaaaagcccagacataaaatacatttattttgaaaccctacagacaaaaaccaaaaattccaagcaggttttaaaacattatttctggaaaccagattctgttctaaaattctaaaaaagctcaaaggtcatccactcatacaaaaatcactactaaagctctcttagttactggagaagagggaaaaggaatataactcttagtacagaaattagaatttaatgctttaacatgttcagaagtgctgagattagttgggggttatgcaaactgagcacgcatagccagcttccaaagaagcaattaacaagtacaaaccaaccccaccaacccaaaatcctactcttttcagagaattgccacaaatgctcattttaaattattttatgattcagcctaggtcatattgtgtggctaggaagtaggggaacagcagaattcatacacttctcaaaggcacccttccatcatttaaataaagcatagctataccaaaacttatttttcatgaaatatactgatgtgtataaatgtgtaagtctggtatgttttaacacacaggtaacaaatgcatactattaccacaatatgatgaacatttctaccattccaaaaagtgccctcatcaccctttacagttaattccccaccacatcccaagcaaccatttgcctgatttctaccactacagcttactttgtccctgttcttaagattcatatgaaaggaaatatacaatatatgtctggcttctttatttagcataatatttttgagactcatccatatggtgttagtttatcactagtttgttcttttttattgctaaatagtatcccattgtatgaataatacactgtattcaaccatttactctacccatggacatttgaggttttatccagtttgagaatattatcaataaagctactaggaacattcatgtaaaaagtctttgtggacatgtgcttacattcctataagattaatgcttaggaatatggtatgtatactttaaactttacaagacactttctaaaaaactgcgaacctgttttccaaagaacacctcaaccagcaaagaatgagatctaatttgcttcatagtctcccctgcacttggtattctcacatttttcttaaagtttagctactccatcttattgtggttttaatttgcatttccctgatggtttatggtgttgaatatcttttcctgtactttcaattttttgtgaagcatctgtccaagtcttttgaacattttaaaaatcgggttgatttaagttataagagttctttacatattctagataaaagacttttgtgttacaaatattttctcccaatatgtggcttaccttttcattttcttaacagcttctttagaacagcagacagctttattttttataaaatctaatttatcattttttcttttacacttagtacttttttgtgttctaagaaatccttgcctaaccaaagttgatattatcttgtgctaagtttacttttaaaactttcatagttttagcttttctatttaggcctatgagccacttcaaattagtttttatgtattttatgagggaaaggtcaagtagacaaggttcattttttcccataccaatatccagttgttttaacatcatttgttgactaaaaaacaattgaccgtataacgtgggtctatttgagggctatattctgctccattgatctatatgtttattattatggtaagaccacaatactttcattcttgaagattttataataaatcttgaaattagagagtgtaaaagttccaaccttattcttcattttcaaaacaaattctgggtatcctaagtctttgcacttccatatgaattttagttccagcctgtcaatttctataatttttcactcactgctgaatgggggaaaaaagtagtatggaaaacaacactgaaaatataatccccttgtcaaaatagcatgaatttaaaaatatataaataaaatcccattttcattaaatcaagcctatattgaaagggacatgcactggtcgggtgtggtggctcacgcctataatcccaccactttagaaggctgaggtgggcggatcacctgagttcaggagttcgagaccagcctggccaacatggtgaaatcctgtctctactaaaaatacataaattagccaggcatggtggcacatgcctgtaatctcagctactagggaggctgagacaggagaattgcttgaagccaggtggcagaggttacaatgagctaagatcacgccacagcattccagcctgggcaacaaagctagactctgtctcaaaaaaaaaaaaaaagaaaaaagaaatggacacacataaaagaaagtgaggccaggtgctgtggctcacacctgttatcccaacaacttgggaggccaaggcaggaggatcacttgagcccttaagttcaagagcagcctgggaaacaaatccagaccccatctctacgaaaaatttaaaaattagctggggcaatggtgtgcacctatactcccagctattcgggaggctgaggtgggaagatcgcttgagcacaggaggttaaggctgcagtgagctatgatcatgctactgcactctagacagagaaagatgctgtctctttaaaaaaaaaaaaaaagaaagaaaagtgaaagcatatatgccgatacgttaaaaaaaagtctttctaaaagatgagattacagaaaattaagttttcctttttacttatctatattttccaatgtttccttaataaacaatttcataaggaaaacaattatatataataaatctacagaataacttaagtagaaaaaaagttcagtcaccctacgtctgcatttttaacatcgcatatcatcctggtaaatgaaaaaaaaagatatcaataaactgcaaactattaactctcatcgggggagagtgattattccaagaagaatgaagactcactttttattttatatacatctattaatgtttggttgttttattataatgaccgtatttcaggtatttaagaaaagctaaatattcatcaataaaaataaagtacttgtgcatatgcgtgtttgtgtgctattagttaaactgatgcaataatgaaaagatcatcccagaggaaggctacccaactccgtatgccaaaaatgccaactgtctgtcacttgaattctaagatgaagaaaagcctttgcttggctagaaatttgcagtggcatcaggtgagatggctgtttcaggaaactcaaaaaggattcatcatgtgtccttgggaatcagaaggaaacagaatatgctatttcagtaacccctaaacatagatagaaattaaaattgagggcaaaaataatgagacttaaaagaaaaaggctgtatttcaacacatttgtaataaaattgttaaatatacacatctcaggtcactgtaatgttgctactggtgctcagtccacatttgtgatactgattctaacttcaattgctgatcagaaaatcgaggtgaacctggttagagttccacaaccagggtcattttcagacttgctcaaatatcagactaccttaccgaacagcatgaaatgtcaatatctctaattccaccctatgaacaagaaaccttttaatagcagaaaataagaccatattatatacatgaagcatacaattttttatgtttatgaaaaagatagcactgctgaattaagcatgacttttcctactaatacccatttgctcttttcactttaattttatcccctgacaataagagtcaccgaagacttatggaaaacttatgagagaagaactataattttattcattattattttctaagatttggaaaaatactcttccattcaactttagtagtaaaatacctcagtccataggaacactgtctgagagtcgttattccgtaatacaccagtagtaaagaagacatacataaaagtagaaacagggcaggaggaggataagtatttccaaatacaaaatgcagtggcaattttacaatactcaccagaaggcacattatcacttcctattttaggaataagtgtcctcaaaatttgaataggtcattagtcagtctccttcggggagagtaactgatattatcatatctaactttcttgagtgcaaccatagtaaaaaatacattttacacagtggcccagtacacacacacgcacacacacacacacacacacaaacgtgtgtatgcacctaccttcatacttgcctaaactctgtgcaatacagtctggatttttctattatattctctagttttgttttgtttttaagctggttataatccactaaagtgattcaggacacactagttgattgtgaccttcagtttgaaaaattctattacagaatcaagagaccagggtgtgaatagatttaacatcttagaattctgttagataaataagtgcaaatgcaacattattttaaagatctatggttgaatggtttactttattctaaaatttccataaaaatagaccaacaaaattcaattttcatagacaggcaaaatctactgggcttagccaaaggtagcagtgttatagatacagaccaacacaacacttatttattactatttcctgtcaaaatcttactcaggtgtatctttcatcttcagccagggcgctcagggccggcgctaggtaagctgcctgagaaagtcaatctcatagtcactgatgatgccagagctccgctggcctgtacttgacccctggagcagcccccaagctttagctaacactgctaacacatgatcatcaatctaaattttgaaaaatatatattgattttccacagatgacgatgatggctttttctgtagtaaatgtgcttatacgttgtgtttttttttttctatacactaagactatgatcaacacaggaaaacaaaagtgctttatgtatttatttgtaggacctattaatcaaagctcccttaatgagtcaaaaaccaaaatgaaaaaaatgaatgaaatatctctactaattcttatatcatggatcatatatactcctaaaatcctgattacatggaaactttttttaaaaacttatatttcctatccattagaaatctccgtgtcaacttgacaagaaaaaaaaaactcttaacaattctaacacatttatatttcctcaaaataattagaaaaggaatagtaccttataaatttaataaataaaaatttagtatttagtacattacattttttagtatccaaagtatgttacaaaggattaaatcatttaacattctatctttaatcagtttggcaattctgagccatctttctaagcaaaataggttgaacagctttaaaaaaaatcctttatcacatcaaactgtgatttgaaatcacatttttcaaatcaaactgtcttttatgctactgcctgatgatctggaatttttagtctagaattccaggcattgaattaaaaagaatgtttcccatttccatagtactgaaaatggaaatatgtaaattagttcatgggcagaatcattaatttagataaaaagtaaaaacacattaattgagcaccaaaaatgtgacagttcttgcacaaaatctaaaataagacagctgctaccactggagcttataaatctaaattaaatgggcaaaaaagcacaggattttaattatttttgtttcccaaggaaatgacaagtctgatagtcagtactccagtctttaacaatgataactctgactctgatttccatagactgatactggcctaattatcagtgccaaaatcagtttgggtttgagaaggaagcagaaaatttcacccaagttggaaccatgagactgcaagtaaaatggaccaattccctccagttacttatttcctggaagattaaggtcagtaacataggcttaagagataccgcttacacagcatataaaccaccttgaataaaatagccacaaactgacctggagcagtggctcacacctagaattctttgggaggccccaggtgggaggactgcatgaagccaggagtctgagaccagcctggcaacatagtgagaccccatcgccataaaaataattttaaaataaaaaagaaaatattattttaaatcttttatatactacaaaaaatatttttgaatgttgaaaatctgacagatgcttggctctaaattgagggaagtagagtcataggtagaaatgggaaggaacacctaacccaacgccattataaagtaggagatccccacatgtttcttcacagatggctgaagtatgcaaaatgcagggaaggggtccatttcttcaagggagatggtttgtagctttggtagattttcgaacgggtctagcaactccaaatatagtttcattgatttcttaccacaatcttatggtgtattaattcaaaaatgagaaaactgaagctcaatgtatttgaaaagctttcccaaggccaataatttgtaaaataacagcaaatgagaatgcaagttattcgagttccaaagtccctgcacttgtaggctatgctaaaaaaaaaaaaaaaaaaaacataaaatgaagaaatgttattcaatcaactctgctaaaagcagcctgatgatgctgactagtaattgtgaacacatatacaactttaactatgtaccaggcactgttgtcagtgcctcatttaatcctcacagcaacagaaccaaatcgcagacaccatgatgatgatttccacatagctcctaaggggcatggctgggtttcaaacccaggcagcctggctcctcagccatacccttaatctctatgcttgatgccttcctctcctgaagacaagcagttaaaggataagggtagaaaatgtgggaagaagtctatcccaagataaatctcttaatgttttaagtagcattttacaaaataaatattatatggtaatttttccttattttagctaaaatttaacaccatgtaagcctaaattatcaaaaatacttacaatgattttctggtttctaaaagatttgggtaaactcaaagcattatacccaccctccaatctaggaaagcttctattgtccttccacttcaattcatttattttgataaggacgggacaaaccctatgttttagaaatatttgttaaacatacatagcacatgacggggagaatcaaacctttcaagatccctaataaagatttaatatcatgtggtttcatacaatcttttcagttccctagcagacttctgccttttccacgaattggtccagacaaatgcactgctgtgtgatggaggcatcggactgcctgtcttccacatatcagcagttcatgttgtcactgacattttatctctttctgccaccattttattttatcaaagacagtatctgggaaaaatgaactgcatttactgcttatacaaagcacacccgaagagaaaaaagtcatctttttgcccattcaaaattttaatatattacatattaagataagtagctatagaagaagcaggattgagatttttttaaaaatttaaaaaatatatattagtagcaaaaacagagtcttgtccttatcctatacataaaatttagagcaactaaacttctgattctatcgtttctgtatcatgctttaactaccagtttgcatcaactaaaactcatacaaaaatgacgcatggctgattataaactgaaatgctgttttctcacattaaatttcccactgaaggatataaaggtgtcaatgagtatgaactttataaataacttaatgaggctcaaaaaaaaggcagtcggattagttctaagtgctctgaatatgcaaacatgagtaattaacatacagcttaagccttctataaataagacaggaaacaagtgtcaagcaggttcttaatgtaaaaggaaagaaagaaaataaatatcagtaatgccataagtcaacttcagcctaaagaatgaataattaattatatgtacaagttctaaaattacatttcattctgtttcatttagtagagctgcatgaattactttccatttacctatgcacttcataatacttttgtaagatgagatcctactaggtttcagaactcagttttagggcaaacctaaattctctgtcaaggcaaattcttaattcatactcctcactcgcacagtgccacactcactcactcacacacacacatactttaaatcccaaatgacactgaacacaaataacaagactcatgttcccaagaattccactttctactaatttttttcattcactcaacaaactgcttagcatttacgttgtttcagacactgtgcaaggcaaaaaagatttctgctgtcacagagcttagaactgtgtgtgtttattaatgtttctctcccctagactatatgcctgttactggtattcattctgtacagccctcattctccaagcctaattgcactattattacgctaccacggaacaaaaattttcaaggactatacagcccaaaattttgttcgagtgagcatttgttaattcatatataccacacgaaattttcttctttaaaaaagaaaaaaaaaggcctgtggccgtggctcccgtctgtaatcccagcactttcggaggccaagttaggcagatgacttgagttcaggagttcaagatcagcttgggcaacatggcaaaaacccacctctacaaaaaatataaaaaattaaccaggtgtggtggtgcccgcctgtggtcccgactacttgggatgaggtaggaggatcacctgagtccaggaggttgagttgcagtgagtggagatggcacaactgcactccaccctgggcaactgagcaagacactgtctcaaaaaaaaaaaaaaatgcctataggatgaaaagatgtatctgggacttgcctcaaaacagatgggggagtaatagataaaggtatagatgaccggttcatgggcgttcattacattattattattaaacttttccatagtaattttttgtaaccatttgtaaagggatattttgccaataccaaaaactttaacttttaggaatttcaggaagccgcacagaaaaacagcgtaataacaacagaatattaaaatgtaacttctatttaatacacaatgggatcctaaatcctaatcttaactcgattataaatatcaagtttccattgtttcaaatggctcgtttgttaaagtgaaggcagtagtgctaatctctctcaatgaaaaatgtattaggactctgtgataaaagttattacagggaaccctacgaaggtataatactaatgctacataagcactaatattaatcatggaaaagtatgtttcttttccagcctagcaggtgaattgggattgttgtagtgacaccatataattaccaaatgtaaaataataatatttcttttgttattcaagcttatatagagatgataacagaaatacaagactaaacctgagataatgaagtatgcagcagagggaacaaagctaataggttttgaaaatataacacattttacttgacatttcccaagaacctctgaagctctcatgtaaaatctgatccaggtactgggtggcttacccatgtgctcacaaccacaataaataatatccgtaatggcattttataggtaaaaagcatttaatctatatagattataaaatgcacaaaatcctgtgagtcaggtattattacatgagactacttttaaagaatatgttttagaatttgcctgtgcttccaactcagggatagaggagcgagactgataccaaatcatcctctaaatccaaattcttttcactttccactatcccaggctgctgctgccactgaaggagtttatcattttgttagcagcataaaacctaaatacatacagaaaaagccagaatataaaataagctatcgtaaggttaacagccaacatatggtctgggaaataagcaccagttaggatcaggagaggagagtgctgagggccgaagctgctaaaaaaggcttcttctaagaaaagtcagtgccccgaggccaggaggaggcccacctgacacaagcaggcagacggctttttgacttcgaagatcacttttcccaataaagaaactggcaataataaataaactggctagaataaagggttgtttagcatagtgtaaggcttacatttaaaatgtcgtttccacaaggaagaaagagaacaaagaaatcttggccccaatgtgataaagtcaggaaagactaatattccatgttgggaaagtttgaatatctgttgcaccaggtccaccaacagttttatctagatacaaacagcagctattaggcattgttgttcaggaattccagaagaaccagggagggaagctagtagatatctattttgaatgaaaattataatttgtaaaaatgaatctgatccaagtcagaacatggaggcatttctttcttgacataaccaagatgatcaattggtgggtaccaattggtaaaattaccaaatgcttgcacgcgttccagaagggttaatacaaccgatatggaaaagcagtctgtaccacagagattctttcctcaccctgattcactgtaggatcagccgtgttaataataatacttcgcaattttatgtcacttttcctgctaaaagctcaaatatgagttgatatggcacatcacaaactacacagatggtactctgcagtttccacagctctgagtgaatagctcatttgacttactaataaatgttcctatttcaagattaaaaacaaatacgaaaaattacagaaaatggtagaaagtcaattttcatacccactgcagaggcatctacctgaaagggtgaactctggacagagcgcccagagcacacctttccttcagatgttcgtgcacacaggtacgcgcttccagagaagtcctatcaagacaccaagaagctgggatatgaaggccagggctagatagtggatggggctgtgttatcgcctgtgtgaatgtacagcaaccagatctaagaggaaaacacctcaccaaggaggagctggaccaggaattacctccttttgtttaatcccttgacctataattactcatttaagacagacacactgtcagaagttttactagaagttattggtctaacctatgcagtgttactgagatttataaatcatgtttaaattggaatacttgaaatccaacattttaaatggttatgttcttacagaagagggacactaaaatcatcctagttttttttgtttttgtttttgtttttctgagacagagtttcgctcttgctgcccaggctggagtgcaatggcatgatctcagctcactgcaacctctgcctcctgggttcaagcgattctcctgcctcagcctcccgagtagctgggattacaggcatacaccaccacacctggctaattttgtatttttagtagagacagggtttctccatgttggtcaagctggtctcaaactcctgacctcaggtgatccgcccacctcggcctcccaaagtgttgagattacaggcgtgagccaccgtgcctggcctagaaattttctttattgctatttgaatgctctactcatacttctaagaaaaaaaaagtttattcctttgaacttcataaacagagcttataaatagtcttctctggtaactgtatctaaatatctcacctttccctgtggatctggaaattttccatcagggaatttagctataccaagttttccatcacctctgagaacatcagtgtactccatttgtgtataaccatgggcaaacctctgtaaaatgtgaatttatctttgaaacaggccaaatcttgaaaaacccaaagaaccaacttatccctatggaaaagagaactattactgatgattagatttaattaaactgtacggcaaaggctgcttagatggagaataactaaagagatttgctttccatggtgattcaagtggttttgaagcatctacttacaggattatattcaaactccaaaaaaaaaaaacacacacacaaatacttgattttggtgaaatatgcccaaccattcttcgcaagagcttcatttttctgagaaaattattgtatattaagccacagtctgaactagtcaaaaataacacttaagtcttatgcaggaattttctcaaaaggggttttattttaaattataattaaattaaccaaatggttccaacattgagtttaatcattacacacttctctgagaaatctaaatataatctctttgtcgagaatataatactgtccacttctaagtccaacacttagatacatcaaacaatcagtcaattttccaggttaatgaaatgtgaattttatatactatatttcttggattattttccatatgataattacaatactctatcacctctgagtagtttttaaaataacccccaaattttttccaaaacataaagagctttaactctattgacttaaaacaccttcccttcaatcttctctgtaaaacagcactgtcaggttcaccttcaaccaccatgaaaccacaggaatgtaacagggacaggaatgttggtaagccaaatgatacatcagatcatctttgtccttccccactcccatccattgagaaccattgaatcagacctaccaagtgctaaaatgttaagggattgtaataataatcattctgtaaacaaacaaagtagaaacacagttactctaaacagtgaataattagaaaataattcataatgtatccttatggactacagagtgctgcatcacccattgcatttctgttacacccttcaattgataaagaaggaccataaaaacctgaccataaataatcctgaatgcacaggtgggtcttgtcttcaagactaacttttttcatagttcttctaaacatcctctatttgaatttaaaataatctactctgaattataataccaaataactaaccaagatttattgaacaccaactgtatgtcaaatacctatcactgcaggtgattcaaagtgacaataacaacagcgaacatttacaaaaattggggcgcaaggtcacacttgtttaagtgatggagttggatggcaatccagacagtgctacaccaaactgccttcacagaactgaaaaacaaatactcttgtattcaagaaactccaattttattttattttttgaaacagagtctccctctgtcacccagcctagagtgcagtggtgtcatcatagctcactgcagccacaactcctggctcaagcactcttcccacctcagcctcctgagtagctagaactacaggtgcccgccacctcacccagctaattttgttaatttcttgtagaaatggggtctcactatgttgggcaggctggtttcaactcctggcctcatgtgacccttccaccttggccttccaaaatgctgggattacaggcatgagccactgcacccagccaagacctccaaattttgcaggtacttaacatattccaatagaatgttccacaaattttacaatttttctgccttttaggcatcaccttgtaagagtgatgaggaaaaaaaaaactaatcatagtatcttgaaatattttactttcattttatccttagaattgaaatgccttttctgaggcatttgtgtgtaacttgtggtacacaaaacacacattagttactttagtgcacggttttcttctctttctgctattgagaaatttcttaatacgcaagagtgagcccaaacagtacgtgcagactgatggacagtcttgccagtaatctccacacttctcaggttaccaggattccttatgggaaagaggattccatgaccctctgtgcttaggaccagacaaagggatcttcaagtactgttccccactatatctatcaaaagtcacttgaaaactctctttaaaattacaaacagatttctagatgcatccatacttttataaatctcagtgaatgagatcttggaactaccactttgataagcaaagtagataatttatatactctaaaataaatgtatagactcttggatgagagacttgttctatcatccatgctctcaccatgtaaaaagccctgcatctttttacaaaaggctgccttaatctacaaaatggatcatctggggaagcagcatcattctagtgctttcagggagaactgtgttcattattacttataagtggctttcagggctaactccctggaaacgcttgtggtaaaataaacagtccaaaaaatacatgtcatcgtcatttaatcaagagttctacacactgtatatgagaagaaacaatagagaggggccatactttttctttattaaaaaagataattctagaatgtaaagaaaaatttttaaaaaattaactaatgccgttcaatcttccttagtgataaccagagaatccaatcccagaagacttctttaaaatcatctaattcattctggcttcatgaataacaaaaatcttctatttgatgctcagcagcaactcaagtgttattatccccatccaacaaaaaggaaatttgggactcagaaataaagcacttgtccaatgcaacaggtccatccagaggcagtatacttaaccattattaaacttccttttttaatatttttagtttttttttaagagatgggagtctgactctgtcgcccaggctagagtgcagtggcatgatcatggcttactgcaagctcaaactcctggactcatgcaattctcccacctcagcctcccaagtagctgggttaatttttcttttatttttggtagagatggggtctcgctttaacgcccggtctggtaaactttcttttaaatcatacaaatgtcctctagtcaagaaaaaagcctataaactttttgaaaaattatttacctactgtagacagagtcttgctatgttgtcaggctgcagtacagtggctattcatataacacactgtagcctcaaactcctgggctcaagcagtcctcctgactcagcctcctgagtagctggggctttgggtatgcaccaccctgccatgttggcaatatcagaaagttcttctaaatgtctgtctaaaatccctttagatatagtttaagaatgctctcttttgtaaactaaagaacatctggtcattatatctcatattgaatcacttcatacgtctcagaaataataaatcctctttcctctcttattttaaaggaaaggacagtaacgcttcaactttctacaaattagcctgtgacagacagatggtggctcccaacacgactgcaatctcttatcccacatgctcctcttataatgtgtcttccaagtacagctggaatcaatgcttcctccctgctgaattcctctgaagtacagctggaatcaaggcttcctctctgatgaatctggatgggggatagagggggagggcgggggggcagcttgggactaagggcatatgtgatcctatgtaacttttgaggttaagtcataaagggaacacagcttccttggaattttcatccactgaacttctgccgccatgctgtgaggaagtccaagcaggtacaaggagagtccaatttgtagatattctagcctgcaacctagcctacatcccagccaacagccagtaggaaaggccaggcatgcaggtgagcaaggcttcagctgattccagctccccagtcatagactcagccctggctttgcgtcttcctagctgaggtgccagacatcatggggcagataagctgtgtcaatcataccttttatgattctgagccacaacatttgtgagcataacgccaccaagtttgggatggtatataatgcagcaatagtaaatagaactccctgattcagaactcaaggaaaaaactgaaaaggaagcaaagaatttaaggctgctttccctatattcaaaataaatattccacattctgtgcactaaagatcactagctttattgataagtctctcaaattatcatgcagctcttattaaaggtatatgtaaaatgaggaaaaatagaaacatactataatattttctgtcttcatcctatgcataggcctctttaggattccttttccctgatgaaatctcatctaggccggtctttaaggctcaaatcaaacactacagcagctctgaggccttccttcaccttgcaaaatgcagtttgctcacgtaacatatctgtatagccctccactctaatacaattttttattctaatgtatatattatacaataattatttgtctacatggcttttgccttccctaagcgtaaggtcttcgaggataggaacatttcttttttaatctttgtatactagtgtctgcaatatacgagtcactcattaaatttttgctgaataaacaaacaaacctggttatctgatttccaaatccacagcagataaaacacagaatattagaaaagaggaaatgaactgttctttttaaaaagcacacacgcacacacacacacgcagacagaaagaggtctcagggaacaaagatgaaactaagtaaaagcctagaattctttagtgtagggtctacagtttacaattacttagtggagagagacaggtcagtatcttaaaagatctcatagatctcagtgaatttttgcacatttcaagtaagtttagtaaagagggaaatactactcattttataagtatttctcctaagtgactacttttaaaattggaggtgccttttaaaggaataaaaaacagaaccaagcaagagatctcattttctgggggttttatatagttactgttttacaataatatcactgtctttatactatttttgttgttcccccttgtttttaatgtccctgttttcgttacacttcagactatttaagtattttcctcccaactgacccaagctactatcacatctgtttgggttgtagcagagccactcagtgtgcaactccaatattttggcaaactccctccaacaggccaaattttttttttttttgagacgcagtttcgctcttattgcccagactggagtgcaatggcaccatctcagctcaccgcaacctccgcctctggggttcaagcgattctcctgcctcagcctccggagtagctgggattacaggcatgcgccaccacacctggctaattttgaatctttagtagagatgagggttctccatgttggtcaggctggtctcgaactcccgacctcaggtgatctgcccgccccagcctcccaaagtgctgggattacaggcatgagccaccatgcctggccaacgccaacatttttttaaaagcagcacaatacatacagaatgacaagaacaaggagaatgtcatcaagtatgtctgtaagacatttcaggaaaacttttttttagacggcggagttttgctcttgttgcccaggctggagtgcaatggtgcaatctcagctcactgcaacctctgcctcccaggttcatgcgattctcctgcctcagcctcccgagtagctgggattacaggtgcccaccgcacccagctcatttttgtattttcagtagagatggggtttcaccatgttgggtgggctggtctcgaactcctgacctcaggtgatctgcccacctcggcctcccaaagtgctgggattacagccatgagccaccatatccggccatttcaggaaaatgtttacaaaaaataaaaataaaaatccgagtcacatattatttcaagttcatagtcaccttaaaattgcccagatttgttaaacaaaaaaggtctatgaccagtgtcacttttctttccattcttttttctatcttctaagtatatgacttcccagttttaaatattaattccacaaaataatatctgcattatttttaagcagcattttctatcctggggttgggagatgttgtctaggtctctatgtcccattcagaaaagtgcagggcctgattcaaggccattagcctaacaatgactctaagaggacttactttgagtcagaggagataacttcattgtgttttgctttttccaaagcttaaaagtttcaagccaagtgtttttctggagttattcaaatgcttgtgataattcttattgttttcttgggtgacaaaatctttcctgcccactactcttacaccaaggtttttctatctacaattaagaatataattatgaggccaggcacagtgcctcacacctataatcccagcattttgggaggccaaggcacaaggatcacttgagcccagtccaagaccagcctgggcaacatagcaagccctatctctatagagaaaaaaaaaaaaaattagtcggacatagtggcgcacacctgtggtcccagctactcaggaggcagaggtgagaggatcacttgagcccaggagtttgaggctgcagtgagctatgatccgtgccactgtaccccagcctgggctacagagcaagaccctgtctctaaaacaacaataataaataaatacatacatacatacatacacacacacatacatatgaagaatattactactactacttctccactggattaggtgagtgagactgaccaggtacctctctctggtgtctactacatacctatgaatgatttttacatttatggtctatttctcaaagtgagaatgaacccctatgcacactgtgatccaagagggaagagagggctctaccacacttctaataagatcctaaagtaggaaagagaaaaggtaaggttaggtataaagtaaagaagatggaaataattataggacaggaaaagtcaacagggagaacagatgaagacattgcaaagaaaaacagaagagagaaacagaaacttccaaattcaaagttatgaagtagtcaagtattcaagaaactgaagttactattgctccgaaaagctccaggaaattttcgtctccataatgttactccaaataagtgtttgaataaaagctttctatttagccaagggggctgtaaaattaagtgtctcaatttctatccccctccttaatctgagcctaaaacagaaatctacttcccaggagggaaaaaatatctcaagttgttagacggtaaatgtctcatggtcagatactacctcttcatttgcatctccttatgatctgccagtagaaagtttgtctaggcccagacctagagacttcagaaggaacatgccatgaaaaggtccaaggatgccatcatttcaagcaataagctctcaaaggttggctgtgcttcttcagccctgatcaaactcagtaacacattaacaacttaatttcctaacagttctggagaaactgaagtctgacaccccaaaattgatagaacaattgcatcctcttcaggacaactggcttagactctaaaaagtctaaacaaacaaaacaaaccacgggaactggtccaccttaaaagagatgaaagggagagaacaaaatgcaatgagtaaacttgattagatcctcgtttgaaaaacaaagctgtaacagccattttggggacagcttgaaaaactgaaatagagctgatattagatgatattagttctcttaggtttaataatggtactgtgtgtgtggttacctaagataatgccttgattttaagacaatgcactttatggatgaagaatcatatctgtaatttactttgaaatggtttatccaatatacatactcacaaccacaccgtggagagggtaggaggagaaattaaaaacatttatagcaaaatttatacagggattcactgtactatttttcaacctgtgtgtaggaaatttttcataaagaaagttgggaccaaagaaatccttagtcctccctaaaccccaatacttttctagcaggtttttttgtcaggaactgaaaacaagaacacactgaaataacagtatttagcctctcattctaccacattattaaaggatcaggggagctaggagggcaacaggacactgcacaaagcgccgcccacttttccatctgagtcgcacagtgtttctacgatttaacgttcattggttggtggcagaaaatgaataaatgacagacagatggatagccttctgacttattctgcaaataaaaacatcccacaaaataagaaattattattaaaaggagaaatttgggaagaacgttgagaacatttttacaagtgttgccacaagtatatattaatgtgtgaactggaaggtctttgctccttggatagttgtagaatttcattatttatctattaagacatcagcccttaagtgatgccttcattctctttttttatcacttcttcaatggaaatagttaagtgccaaccctggtatactttctttgtatttggttttgttttattaccttttcagaactactgaatttccccaaggttttctttaccttttcctcctctatccactaaaaactgatactattaatccctcttctcactccagtggcaaaatattctgcaggggaaaatttaataagtccaggtgtgaaaaatgtccaattttactgaagtgacaaagccaaaaatttaattctttattgtttctgatttgaaggttagaggactgccttaaaggagtaaacatctatgaaaacctgtggtagtcccagaaaatgtgggattaagctcccagggatacctgaacctcaaaaggaaataggaaggagatgggaaagggaaaactctctttacccctcggtgggaagacattgcctcccctcactccttccaagggccctagaggtacacaagcccagtgaagacagggaactcagcctctgaaaaccacaagccccagaaagccttcccttgccttaggactacctactctttatctgatcttgggtgcagatccaagatcacttctgtcctaagaaggggaaaacaatcccccaaatgctcagtctggtaacacagaggatgagggcagaagagctttggggcttagtggtgcttgaagggcacaggccatcagcattgccattctgttccacaattaaggattcggattaaacggctctctctatacatgagctcctggtgggatatcctgaattgtacaattgtagtgcaagtgagcatctagggcctccacctgctgagacttgtcccatcctctatctacctaccaaaggctccctcttttcctctcttcttccctccccaccaaaggtcagcagctggcccccaacatcctccacccccacccatacacacagtgagaggaggcagggaacagctgaggcctctcctagtgactcccagttcatgacgcctgcaagagtctcagatcaccctgaaacccacatgtagggccaggccaggtgtgcccaggcccagttccttcctgcccaagcctttgcttccctggagcctaaaatctgggctccccttgtctcctggttctcttctccgctaaatgtgttttcttaaagtgaaaatacttaatactagaaatgagataataaacgatcgtgagaatgctgctattgattgcatgagtgtcctttaaccaggaaataatgctccagttttgttttccaatgcccttcaacgtccaggcattttgttgacttctattgttgttgttcactgtcagtaagttcagtcagcgaatatgtcattttttggtattacatgtaatagcttagaatattccattctattaggatcgttaattgattgtacaaccctttgcttaaaataaaaagtagcacagtataaggaaaagatagtcatgtggtttcccatttccttcactaggtttcatgacgtactgcctatttagaaaagagtacagtggtgctcaaatataataaaataacatgtttttgtttctgagacagagtttcactcttgttgcccaggctggagtgcgatggcgcaatcttggctcaccacaacctccgcctcctgggttcaagcaattctcctgcctcagcctcccaagcagctgggattacaggtgcccgccaccatgcccggctaattttgtatttttaactgagatggggtttctccatgttggtcaggctggtctccaactcctgacctcaggtgatccgcccacctcggcctcccaaagtgctgggattacacgcgtgagtcaccgcgcctggccaaaataacatgttgaaatgaaataaatatttttacatcacacttgtatgaaaaagctttaaggaatcaaaacattaatattacttaaaacagtaacaagaacaccacacaaaataagtctcaaaatagaattacggaagttgaaaatatattgagaaactccaaagaggcaggcattcttcaagttttagcaatttgactacagttttcaccaatcttaaattgtcttaatattttcagctaacaccattttgatggctttaatcaccattttcatgacatctaacactgtagggtttataacaatatccttaaacagggaaaaaataaaatacagatataaaagctaaggaatgtaatactcgatcctactacaatagaagctcagccccagtcttctgaaccacaatgttgtccagcaactaactccaacaacaaatcagccaatacctcaccactcttgggttaagcgatcttaacacaggcacaacataactgctttcttaacaaacagctgacttcttcactaagtgtttttggcagagtaaatctgtttggtaaaggggaaactgtagatcatgatcagacatgatctacatacatgaaatccttaatgatagtaacagacttcccccgtaatcttgattgtattcttttcactaccacttatatttaatcttcaacttgaagaaaaaattaaagtcagggaagaagaaagataaaaggaggtagaggagaaagatgtgcaaaggttcatacccaaagtgaagtggtcagaagtttgaatcattatttatcattccaccctgatgtcaaagcactgcgtagtaagtggtcagctactggagtctggtcttaatgccaggcacaccctatgctacatccagaacaggctgctggcacaagatggcagatgcaggacagcagaaccgcctcaagcaccggcaagcccccaatgcctgtctccataactacaacctgcttctgtaatttccagaaatgctgtaatattaggttaaatttgtagaaattcatatactcccgacattcaattctactacggaatttccgtattccttatttaggaatctaaaaacatttcgacaataactgaaagcttttcctttttaagcatattaacagtacaattagaaattttaagataagttaatattaaatattctgacaaatgctactacaataccaaagacaagggaaattgtttcatatttaaatcatgtactgattttataagcaggaatgatctgctagtaaagacaatcctcatttagacggggacttcaatgggcagagatcagtcagcaccaacaggaactaccagaactaacactctccaagttaagccttgaaaggttttgggtcatatttcatatggacacactaaatgaataatagaaaataccgtgcattatattctcgtcgatgacaacaggtcttcagtctcagcagctggaacactgtaagcaatgcatgctgatcctatatgtgcaggtgaaagagttccctgaaagctctccgcgctccgtgcaaacaattgagcagacagaagaattccacaaatagcagagcagaagtcagatgactgaatatattatcagccttctttttgggactacaatacctcaacacctagtcatccatgctacatgattacaaaacatctgcaaaacatgcatcacacaatctgcgcacaacagttaaacaatactagaattaaatgttttaagggcataagaagccaaatacctgtatcagcattctatcctttctaagcctatatcctctatagtgctctgtcaatctatgttctacctatcccccacaatcaagttttcttgagctttattttctgagctttttattgtgagaacaacaggcaacctgaatatgctcttgcaaaatacactccctactcttttccttttcactagcagagaattactgatctatgttacttcaataaagcactgggtaagagagctaacaagaacagggttctacctctcaatgctacagtaagaaacatacaagagtactgtacggtcatctttgccctgcacttggttttcagtaagcactcaataaatgttaactattttacttcacccatataattcttatttcctgaaaattaaaagaaaaaatctataatttcaagaatagttaaaaactgagctgatgactaaaaaagctagagactattcatgggtcttaaaataaataacctctgtgcaggtataagccctccttaaggcaacagtctggaagatgcctcctgatacaatttgcaggactggaactattcaaatctattcatccttcttacggacttaacaagtagactgagccttataatgtcccacaaacatttgctttatcagattcctaaaagaaagactttttcagattcaaccattccctctgatgtttattatttatttcccccacttagtggcaaagttaatttttcctcgccaaagttttgctcacaggcacaggacttaaactcactttaagcttcagcctccttctggaaaatggaggtaacctctattttatagggttgtggcaagaattaaagaatgaagcacacatcaaaaaagcctgtatcaggttcctggcactcaatgatagctgctattatcatttatgttatcattgttactcttctaatacagaccttttagtcaagagcaagaatgggccaggtgcaatagctcatgcctgtaatcttagcactctgtgaggctgaggcaggcaggaggtcaggagttcaggaccagcctggccaacatggtgaaacctcatctctaccaaaaaatacaaaaattatctgggagtggtgacatgtgacggcagtcccaactactcaggaggcttaggtgagagaatcgcttgaacccgggaggcagaggttgcagtgagctgagatcacaccactgcactccaacctgggtaacagagtgagaccctgtctcaaaaaaaggaaaaaaaaaaaaaaaaagagcaagaacaagctacatctagaaaaactgacaaccatagcagaatacttgcacaaggctgcactcaggagcattccatcctttagaaacctaggtagttaaggcccaaaatgagtagtcctaaagcagcaacaatacacaggcaacgcctatcaccttcgcccaactaaagagtgccatccttaccatacaccacacaggactcaaggacagagagcacaaaacatgattccagaggaaataaaacaaaaagaattataaatattcataccttcattacatgaaatctattcggttgtaagctaatcagttaaggggacattttacaatattttttattataaacatttcaaccccattttcagggaaaagacaacccaaacccaaatcaaagcacaatgtgctgacattatataattaaaattacatacacacaaaaagaacagatctttagtactaaagcaaattgaaattaaggcatatatgtcccctcccacctccccaaccaaaaaaagtgatcacccactctatgttccccctttaattactggctctgtaatggatggtttatactatcaaagtacactgaaaaggccaggacacagtactcatcaaacgactaaacgataaaatgaatgaagcaatagtaaagtcagacaagaaggcaaacacaaggtccaaaaagcccaaaatgatggccaggtacggtggctaatgcttttaatcccagcactttgggaagccaaggggagaggatcgcctgagcccaggagtttaagtccagcctggggcaacatcgcaagcctcatctctacaaaaaatatcaaaaattagctaggcgtggagacacacacctgtagtcccaactacttgggaggctgggtcaggaggatcacttgagcctaggaggtcaaggctatacagtgagctgtgatcatgtcactgcactccagcctggatgacagagcgagaccatatctcaaaataataataataataacaacaacagcaagaccaaagtaagatttaagttggccaggggaactcaaacaattcggaactggctgcctacaaagcataaattctgccagaattaacaggctaatttcaattctccacgttatctgtcagctgacgcctagtcaaagtaaagatgttttctttttcctttagaacatttaaccagttgcgagtaacttctacctatatgattctgtgtccaaagcctcaaaaacagctatgtaaaacaccaccataggttcccttgtcatttaattcttctctagaaatttccaaccagagaaccaactgaaaattatcctggaatcaacatttccacaattgcattatgtcatcacagccatggggacccagaaatgtggtcattgatcaacatttcatagagtaaacacataaaatctttgccctaaaagctaacagtattaggatctacctacagaccacctagtcttttaatttcagttgccttcatagtttatccttaagatttccactccttttcataatgttttaccacagctaagagaactacaccagcttctaaaatacccacaaaagtcacattcgtgatcacctctatctagaaattagcatctagaatccataaagatgtgttttctttatgatgtctgaattgaaggtctgcaacattaaaattgtatttcatagcttttccagccattacttgtaatagactttagagagtaatatgacatattctttttacagcttgcaattcataaagccctactagaagcctttaaaaacaaaaaaggaaaaacacaaacacctagaacacaaacacttagaaccttttttgtttgtttagaaaagtaaggcatagagaggtaaaattagccttaaatatgaaagggtacaaaaaaactgaaggttttgttccattttcccttaaatggctttcatttttggtatgaactatagtcttattcttatactatggaaaaagatcctgatttgttgctgattttatgatttgctgcaataaaagaccaataccttaaagcagtgacttattttctccctcctattctcttaatctaaaatcaataaagcatgtaataacatacattactaaacaaaactacatacgcaaaatactaaagttagtaatttcttaaatagcagttttttcataacaataaataagcattaacttggcttttaaatataacttcgatcatgacacaataatggccaaaatatcaaatgagggcacatgctgtgcatttcagaaaaattgtttaaagagaccatccccttttgtattttcctttactatccaatatcctaaagagtgcttaaagaattgcttttcaactcaatacaacacaaacaatttttcctaagaaatccaagctgtcaacttatgggtcacatttcaaccttatgtaatttgaaacagctacggtactgaatccttaaatacagggcatataatggaaggactgctcacagatccttgatgttactgaagcttggaaagctttaataagatacaactataaataaagacaactaaggagcattacccctttatccacagcccaaatccccctccaagccttacattttatatttccaataaaatgctcttctaacactaagccactcatctaaattatatttaaccaatgaagggttaaaatccaaaacatattaactactcaaaacataataaatccgtaattggtgagctccttttctaccctcctgcttcagtatactgacatctaaaagtcaaagaactcctctgtttaagactgaaattcccaggaggaaggaagctcagatccagtctgagagcacacaatggaatcacagctgacgatgcacatctttttctagatgtctccatatgcttgagaggtttttttccccccaagccagccattaggagacttggttctctctgccaccaagaatcttaccacattttcaaggattgttgcaaagaattaagtaaaataatgtgttgctcttcagcatacaaaagagagaagggcatatgtcagagtgcccataagtaactaaattaacaaatggtggggggttttgaatgttgtcaaattttgaatgttgtttttaatactccttacctctctgtcagtctaagtgtttggtttaccttctctgtttttactattttattacaaaaaacatctcaagagccacagcaaaatgcaattaattcttgtctacatgcacccaaaatgatcctgaattgggaattctcatggtaaatttgaaaacactatattacaacagaacacatttgtaagatttggcaaatactgttccctagaactgcagtccccttcgattctttcttagcaacccaagattaataaaagcttgacttatagaaaagatacacattttccacataagatacctaaaagaaaacactcccaaaattaaattcatgggatacttatgacaaaaatcaatgaattcattcttaatctaacacttttcattctttgagctcccaaagattctacaaattccaggtgagaaagggagcattacttctgtcagtgtgcctaacctcaccaacaaagaacaggaacacacacacacatacacacacacacacgcgcacacacacatgctttgtagcagctgctttctttttaaaagactgctattcctgcagagcaacctgtgatctttacagagaatcaaagacctctgttcctaaaagtcaagagttgagaaagtcacttgactgaacgcgcaataaacagttaaaaccaaagatgtctccaaaccttgtataaaccagaaaagtacccacacactgtacaattcagcagtgtttaagaaaattaaaattatttttaagaatcttttgtgtgggagtaatctggcaaactacattttactcagactttttcctgtagacaaatattctttgattagctttgctccttaaatacccacacttaatgtttcaatcagtgatgctttagttcccaacttcattttgtttgcaaaaagaaaaaaaaatgcataccataaaccacaacttttttttttaatgacatccccaatgccgaagtttcaagtacactttgggaactggagctctaattaaacaagaaaccagtgaagccattatgaacaatgatgctttctactaccaataatcagttgacgtgatactgctcccatgccttcattctcagggttccctttcaaatttcattgtccccattctggcatagctgagtgaaaccgagataagaggtaaacgggtaacttctgtcttctgtgacccttagcatgtaaaccggacgctgaggtccaggacatgatcactacagcatatgccattttagaaaccggcctcggtgagttactgccacatcctaaagtggctttagacttcgtcgtgtctaagacaacgtctatttcggtacgaaagacatacaggacctcgagtgcctcggcagcctctgcgggtcggagcccctataagtgacacaaccccagaaatcaaggagcgggtgactcggggatggacaagagtagctggctctcagcgtctccatgactcccccgccccgcatgcaactctgctctaactggtcaggagaaaccccgcccccttccttcctccggtccgcacgattggctcaccgacacccggcaggtcagctccctgccttcgattggctcactgccccatcagtcagacgcaccgagattcgggtcggtgggaggggaaggcgtcggaggaggtggagagggagtgggattagaggacgaggtggcggaggaaggtgttcaggctcggtctctggtttgggaaagtttcccctaccagtgacggacccagaacgcgggaggcccagtccagctccgggccagcggaagggggctccagtccccgattcccgcccctcggtcccgcaggccccggaaaccactagagggaggggaagagggaggggccatctaaccagggaccgacccacccccggtctcggaagaggcgcctctgggactcccccgaggggaggaggcggggagcgcagccggcagcgacgaccccggccccctcccccagcaccccccaggggcccgagagggccgggtccccgtgcccggggcgtgaccgtcgcgaggcggccacagggcccctcccgcttcccgcctggggccccgagggcctgtcccttcaggggcggagagaagggggcgagaaaagggggcgctggcgagccaacccggaacctcccggtccgcctcccgcccccggccccggccccagcgcgcctcctgcatacacgcccgcacccagaaagttcagtcaggggcgagcccggctcggcgccgccggggcccggcccccggctccccgcccccaccacggcccggcctgctcggccccagcgcgccgcccgccccgcccgccgcagctccttcccgtccgcccgcggtgctcggcgcccctcgccccccacccccggggctgacacgggcccgggccacccgccgggccgcggctccccttccccgccccgcgctgcagctcgccggccgccccgacaccccgcttcaccttcacacacccccagcacttcccgagtcctgcctcccctcgcccggctcccactctccgctgcagccgctccgcgcttccattaaagaatgcaccttcccaggattcaccttctcggctctgccgcgctgcccccgaggggttagagcctcggtctccgccgaccccgcaccgggctgggcaatgggcactcgctcctcggggcgggggccgcgcccgcacccccggccgcgcctcggcgctcacctctcgcccgcgccgcgggctgcagcctccgcccgcctcgcgctccgggactcgtctcctgagctctcgcaaggcgctggagcgcctcctttctctcccggggactccgcgtctccccgtcgcttcccgccctccccacccccaagccccaactccccagcgtcgctgcgcctccgggatgcaactcccgttttccgcgcactccggcggcggtccccgcacacaaaaacagcctctcggaggcgcacggctctgtcggagctcggcgcaggaagggcagtcgcggccgggggtggggacgcggcgccccccgcctgccgcccgccccccgcccgccctcgcggccccgggggaaggcgcggttaccggctcgggtcggtcacgccgtcaggtgccggctgccgtcggcgctgaccttcgccgccgaagctgtagccgaggctgcggccgccatgttcccgtgttaataactgctgcctggttgtttatttcaatggagatcctcccccaactccctcctcctcctcctcctcctcctcctcctccgcgtctccgcacttgcggagagacagacagcgcgagctcgcgagcaggggagggggctcgggagccaggccgtccctccctctgcctccccggcagtggccgccgccaagtcctgtcaccgggaaaaggacggggcggaaacttgcctctcgcgcccccgaggaaggggcaaaggtggacgcagggttgtccggggagcagcccctggccgcggggtccgcagcatctccgtcggcagagtcctctgagaaggcggcccggggagaggtgaagaagagtaaggggacaggggacaaaatgggtgactgtggtagagggagggtgacctagaggtgactggaactgaagagagagtcaacagaggactgcatgggagggcaaagggcaatgccaaaaagaaaactagcgactgggacgggcctgggccgctgagttagaggcagtggggcctgggggctgcagacggcagggacggtgccccaggacgaagatcggggagagccgagttccagggtcgccagcagaggaccctcgcgcccgtccggccggacccttcggccagcaccctgcaccccctcgggcgcacctcaccctacccaactcccggtcctgccgctgctccccggaggcgccccgcatccgtcaagtcccctacggctccaacagggagaggcttctcccattgcagtcctagctccagaggggatggagaggcgcgactgtgggagctggaaggggcaccacccggcaattgcgggataaagcaaatgctgcacacagagtgtgaaacttaacctggttgagaattttcggcacatcatgaaatcataagtttgtattggaaagtccattctctagacatccgtgaacaaagtactgaggggacgtaggagattggcactgaaaatgcgagaacccccatttaagtgttacttagaccaatctgttttacgctttggaaaagcaagttttttttccaacttatacggtaattagttgaaaaaaaaaacttttgtttaatggcagttatcaaactatgagaggaacatattccctgattttaatcttataatgagaaaggtcacttgcggtagacaataagagtgtttattgaacacttactgtgaatctgactgtgctaggtgatgtatatatgctataggccttaatcctcaaaccttccgaagtcattgccgcttttcacttcacacaaaaaattgaagcttaaagtaatttgcccagggtcacagccagtagttggagaggatgtgagcccagttctggtgagctccaaagcccatgcttttaaacatgtcttcatcctaaaatttgtgggtgtaccgccaattttatttgggaaaagaataaaaaaaatgtgtggggtgtgtgtgtctgtgtttgtttgtggatagaaaatgcttggaagcctataacaacaaatgttagcgctggggagtgtaagaagtgggtgatgaggcacttccactttttattttgcacacctatctaatgtttgaaatgtttgcattgactatgtattaatgtatatttttaaaggttttttttttttttttttttttttttttttagctagctggaataatagaattatgttcccaaagcgttgagaggaaatggagagtttgtttatggcctatcttctgctaataccagtctgtagcttgtctacaatggggtagtagtcacctgaggtttgtcacaattctgaactcccgatttgctttcctgtcctcacccccaactgtgagttatcaggagttgtgataataaataaataaataaataaaaatttaaaaaaaagattctccttcttgcttgctatccctcccattttggcagaagtccagagtctatcagtcctctgcaatcgtagatttcacactttttaaaactacccatgatacctctgcaaacaaatgactccccccattgcattcccgtattacccaataaaacgtcttacgacggctgaagactttttcttacaagaaataaacaaaaacgtctgacagcatagtagatgagttccatgcccaagtgctactcaattgcctgagcttgaattgaattgtgtgacttaaacgcgctctggtacaatctctgggtgccctctgaacttcaggctcttgctgtaacagtagtctgtcttgcactagagttgtttatatgtttgtctttctctttcactagattgtaagtgcaacagagcccaagacctagtcttgttcttgtttgtacatgctatagcacctaacaaggaatgtatgatgtttgttgtttcattgaatttgtgaaatataaataatagtatctattccgatcctcatgtcctcttccccacctcatcttccaatcccttgctcataaaacatgtttataaaaaacatcttccatacttagaaagaactttgattcccatgagacctcagaacaattgtttattaaaactagccataatttttagtgaatcatcactatgataatgtaaaatgaaaaggtagaggaggcggtaaataagttggctcaatgacacaaattaagaaaggaagaagaaggaaagaaaaaagaaggcaaagatataggaactaggtatattaccaagagagaacaacaaggaaaaaatatgtgggtgcagatcataaaggggaaggaaattattgaaatttagtggaagtagaaataacataccgtgaatggatgaggcaaggaaacaccaaaaatgtcagcagaatcataaatgcagcatggaaaagtaaagaaaatgacaaattatatatttaacaatataacctaggaataatcagaacaatatgactgctacaagacaagaatttctatttttgtctgccttttcttccacagttttcaaagtactcacttttttcataagtaaactgcataaaagtgggagattctatactatttttgagttaatactactagcatacatcatgagattagaggtaacagtatggtaaaaaagagctatagaatataagcaaataaatatgatgtgaagtggtctctgtaagttactgtgtgacctcaaacaagtcactaaatatcgcaatttcctcatctgtgtaattgttgcaagactcaaaatggtgtaaataaatgtactttgttaactatcaagctctttatacagatgtaagggaatattattatgtcagctaatatgtagcacagttatctctgttttggtgcattcctaaattgccaaagcaaaaatctatagttcattctattaaaatgtaatcatagggtgggggcgtcagttaaaacatttgtttgtcaatttgattattgaacgactgtgatgaaatgtttcattcttattgtttgctctcttctaaatcccttaaatagtataactacaataaacaaatgtctaatataagtcaagcatattacataaattttttccttactgaagtagtcattgtatgtatattattctcattttatgtacaataaagctgagcttcagagacttcaagtaaattaatgcaaagtcatagaactgccttcgctgcatatctaagattgtgttaggattctactcttcatcacttgtatttctactactctgagaaacacattggctgggcgcagtggctcacgcctgtaatcacagcactttgggaggccgaggcaggcagatcacgaggttaagagattgagaccatcctggccaacatggtgaaaccccgtctgtactaaaaatacaaaaaaaaaaaaaaattagctgggtgtggtggcgcgctcctgtagtcccagctacttgggaggctgaggcaggagaattgtttgaaccgggaggcggaggttgcagtgagccaagatcgcaccactgcactacagcctggtgacagagcaagactctgtctcctagaacataatgcatactcaataaatgatcatgaaaagaatgaataaatgaatgaatgggctcccttcaagtcatactgtacactgtcacaggattgatcccctcagtcttattttgttactttcccacttgaaaacacttaatgatccttcattaactatggaatacaattcaaatccttcatcttagattaagaacctctttgatataccccctctattcatacctcccttatttctccccctctattcatacctcccttatttctcaagcaaaaacaaatattaatacacccacactcattccagggtattctgagtgagattgacatgagtttcaatcttggctcttactaactgggtgaacttgggcaagttatttggcatctctgcaaattttatcagtgcaataagacaagaaaatgaattggaaggaggtgaaaccaaacttattcactaatgatgatatagtgtacgtacaaaattcaaaagaatccatgaactactaaaatgaatgtaggatcacaaggtacaaggtcaattgtatttcttctgtatgttagcatgaaacaactggaaaatgaaaattttaaaatgccatttacaaaagcattttaaaaatcaaaattcaggaataaatttaatgaaagatgtcacatgatctctacattgagaaaaaaatattgctaatagaaattcacaatggcctaaaaacagaaatagactgggcacagtggcacatgcttgtagttccagctacttgggaagctgaggcgggaagatcacttgagcctaggagttgtagaccagcgtgggcaacatagcaatactgtgtctcttaaaaagttaatttttgtgtgtgtgtgtgacatgaccttactctgtcactcaggctggagagtgcagtggcacaattacagctcactgcagccctgacctccctaatagtcaggaatacaggtgtgtgccaccacacccagcttttttttttttttttggatttttttttttttgtagagatggggtttcaccgtcttacccaggctgatcttgaactgctggggctgaagtgatctgcccacctaagccttccagagtgttaggattacggcataagccatcatgccagaccaaaacattaaatttttaaaacaagagatgggaccaggtatagtggctcatgcctgtaatccctgcactttgggaggctgaggtgggaggatcacttgaggcaaagagtttgagaccatcctgggcaacagaaatgggcaaaaggactccatttctgttttaaaaaacagtattaagatgtcatcagtattaacatgtcaacacttagcaaatggatctatagattcaatgcaatcccaatcaaaatcccagcaagctttttaagtaaaaattgaggtctaattctaaaaattatatgcaaatacatattacctagaatagccaagacaaacttgaggaagcatgagttgaatgacttacactgccagcttcaatatttactataaagctacactaattaagacagtgtgatattggtgtaagaatagacaaacagatcaatggaacagaatagagaattcagaaataggcccccaaacttatagtcaatgaattttgtacaaagttgtcaaataaattcaatggaaaaaggaaagtcttgtcaataagtagtgctacaactaggtatcagtttggagaaaatagtgacttcttaccatacacaagaatgaattcaagatggatcatagacttaaatgataaaaaccaaactataaagctcctagaagaaaacatcagccatccttgtattccaagcactttgggaggccaaggcaggagaatggcttgagcccaggagttcaagactagcctgggcaacatggtgaaactccatctctaaaataagtaaataaaaaagccaggtgtggtggcacacacctgtagtcccagctgcttgggaggctgaggcagaaggatcacttaaacctgcaaggttgaggctgcagtgagccatgatcatgccactgcaatgagctgagctggagcctgagcaagagagcaagaccctgtgtgaaagaaagaataaaagagagagagagagagaagaaagaaagagagagcagccaggtgcagtggctcatgcctgtaatctcagcactttgggagaccaagacagccggatcacctgaggtcagcagttcgagaccagcctggccaacatgatgaaatcccgtctctactaaaaatacaaaaattagctgggcatggtggagcatacctctaatcctaactactggggaggctgaggcaggagaatcacttgaacccaggaggcagaggttgcagtgagatgagattgtgccagtgcactacagcctgagtgacagagtgagattcttgtccaaaaaaaaacaaaaaactgacaatatcaaatactggggagaatgttgggcaattggaactcttattctttgctggcagaattgtacaaacaccttggaaaacagaaacttcctcatgaagttaagtatacacaattctaccctacagttctcctaggtatttacctgagagaaatgagaacagatgttcaccaaaagattgtatagaacattaataatatagaatataataataacccagcctcccaagcagctgggactacaggtgtgtgccaccacacctggcttttttatttatttatttattttagagatggagtttcaccatgttgcccaggctggtcttgaactcctgggctcaagccattctccttccttggcctcccaaagtgcttggaacacaagcatggccgatgttttattcatgatagtgaaaacctggaaactaatttccatcgtcaagttatgtggaggaacaaagtgtggtatattcgtacaatggaatagtactcaacaatacaaggaacaaattactgaaatatgcaataacatgaatgaattttagaagcattttgctaagcaaaagtagtcgtacgggtgcattctgtacaattgcatttatgctagaatactacaggtgcaggcaaaatgaatgtataatgatgaaagttgatgctagggttgtggggggtgcagattgactggaaaaagggaagacagaattttggagggatgaagaaatattctggggtgattaatattgatttaggtgatagttacattttgacaaaccattgtcaaaaatgtattgagttgtacccttaggatttgtgtattttgctattaacttatgcaaattatacctaaacaaagtactattagcattttaaaaaaccgggtaagagggaagttccccagtataatgaagtatatttacagaaagcctataacaaacattgtactcaatattgaaacatttatagcttccccctgagattgagaaagagaattgcaaatagtatgcccagtattaccatttgtaaccaacattgtacaggcagttctagccaatgtgataaaaggggaaaaaatggcataaagattgctaagggagaaatagaactgtcattatttgcagatggcatgaatgtttatgtgaaaaatgcaaaggaatctacaaactattagaattaaatttaataagatctctagaatgggaggtcaatatagaaaaattaattgtgttactatatattagaaacaattagaaaatgaaaatttggcatgtaaattgaaaactgtttggcaatatccattaaagctgagcatgtctcctgggtgacctaataattctgttccttagtatgtatcctatagagtccttcaacagaagactgaatgaattacagcatttttgttcaatggaatactatactgaaatgaaaatgaacaaactatagcttcacacaataacatgtataaatcatagagaaataaccttgaataaaagaaactagatacaaaagaacactactatatgatgctatttacataaaggtcagacaggcaaacctaatctatggtgatagataccaggatagttgttaccttttgccaggtaggtgcggcctaggaaggcacatgagagagatttggggattctgagaatattctgtttctaatccgagtggaggttacatggacatgttgattttatgaaacatttgtgcacagtttattcatggtatacaaatgacttgtgtgcctatgtatattacacttcaattttttaaatgttattgttgtttgcatttactgaatctcgctccctaactagactgtaaactccctgaagacagggattatattttagatttcttagcatccctcacagattttagcacagctgcttcataaaatgttactttacagcccaggcgtggtggctagcagctgtaattccagctactcaggaggagtagcttgagcctaggagttcaagcagcagtgagctatgatcacaccactgtactccagcctgggcaatgaagcaagaccttgtctgtctctaaaaagaataaaaatagaaaataaaagattactttacaaaaataagttgatatagttcccaataaagtctatttgtttagttttagtgtaagtacaaataatagtaaaacaacatattttatatatatatataaaatatataaagatatgtaaaatcaatttaagtattgacattttgtctaaagatctcctttctcttagtttatctctagtaactccaaaagaaagctctagatatatattaaaagtagaatttatactcaggaagctgagacaggagaattgcttgaaccaaggaggcagaggttgcagtgagccaagataacaccactgcactccagcctgggcaacagagcactacttcgtctcaaaaaaaaaaaaaaaaaaaaaaaactagaatctaataaattaagcccaatgtgagaatcacatctcatttgagtattgctagtatgtaaaaattggaatacagatagacataacaccaggtattggcttcacctgacttaacaccacttaacataaaagttaatagtgggccgggtacagtggctcatacctataatcccagcactttaggaggccaaggcaggtagatcactggaggccaagagttcaagacctacccggccaacatggcgaaaccctgtctctactaaaaatataaaaattagccaggtgtggtggtgcacacctgtaatcccagctacttgggaggctgaggcatgagaatcacttgaacccaggaggcagtggttgcagtgagctgtgatggtgccactgtgctccagcctgggcgacagagtgagactccgtctcaaaaaaaaaaaaaaaaaaaagaatagagacataggttctaaaggttctaaaccggtatctgaatgcataatcaatgagacttgggcattttgtgtgtgtgtctttctttacacacaacatttgccatcttagctatttttaagttacaattcagtggcattaaatgcattcaccttgctgtgcaaccctcaacactatccatctctagaattttttcaagcaaatcttctggacatgcaattaaatgcatctaggactcagtttcctacctgagtcctacatttttaagattccatgcagctctgaaacactacatccgggaactaaagaacattcaaagaaaaacagactcctttggttaaaatgcaagttttataaaaccctagatccagaaacctatgttaatgttcagttacagttgggatagaataatgcctttgcgaaacagactgcatctaaataattgttcttttgcctcaggaaaagaaccatcttcagaagagtaatatacccttcacttcttttgaaataggctttataaacatggaccacttgacagagagtcttaccactgaacacccactccagcaatagtttctgaactctaaaatcaaaactttgtttttattcaaaatatttacagagtcaatcaatgttatacttttattagtccattatttatgaatgtcgttttttaacatctttgattaaatgcctcggcccctgggttgtttgttttgttttgttttcagttttcccccaaaataattatgaagttccagccatgcgactaccagagagattgcagttggtctcgtgccccacccccatgcccttttagatgattaatgtccaagctcttaaaccgagtggtaggtatgtgaatatttattattcctatatctgtcacacatgttataaatattttctgtgtatatatgatatttagtttaaaaaatttaaattccttctataataactgttttacttaatcacattcttttcttataaaacaacaaaagctaacatttagaccctgtttttctttagaccaagttttaaaataaattactaatattgggtactttctcatacactttgtctctgatttacacatggtcaactaaccaccgtctaagactaacaatgctcttccatgtctgaactcccttctctttctgcctctgcctgcctcttcccttatcctctttcctcttctctctccttactgtgggctttgcagctgtttctctccctttttaatagtggtttcattgacaatatcaccattgcctcatatgtgagttctacctccctctggagatgattgttttccttcctctggatcccttgttgccatccctaagataaaatcccaagcccaggtgactttgagtattccccgacagagcaaccacattaccccaaggtgccccatcttcatctatacatgtttagcagagtccctatccaagtgcagcatagttttccacaaaaatgcatatgatggttatgttttattaccagtacagtactattattgatgtcacaggttttaggaagacagctctgagaatttaggctcctcgaaaatctggtttctatagaaaaacatgctttactttaccaccaataaatgaaaaagtaaactttggaaataagtgcatgaagattgtttgtgctttccatctaagacttcaaagcccttcataaaacacagtttttaaaaaagccttttgacacaactaatagccattcaaggacttgttatattcataactaagatgcatttattagcaacctttgacatgaagcccaggagataatgcacaaaatgataaaaaaaaaagatagggtatgtttctttccatttattaattcagtgaaaatttgttcagtttctactctagttcaagtactggagactaggcatggtggctcatgcctgtaatcctaacacctttggaggctgaggtgggaggattgcttgagcccaggagtttgaggctagcctgggcaacatggcaaggcccccatctctacaaaaaactttcttcaaaattaacctgagttttttatttttttttttaattagctaatgttcacctgtgttcccagttacttggaaggctgaggtgtgaggatcgcttgaacccaggagtttgaggcttcagtgagccatgttcacaccactgcactccagcccgggtgacagagcaagactctgtcccaaacaaacaaacaaaaagtactagagacccagtactaaacaaactcctctatctgaatgaaatttacagcagatgcggcccatactaggcactcaataaatatttgtggagtgagtgattgtgcctaagaaaacccttagaatacgatagatatttttgtttcataaaattcaatgaaatcaatgaatgaaggggttgcagaatataaattaggcaggggaattttacagcaatcaaagttaaaatacttcctattcctactgaagtaattgtgggcgggaatattgggtgactgtgaccagaaaggcaacacctctacagcccatatggctcttactttgctgggcacgggttaggagacaagtgccatcccaccactacctctatacctttttgctaattttaactttgagacctaagtgtattttatctacaagtagtttagatttatcatcttcacttcaagaactctgcactcatttacggtagcattgtaacagaagacagaattttaccaaatgtaacaaaggctttagaccatgataattagttgcatttgaaatcccatcttcatagatattcataatgtatttcttctttatgatattactacgattgcaatcctcctaaaaagccaaacatttttgtattagagttctctagagaaatagaaattagatatttatatctaataaagagattaattttaaggatttggctcatgcaattgtggggacttgaaagtccaaactttgcagagaaggccagtagggtggaaattgaagcaagagttgatgttgcagtcttcagtctgaaggaagtctggaaacagaattccttccttcttgggggacctcagtttttttgttttttttttttttctcttaatgcgctcagctgatttaaatgttcaatgagcactgctgatttcagtgttaattacatctaaaataccttcagagcaacatctagactagtgtttggccaaacaactgggcaccacagcctagacaaattgacacattaaataaatcaccacagactactatttctcaagttggatccatgcagtcttcttaagccatacttaatctccaagtgaagacaataaaaaattcatacttctgcctaacatgatacaactatcttgtgtgtaaccaaaaatacactaacactttccccagagaggaaagcaaagtccttgagtaatgttcactcttcttgatatcttgtaacttaaattttactatgatattgccttagtacatttaatgctgctatatcagaatactagagactgggtaatttataatgaagagaaatgtattgactcatgattctggaagttggaaagtccaagactgaggggccagatctggcaagggctttcatgctttatcatcccatggcagaagggaaaagagagagtgagagagtgagaacaaagggtatcaaacttgccctttataatgaaccactcttgcggtaatagcctaatcacttctcattaggctcatctcccaacactattgccttggggattaagtttctaacacatgctttttgggggacacatttaaaccacagcagatgttaagttgataatacttaaatacttgatgtaaaatcaatacatcttatgttatatgttaaggggatatgggaggaaaggaaagaaaacaagatatttgccctatacacacatacatgcattcaaatgaaataaggaaacaattacagcctcatttctataaatggtcatgtggttgtagctagtacttaaaactaccttcttggtgctgggcatggtggctcatgcttataatcccagaactctggaaggctgagacaggaggatctcttgaggccaggagcttgagatcagcctggacaacatagtgagacctcgtctctattaaaaaaaaaaaaaaaaaaaaaggccaggcgcaggggctcatgcctgtaatcccagcactttgggaagccgaggtgggtggatcacctgaggtcaggagtttgagaccagcctggccaacacagtgaaaccccatctctactaaaaatacaaaaatttgtcaggcatggtggtgggcgcctgtaatcccagctattcgggaagctgaggcaggagaattgctttaacctgggaggcagaggttgcagtgagccaagcttgtgccatttcactccagcctgggcaacaagagtgagactctgtctcaaaaaacaaacaaacaaacaaacaaacaaacaaacaaaactaccttctttcattatccattctgtattccccttgccctcaacaagcatgttactcagctgatcgtggttttttacccggtcaggtgactcaaaacttcattcatgaaagatctaagtaagccattagtagttgtgcctgaattgggttgtagtttttcattgattttactctagggtatagaggactaagagacatcctaatagatcttctgcatttcagcctttttcgtatctccattgtgtagttgctgactagtttcccctggcaatcagaataaatcattccagcagtacattaactcccttctttgtctgctaattcagaggcacgagagagccaaagtggccaggtcgcaatcttaacttccagttcatggagccattgttatgtttgttagtggaagaattcctccctttggaactaagacctctagattagcagcatataaaatctcaggaataggaagcaaaaattttgctagtgaatcagtagcatagtagcgatactccctcccatttctacttcttaattctcagacctgtgaatagtgggtatgggagaaaacagcaccatttattgacacttacttagaacacacacagccacctggagaaccctgtcccagtcctgcaaggtattgtcacctagctgacattataactgagtcttcaaaaggccattccactgtactgtcaagccagagatgcttcaggatggtggggaacatggtaagacaagtgaatttcatgaccctgggcctactgaacttcatttaccataaaatgagtttcttgatcagaagcaatgctgtgtagaatgccatgatggtgaataggaggtcccgttctgtggataccagtcagcctccttccagagactcctgtcatcattcagcaaactcataaacaaggtgactatgatggcaatatggacttccaatcagtggatgccactgctaaatccccagtctgccagcagcagagaccacaccgagtcccccatatggcaccattccctaatcagctagctacctagtggtaggtcaattacattggactgcttctaacatgaaagaagcagcatttactctagttatagatatgccttccctgcacaaaatgcttctgtgaaaactactattatagaccactttgctcagaagcaccatctctttgcaatatttttcaaaagaatatacataacactgaaatagtagttaaaacaatctaactcactttctttggtgaccaaaaatctagtactatatttgcaatatattcattttagcaaacttgctctaaaatgcaaaaaaacatatttataattgacaattggttataaacataataccagcaatgtgatgtatctgtagtaataaagtgagtgctctattcagtatgcttccatcagtgtgtataatgggttgtcagtgccaagctgagaagatttggatccccatgggcataatttcaagattttttatagtatagtggaattttgtaggattttataaaaaaaaaaaaaaactagatatccagattctttattgaacaaaccctcccagtgtatttggcttggtttcactgttggctttttcttgatttttgctaggtttttcatatgttaaattttaagtagggacattgttgcaattcttcaaggagtttttatctttagtctgctcactcctaaaatgatgtttttttaaatgaaccaaaaggatatattttatatagcatgttttaaataaatagtcaatgaaaatgtgtgtaatagtatctatttttaagtactatgctattatgcataatctgttttctttaaaatttgaaattctttccttccctttaaatatatcattaacttgtgataatcttaactacattttaactctattctagagtgattatactttctttacgatgggctcttttactttttttgccccttttcttgtccctacttattgtttttgccctttttcttgtccctacttattgtttcttttctattcttggtctgttttaatgtccctttctcatatacttttattgcttacttgcttttcatctaactctttaactctcctttcctataatcctaaatgatttgtgtcatctaccaaactgagtttttactatttttttcaccaactgttaatcagttttgtcattttaaggcaccctcaaatgtgacttcaatttcaaataaacttcccatttgctattgatataactataatgtttgtatacatttcccatgacttccaattaaccatgaatgacgacagtttttaaacttgatttaggtataatgctatagaaatacactttgttaatatgcttgaaattaaattttaacatattccttattttgggaaagcctgtgcacatgcctctggcaagcgtatatgtcactttatcatatgtgctggagtatttttctcctgctattagactgtaagccccttaaaagcaagaaccatatttaaatctctagtgtctggcacagggcaggtttttaatgaatggatagtaaataaataaatgaatggatgagaacaaagttagttgtgtaatttccatggtcttgttcaaaaaatacttcctctgccagctccaaatgatactaaatgaaatttctttcacaaaggccaagtcttttactttcccaactggacttattttacaacaaaaataccgttagaaaaacacatttatttaaacctatttatccaaggcagaagttcttaatcttggctgaaattggctgaaagtgagaatcatgtccccatcccagtaaaaataaattagaaacaccagtcccccaaccccaggtgagtctaatgtgaaggaaaggctgagaactactatgctaactaagagagaagcaaccgatggcatgttctaaggggcatgaaaataaagcgaggtctctaatgattgtggcaaagaagttctttgctgtgggaagggaggtggggagtttaaagagtccatttctcccttcaggaggctgggggtggctggagacagaagtgttctttgttgttgttgtttttgtgttttgtttttgagaccaagtcttgctctgtcgccaggctggagtgcaggcgcgatctctgctctctgcaacctccacctcctggtttcaagtgattctcctgcctcagcctcccgagtagctgggactacaagcctgcaccaccacgcccagctaatttttgtatttttagtagagacggggtttcaccatgttggccaggatggtctcgatctcttgacctcatgatctgcctgcgttggcctcccaaagtgctgggattacaggcgtgagccactgcacccggccagaagtgttttttaaggtatctgttatctttaaaaacttaaggagaaagattgtaagtactatctaaagaggtaaactttgaaaaggaaaaaatatttaattttaaattttaaaatgaggtcagagattctaacaaatgctaataaaagggctctttgaatttttggggcttttacaaaaaatactgtgtaggcaggcaaacacagcaagtgtattaggtatacagactaatacactaagaggaaagcctaaagaagaatcaaagttgacatgacagaacttgagaggggaaaaaagaattagtattagaatactaattctttaaaatcttgacacggtggctcacgcctgtaatcccagcactttgggaggccagggtaggagaatcacttgaagccaagagttcaagactagcctgggaaacatagcgagacccccatctctacaagaaaagaacacaaaacaattagccaggtgtggtagcatgcgcctctagtcgtagctactcaggatgcggaggcaggaggattgcttgaacccagaagttcaagactgcagtgagctatgatcgcaccactacactcaagcctgggtaacagagtgagatcctgtctcaaacaacaaaaaagtattttttaaattagtgtctatacgataataattccgaaaacataaaaactatatgtgtctgtggatgaggactagaaaagagatattaaatgattggcatgtttaggtgtattaaacttgaagcttgaagttctggttcctactttgctatttagatgcatacgtgtggtgaggtttgggcttttggtaaaaaaaaaaaagtaaatgtagtaaaaatatagttaaaaaagtaaaaatatatgccaggcgcagtggctcatgcctgtaatcccagcactttgggaggctgaggagggtggatcacctgaggccaggagttcgagactagcctggccaacatggtgaaaccccatctctactaaaaatacaaaaattagtcaggtgtggtggagtgtgcctgtaatcccagctacttgggaggctgaggcaggagaattgcttgaaccagggaggtggaggttgcattgagctgagattgcgccattacactccaggctgggcaaccgagcaagactccggtctcgaaaaaaaaaaagtaaaaatataaacaaaccaccaaaaaaaagaaagaaaagatgctatgtgtccttaaggaggtctcttcatttctctggggcccaaatttcttttctgcaaagttagggaattgaaagctttagttaaactagtgcttcttgcaagattcctctaagagagtaaagaatgtagcctgtggctcagagccaaggcaacctgaagcacccactgcaagtccaaattttcttgaagtctcgtgttttgccttaaaggtgcatatccttgtatgtgaattatttctcaaaatgctgtgttttttttttttgttgtcattgtttttgtgttggggtctcactctgttgcccaggttggagtgaagtcgtgcaatctcagctcactgcaacctctgcttcccagggtcgagcgatcctcccacctcagcctcccaagtagctaggactacaggtgtgcaccaccacacccagctaattttcgtgtttttggtagagacgtggtcttactatgttgcctaggatgatcttgaactcctgggctcaagcaatcttcccacctcccagtgttgcgattacaggtgtgagccactgagcctggccaaaatgctgtttttaaaaaaagttcatgagctttttattccttcctattctttttgtgttttttttcttttaaatatacagttaatcccatattgtatatacaattttatattctgatttttcactatcatatctttcatattttatgtatgtcattaaaatgttgttacgttttctttttattttttcttttgagatgaggtcttgctatgtttcccaggctggcctctaactcctaggctcagcctcctgagtggctgggattacaggggccgccactgtgccccactcattatttttcttttaagagctatataatgttcagtcatatggctgtactgtaatgtattaacctcctgattgggatgttcatggtacagctcagtgtgttttcatctccactatactctttccctccacttggctcagtgtaaaggctgagccttctttatactttctttttttcttgtggttttttgttttgttttgttttgttttgagacagagttttgttcttgttgctcaggctgtagtgcaatggcacgatcttggctcactgcaacctctgccccccaggttcaagtgattctcctgcctcagcctcccaagtagctggggttacaggcatgtaccaccatgcctggctaattttgtatttttagtaaagacgggatttcaccatgttggtcaggctggtctggaactcctgacctcaggtgatctgcccaccttggcctcccggagtgctgggattgagccaccgcgcctgggctttctttatactttctaattgaatcctctgaagtgcaggagatcataagatgaaaatttttctctctcattgctgcagtgtgtgaaatggtctcttggtgatataaattgtaatttgtcctttttggaggtctcgccctaatgagggggaaggaagagaacatgaccgaaggctgactccacacaaggccttctgtaaaggttgtcacatgtcaccacccagtgagggaatcactatcccacttcatggaataataagcggagactcaaaggaacgagtaactggctacaaaagtggggtaccagggtaaaattgggttcaatccaccccagatctgtgccaagtggtcctgggcagcacactcttgtcccacagcagcaatagagccagcacagggtccccgacactctccgccaatccagtcttccctcagctccgatctcgatctcttttcttggctgcacaatggcctctcctgtgattaacatcttattttttgatgaggatccttagcatacagcagatagtttgttttccagaggatatacaaatgaatggttatttaatgtttagagcagggagcagcaaactttctcttttcctttttcttttggtatataaactatgtattagcagacaaggccacagacttagtgcttcttggacacagccatagtatggccacagtggccagtggtcttaatgtgctggcttcagacacgaagaccccagaagtggtgcagccctctacaggctggaatcttcttcagttgctccaggtcttcacggagcttgttatccagatcattcgccaggacctggctatagtttccagcctttccatccttctgcctgttcaagaaccagttggggatcttgaatgcatggattctgcttagtggcaatcatatgttccacctcatcctcagagagtcctgtgctcttggtgaggttagtgtctgctttctcaataccacatgagcatatcttcgacccacaccctcaatggcagtgatggcaaaggctattttctgccaacatggatgttggtgttgagtactcgcaaaatatgctggaatttctcagggatcacaagagataaggcagcagcacaagcggcggtgtgcaggcctcctgtggaagagcaaactttttctgcaaaaagccagatcgtgaatattttagcctttgtgaaatacgtgatccccgtcctaactactcaattctgtctttgtagtaggaaagcagccacagacaatgtgaaacaatgggtggtctgtgttgcagtaaaacgttatttaagcacgcaaatgtgaatttcatgtaatattcattgcttacaaagtgttactcttcttttgagttgtttccatccacttgaagatgtacaaaccatccctagctcaagggcagttcaaaaggcagcgtggatcatcatttgccaagtgccccacctcccaaatgggtggagtgttcaaatgtccaggctgctgaagtgagggccactcactccactaggacagttctaaaggacatacataaacagagatctcagccactaaactcctacttgtacattaacatgtgcggaaggtaggtgataggcgatgacagaaatgcatcttctagaaactaggcaatactaaataccctcccaaagctggaattcagttagcactcctgtttctggaaggcatccttgcactaagcatgaggtcttgttatttccatctccattccaaccatctctctaagaatcactcactctgggctctcagtacctgcagtgctcccctttattttttttaatctgcatttttaaaacatttcaatagtttttggggtacaggtggtttttggtttcatggatgagttctttagtggtgactcctgagaatttagtggtgccctcctttaaagactgcctgtcaccccacccagcccctcccttcggtggccacactagaatttgaagcttaaactaactcccctccctgaactcctcacatcctgttccctgccccattcctctaccttcttagccactttcactccattccttttactgcctcaatggcaacaattattccacccatcagatccatgaccaattgtttctattactttttcaccgtgcttcacccaaatcaaatcctcactttcctccttatccagcctaaatttcaacgtcaatcctgatactgtcttctttgcttgcacactaagtctagtttttagcacctgggtggtgtctttaattcagacagaacgcaagggagaagatgtgggaagtagaaaagatgatgcaaaccccataccctccccactggctgcactgcccatgcctggtgatgcctttggtgctaggggctttgtgtgccactatggccctaggactgcctgctccccagcctgagtctgggtccacgactcatttgctcttccaagcaacaggcctaaggcacaatcagaggatggaatgtgaatggaactggattttccaaaattatctggatcactgtcttcatttcccttagctctttcaggtatattattcatgaaataaatctgagcagagaataaaaattagatgctaagtaaacagcaaaactcttctcttcatagtggggtaatttatgcctctgggccaaaagagagatgacctaataccttctactgggaagtaacaagtttgggaggtagactagtcattccatccattacaactgataatctaaactaatgcactcttagagatactgaacatgtttcagagcaagcaaaatgtgtatatgatatgacactatttttgtgaccgataaaaacattcatactaaaataaaactaagaaacaaaataactgcctttcaacagatcagtgtgattaatagatgataaggtattacactttatatatttaattttataaattattcatatagttacatgaaattgtactgaagaaatcaattcaaattgacataattatgggcactggaatataaactaagaactgactaaaagaccagcagaaaacctgtcatgctttaagttaaaggcaggcactgtgaactctttgatacctggcatgctgtcaactagaaagctttagtgagtggttctttgatctacccattcaatattatttgatccaagttcgtggagggcaaggtctatgtcttatgcatctgtttgttttaaaatttcttgcaccttgttctgtgcccggcatgtagtaaactcaaaaaatagagctgaaatgaatcaatgagtgaatgaatgaatatggtggtgaggatgagacactacaaaactctgaattggtttttggttttgtgtttttagagacagggtcttgctgaggctggagtgcagtgtcactgtcatagctcactgtagcctcaaccttccgggctcaaaggatcctcctgcctcagcttcccaagtagctggtattacaggtgtgtgccaccacactctactaatttttaaatttttaaatttatccctatgttgcacagtctggttttgaattcctgggctcaagtgatcctccaacctcagcctcctgaagtgctggggttacaggtgtgagcacagtaatactagtatatctggcctggttttgtttttttaagccaagaaagcctaaattatattcagtatgtattatattctaacactgtgccaaattgtaattctcaattaaattaatatttttaaagtggccttgaagttagtaataatttggttttcaggaggaaaaatgagcatttcattaaaacagagaaactagtaaaatgagaaataaaatgaaaattaactatgaatctttaaatataaaagttttactttaaaaaggaagagtaagatatcatcaggtagagaattatatctgagcataagtagggatgtgttcacacgaatgatctactagaatcagatatataaagtgtaacaccttttcatttactaatcttacatctctatttaaaagcagttaaatttcctcagattatctattggtcagcgaaatagtgttatatcatttaaatattttagtaccaaaaaaagccccaagcaaatagctcgataacctgctgcttgaatattctaaaagcccttacaaagtgtcttaatgttataaaaagttgagtagtgatttcccacaatttgtacaagtggtaccccttctcccagcctctgcccctgttcaatttctctcaacttactggagcaaactatttatgctgaaagttggccgtaggaggaagatgccaggagaggagctctgtggtccccaaatttatgacatatgccatgtgacactccgtcaacatgattgcaagccagtggtttacattcactttctaggaagtcaaaccaggcagggtataactgtgatgttgtggcttttccagcttcataaattcagtattttagttacgtatggataaatgtcacaattatatgccacaaaaatcagttcacataaacctgtccttcttgaggttttttttaagtgaaaaaggaaagtctaaaatgtttaaaattttgaataaaatatacttgaatctctgattaaaatgacatacaaataaggaaaaaaaattgagaaaattaacatggttctcatggcaggattgataaaaataggctatatttcccctcgaaggttttctcagaatacttttgctggtcaggcatggtggttcacacctataatcccagtgctttgagaagttgaggagggaggactgcttgagttcaggagtttgacaccagccaggaaacatagggagaacctgtctctacaaaaaaaaaaaaatacaaaaattagcagggcatgatggcatgcacctataatttcagctactccagaggctgaggcgggaggatcccttgagcctgggaggttgaggctgcagtaagctataatcatgccacttcacttcatcctgggcaagacctgtctttctctataaatataaaaataaaaattagtcagccatggttgtacatgcctgttgtcccagctactcaggaggctgaggcaggaggattgctggagcccaggaggtcaaggctgcggtgagctgggattgcgccactgcactttacctgggtggcagagtgagaccatatctaaaaataaaaataaaaataacttgctgttatctaaaaaaattgtttaaggaagaaattataatgtatcttgcaatctttaatttccagctgttctactgtcaatgatgacaggagacaggaatttagcttagcagtgtgcccaaagcaaggcagcatagcaactattctgtagggcaaattgctcagcgagcaatatgccctctgtgtggcaatctaacatgtgcccatgccgagctaatttgctaaaaaaaaaaaagtttagaacaaaagctatcacttcatgtcagctacttactgtgggaaacgactatatatgtttttgtatgattttcaatctcatataagaagaaggaagatatattgtggctgatgtcaatatttaactattttggagtctctgcatttcaaaaccttcacaaatttcaaaataccaatttttcattattctgcctcatgccaaaacatatttgtctggatcaagctgagtacagtgcacatcagcttaccttcaggaattataaatgcataattttgagatgttttgcagcaatactataataggccccattctttcatttatgtttgaagcctggtaaaaatatgtgcatgggtgctggggcatgagggtgagcaccaaccttcaagattgctcctgctaaatgaaggcaatttctctgctcagagttgtggaggctgaaagcatccacaaggttgttccagaggtgacaagcctttcaattaagtggagctacttaggtatgcctttacaataaagcaggagtgctgtaactgtgttgtaattccccttaatgtatgcatttttctttctgcttcccttccttcctccatttcatcctttcttgcttgctactttatttgtaaatttatgtttctttctagattagagtcactttgtacacatgtagggcaatttctcccagagttgtgatggttgtaaagtcatccctaagaatcttgtttgacatctcactgtcttcttatacaggcaaagaataaggggaaatatggaacaatcataattaaccataaatggagagtataaaagtaatacatatgaggttttaaatctcaatcgtcaatttcaagaacaggattaaagactaaaatcataaagatatcagcaaaagtgatttgtacactcaaaaagaatgtagggctttaatacatgttttatttttatttttagttaaaggacctttgcttttgtttttgtgtgtgtggggtttttgttttgttttctttttttgagacagggtcgccctccgtcagcccaggctggagtgccatggtgtgatcatggctgggctgaagcgatccccctgtctcagccttccgagcagcagggattacaggagtgtgccaccacacctggctaattttcttatttcgtgtagagatagggtctcactttgttgctcaggctgatcttgaactcttgggctcgagtgatcctcccatctcgggttcccaaagtgctaggattacaggcatgagccactgagcccaacctgtattttttaataatggtgaagtgcaactatgaattgtaatagaaagcaagctaaacaatatatggaaaattagtcttgccttaagtaagctttcccaaaattttgaatttaccttacagataaaatgagataaaaaggcaaaatctcttgcccctttaaggaaaatggcataacatcacagacatttgataactacttttacttcaataattatctttacttttacaatagcactacattttttacagctttataaagggataattggcacacaataaacagcagttaattacagtgggtaaattttgacatatgtatatatccttgaaaccgccaccttgatggagatagccaacatagtcatctccaaatgttttcttctgccttgtggcagttcctcgctcagtttcctgccctctaccccctttctttggctcaaccactgcctcattggctgtcatgataggttagttcggcattacgtttaataatctgtaaggaaaacaaaaatgttccctttcactcaattaaaaaaaatggttgcttcgtttcttaactggaaggtaaagtaatagtgttggagtgaggaggaagacacacaggtcatcagaaggaactctcacctgagtaatgattttgccgattatttttcatactccacagcctaatgctaattggattaaagattcaagaatccaggaaatgaagtaaaaaaggtatgttgagtttaataaataacgggtttttttctaccttatctatcaacttatttctagttaataaatggatttacgaaatctggccaaaaatgaaggtctccactgataaatgctcaaaacaagctgtatgttggagttttatgtcaataataaggcaaattgttgcaaatgacattaaaacactaaactctatcttatgaaagtgtgattttattccattacaatatgtaaaaattatatatgcagataagtaaagactggctgagaatctcaaaaatgacagttcaattttgctggcttgtggaattatgtgtatatattttaaattaaataaatattttattatgtataataaataatttatttctacccctttccaatatacattattctattgaacttggagggttcgcttttgcattttgagagtgtttttgtaagatgtgatatctaaaataagctcaatacttcattttataaacagcacatttttcattctcttgacattgccaaaggataatgctgtacattgaaacataaaacaaaaatagacccaactctgttggaagcataatatatgtagcactaatgctacttattgattaccacaaaggtgtttgcttttgctttttgtagctcttccactgtagagcaagaaaccagaaatacactatttgtgaaaggtggttgtactaaaatgttttcttgtggtgaatgcttattccacactctcataaaacaaattagtctttcatgatgaatgaagtattcgttctttgggctatatgcatttcaaaccttgaatatgcttagataaatttaatagcagaaatctgtgtaaaatacatagcttaacatatactttatacatgggtttgtatatgaattttaattaaaatatgtttcaaatagtctattagtttcaattactgtttacatagtgttgaaagatatggcagtgaccaacctaatttgacaatttactaaaatattttttattcatatagttctgatttaaaagatacagacgtattttcaaatcaattcatacacttgaaagacatgtttttgagcactctgtatttagcaccagactaggaatcaaagtttatttgaacggaatagtaaatggtaaaatcagagcgtgctctcaagcacacaaaattagggaggacataaaagtaaaccagtggttgataaccataggtacagatgattatatggatgagtcctagataggtatttacactacttgctaatactgatcattgcaaagatactgcaagtccatcttcattactggttttgaatctgttaacaatttccctgacagtgaggctgaagtagacagttttgaaatgaaacagttctgtggatctgtggatttgatttacaaatgaaatatttctatgatgtatctgctctacaaagattttagatgagagggtcttcatttcagactggcagttggccaaccaaaattgaactcagaaaattctgggttttggctggacacggtggctcatgcctgtaatcccagaattttgggaggccaaggtgagaggattgcttgaggccaggggtttgagatcagcctgggcaacaaagcaagactctgtctctacaaaaataaaaacaaattaaccaggcctaggggcatgcacctgtagtcccagctactcgaaaggccgaggcaggaggattgcttgaacccaggagatggaggcttcagtgagctaggattgcaccactgcactccagcctgggcaatacagtgacaccttgtctcaaaaaataaataaataaaaataaataaaataaagtaaaatcctagggttcactcacaaaaacaaataaatgctgaattcccaggaaataaaattacaataaaaattctttttaatggtaatttcatgcttatatgtatttttatatttcctataataagtttagatatagcaaagttaaaaatctatgttttggttaaagccccaatattttaacaaaaaacagctgattttaatctatttctttcagtgatttatgtattacttgggaattctattgtttatatattgattacaggctataattacattaaataaactgagaaagcatgtcacaaaccagttttagcaataactatatttttacatatctgtcttttgaaaaagtggactggatatttatattttacttggtaatatctcaatttcctcaataagtaagtcagtaaattgaatttatagtttattttgtctgccctcccatcaaattatatgaataagaaatactgtggtctcataacataattctatttccaagagaaagaacatgcaagtctgtagaataatagtcaatagtgatttttgtcaaaatatatttattgagcatctatagtacacaaggcactgtaggggtgatagcaatatattttgtttgatgtctttgcttttaagagaagtacactaaaaaaaaaaaaagaggagtccactttaggtaggaattcacattcaggcaacaaatacaggacatgttttccattctatatgtcaaaggtagctttggtggattcccatatgccaatttagggcctctgattcagacattttcaaagtgaccttgttaaaaatgagttacaagcctcaaaaatgtagagtgtgagtggtgatggaatggtatgcccaatgaggtcagatcatatagggcctacattctttatgcaatgccgctactgaagagtttcaaagcagggaacagttttctagacagaagtgataagactgtgaatttagtaatatatttgactagaaaggagagtaaagatctgagaaatgttaaggaagtacagttgtcaagacttggtcactcgctgaatgtgaccggtgacaaatgcttccaggtttctggcttgggtgatgagatggatgaagttgccgcttcttaaagggggcaccaggaggagaagcacacatgcagaaaaaggtcattccctgtgggatgtgttaagttttatgtaatttgggggacttgacaatgaaatgtccactaggcagtctggtcctctggaacttcagggaaaaaaatatttgctgggatgaaagatttcagattcattatataaatgagactcattagcatgtgtgttgtcatcgaaatcatggaagtgaatgaaattgcacagggtcctcagtaaatgttactgggtctaatgaataaataaataaccagggaagattaaaagagagaactcagaggtcaaggaggagctccaaaataatagggaaagtgccaggcaggataaacagaacccactctgtaagtttcctcaggattgtcttcggtcatcggaacatatgttctgtagcagaataccataaaaacaagcatactataaataaagttttaagaaaacttcaataattaataacttggagataaaattgatacgataacattacttggagatagctaaattagctatttcagaactgacacattctagcagactgaatctacatcattatggagctagctcatgaatccacattattaatgaaatgtgaacatcaccccttcaatttgctctctgagaaaagaaaaaacacagcatgaagcttgagaggcattattaaataggagttatgagcacaaactttagcgtagtgtttctcaatctcattttctttctttctttcttttttctttttttggaaacagggtcttgctctgttgcctaggctggagctcagtgatggaatcatagctccttgcagccttgaccttcggggctcacgtgatcttcttgcctcagcctccaagtagctagaactacatgtgggtgccaccatgcccagataatttttttaaaattttcataaagataggggtaatactgtgttgctcagcctggtcttgaactcctgggttcaagccatcctcccaccttggtttctcaaagtgcaatttcatccactcccatgattttgatgacaacacatatgctaatgatctcatttatataatgaatctgagattacaggtgtaaccactgccctcagccttcattttcattgcactcctaaggagatattttagacatatttttcttaaccaatctctccttccccatgagattttaattctatttgtgtactatgtgactgtttatgtatctgtcccttgggagggccacaaaccttggtaatatctaagattttgtttttatcccctaaaaatcaatttctgctctcattaagaatacacactcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaaaaaaaaaaaaaaagaatacacactctggagagtcacactgccccaactgaggtcctagctctactgctttttagctgtgtgaccttgtacaagctacttaatctctctgttctccagttttctcttctgtaaaatggggataataatagtactgtcctcataggagtgctgtgaagattgaataaattcacacatgtaaaatacctagcaagcctaacacataaacagcaattactccttttctacttatatatatataagtataatacttacacttatatatatatatatatgatcttcctctctttcttttctttattttaattttatcttgttacatttatttttgtgaatgttcactttgtgtttaataattttgctgcttataatttagaaaaccttttttagagacaaggtcttgctatgttgcccaggctgacctctaactcctaggcttaagcaatcctcctgcttcagcctcctgagtagctaggactacaggtgcgtgccacgacgtctgacatagaaaacattttattattagttttatccatgatcgtttttcctctccatgatgtgtaagaatgaattgacttcatataagttttattcaactgtgtttaataaagccatatttttaaaggaaaaaaagtaattctttccccaaaaactagataccaaaacaaaaaacaaataataaaactaggtactagttttcagaggcatgcattttatttccatgtctcatattttctgttttagcctaatgcccagacgttg

SEQ ID NO: 1150 - DNA, 55938 bp, Homo sapiens
cctgtagtcccagctacctgggaggctgagacaggacaatcgcttgagcccagggggcggaggttgcagtgagctgagatggcgccactgcactccagcctaggcaacagagtgagactccacctcggaaaaaaaaaaaaagtcactctgaaaacagacttggccaagcactgggccagaggctgaggtccagcaacaaggaagggacaaggaagggataccttgaaccctcagagactggtgatacacaggacggacacatggaacttgggccaacagtgttggaccgtctcggctgatggccaacaggagaacaggcaggctgatctttgcagctgagaggactgggagagcccacagggactgtggggtctggagagcttccttgcaggaggtgggcatggaaggtccagataaaagcaggtagagaaggacgtggacttgactcatagtcccaccattccatagctgggtcatcttaggaaattcatgatcctcttgaaacctccgtttcttcctgtcaaagatggggatgaggaatggaacctattccatagaggtgttgtgagagtacacggcgtggcatatggcaagtgttcaataacatattcacactgtggtgtgctcactgtttaccaggcaccgagtcctagtgtatgcatccctcatgacaagatctaagtggactgtcatcctcacttaactgtgagggagactgaggtcaagagaaatgaaatgactggccaagagcatacagccgctaaggagcagggctggaattcaaatccaagttcgctggggccagagtccttgcagttgccacctgttgcctctgcctggggcacagagtgagcagaagctcacaggtgggagtactgagagctgcgggaagttggtgaagctaggggtgcagagatgtggggagggaaagccattcctgtcttcatccatttgggccagcttgtggaagtgtttggactttggtgagtgggcgggctgcttggagcagaggaccaccagcgtggagactgcagcccactatgaggccgggttaccaccactgtcagcagcagcagccgccgtcggtcctgggctgagctcctactatccaggcctgctgatgggggcagtcctcgctcctgggggaagtgctcaggcacaggcagcttcccggcctggaagaattttgaatgacacaatccaaggatttctctcctctgaggcccgggggattctggaagcattttccctccgcctcttctgagcacttcctgcacggtgcccatgtcagagcactcaaggacagaaatgtctccagggcatcccaattgcctgtctcggcagagggccctgcacacagggagtttttaatcaatatcccttaactcattggaaagttttaaaaaattattattaaacaagtaaattatgcttattaggaaatacaggttaacacagaagaattttaaaagtccagttaaaatccgatcctaacttgtcttttagatgtttcaatgcatatattcacacatatctattacagaatttttgtataaagtatgaggtagtagtccaaattcatttcttttgcacgtggatatctagttttcccagcaccatgtgttaaagagatcatttttcccctttgaattatcttggcatccttgttaaaaaacaacctactctttaaatttagccttatattctttctacacaaagcatttggcagcccaactgtttttcattgagatataattcacataccataaaactcacccttttaaggtgtgtaattcactggtttttagtccattcacaaggttgtgtaaccatcaccatgatctaattccggaatattttcatcatgcaaaaacaaaacaaaacaaaacaaaacaaaaaccaaacctcatgcccactagcagtcactcctcattcctccctcctctcagttcctggcaaccaacaaatctactttctgtcttcatgggtttgcctattccggacattgcatgtaaacggacttacacaatagatgtcattttgtgactggcttctttcacttagcataatgttttcaaggttcatttatgttgtagcatttatcagtactttgtttttttcacagctgaataatattccattgcacagatagatcacattttctttatccattcatcagctgagggacatttagtttgcttccactttttcctcttatgaataatgttgctatgaacatttgtgtacaagcatttgtgtgcatatatgcttcaattctgttgagtatacctaggagtagaattgctggatcatatggtaacaccatgtttaactttatgaagaacccacaaactattttccacagtggcttcaccactttacgctctaaccaccaatgtatgaggcttccagtttctccacattatttccagcacttgttttctgtcctttggactaagggcacctttgtgagtgtaaagtggtatcttatggtggctttgattcacatttccctaacaattaatgatgttgagcgtcttttcatgtgcttgttggctacttacatacgttctctgaacattttcaaatcctttgctcatttaaaaagttgtttgttattgagtttcaggagtcctttatatattctggatatgagtcgtgactattttctcccattccgttggttgtctttttactttcttgatcatgtctttcaaagcacaaaagcttggaattttgataaagtccaacttatctatttttttctttggttgtttgtgctttaggtgtcaaatctgagaaatcattgcttcatccaaggtcacaaagattttcacctatgttttcttctaagatttttatattttaaatcttgcatttgggactttgatccattttgggttaatttttgtataaggcctgaaggaggaatccaaattcagttcttttgcatgtggacatctagttttcccagcaccatttgttaaaaagaccacttttttccccctgaatcatcttggcatcctcgttcaaaaaagagtctactttataaatttagccttatatattctaggcagctttctatctgataaacatacttatagcatctttaaaaaataaatatctattgaaatatgacaagcataaaggaaaatataaatatcatgtgtttaacttggtcagtttcacaatgtatttgcatcaatgcaaccactattcagagtaaaaataggagattactggcaccccagaagtccccttcactcctcccctagtcactacctccaactttctccccagtggtagcctctatcttggctcctacctgtaatgcagttttgcctgcttttgaactttatagaaaggataccattccgtatgcacgctcttgcactcagcctgtttcacccaacattatgtctgtgaggctgcagttctcgtgggggtacagtgattcatttattttcattggttattagaaccacagcattatttttagtatattcactcaacaaagatttattgcatgccaggtcctgttctaggccttgggagaaggcaagggacaaagcaaaaattccctgttcccttggagctcatgctgtcttgggtgagagaccaacaacaaagacaataaataagtagaatacataatgtgttgtgtgcagataagcgctatggagaaaaatacaaaataaagcaggagagaagggattggagggtgttgcagctgtacaccgaatagttagggaaggccttgccgagaaagtcatatggaagcaaagacccaaaggagaggaaggagggagccaggtagatttctaaagaaagagcattccaggcacagcaaaggcaaaggcctgagtgtaactgcaggtttggcatatttgaggaacagccaggaggccagtgtagctggagcagagtgagtaagatgagagtgtaagaggtgggcagagagggtgccagaggccaaacagcaattgtaaggaccttggcttttactttgggatgggagccatcaacagaagagtttcagcagaggagtgatagaatttgacttaaaacagcaacaacgacaacaacagcaaaaccaacagactcactctggctgctggattgaagaagggctgtagatggaggcgtggagaatggccaggaactcctgctatcacccaggtgagagatgatggagatgtggacccaggtggtaatggtgcatatggcaaaaatgggctgcagcttggaaatatttgaaggccaagctgaaaaatttgctcccagattggatagtggggctgagagaagatgggtcgggttaagtgttctaggttcagatgttctgtcagttttcttaattaattttctgttactgggcattagggaggtttctagcttctcactgctgtaggcaagatggtggtgaacatccttgtagatggttctgtgcgctgcccagaatgaattttctagggtagattcagtccttctaatgcagcattttccaaccttggctgactgtgcaccacctgcacaggtatttacttgaaagcggtatggggtagtggttagagcattcatctgtgccagaggcctggggcaaatccccatctctggtgccagaggaaagggggcatctcgaggctggggaggcccctggcaggagtgagaagtcctgaggagcccgggcttcaggtctcagagggggccactgttttttgagtaccttcctctctgtgggactcagtttccccatcttcaccatgccagtgagtgggtgggtgtaagtgagcgagtctgcctggaggatcctactgctgctctctgcacctcttaggggaatctcctgcctcctccttctcccttggtgggcgtgagatcaaagttcaaatgtgtacctcagtttctgcatctataagttagaggcaataatagtcaataccctagaggtggaagtaactgagttactgtctgtaaagactagcacatggtaaacactttctagatgccagttattttcgttatttttaaaaattgacttcacattttttaaaacaaccaaatatgagtttcaaaaggaacatttacattaacatgttaaatggaaaaccggtgtcatttgctccggagaacagaagaatgtaaaataaaatatatttaatggaaacaaaaacaatgctattaaagctaattagatagtttcagagccaagtaatctaggcagtgctagaaaggtactcaaaccctattagtactaaactgagaaataaactccattcaacataaacggaaaaactgaaaggaaaatgaaaaaaaagaaccttaaatgaccagtccactcttacctaacatgtaacctgtcacactctggaaaagttttcctagttttggctgtgtgtgcgtgtgtgtgtgtgtgtgtgttgggaagtgaggcgtgtgttgggaagcgatgtgtgtgttgggaagcgatgtgtgtgtgttgggaagtggggtgtgtgtatattgggaagcatgtttgtgtgtgttgggaagcggtgtgtgtgttgggaagtggtgtgtgtggggtgtggtgtgtgtgtgttgggaagtggtgtgtgtgtggggtgtgtgtatgtgcacgtgtgtgttgggaagcagtgtgtgtggggtgtgtgtgtgttgggaaagcagggagtgtagtgtgtgtttgtgttggaaagtggtgtgtgtgtggggtgtgtgtgtgtgtgcacgtgtgtgttgggaagcggtgtgtgtggggtgtatgtgttgggaaagcagggtgtgtgtgtgttgggaagtggtgtgtgtgtgagtgttgggaagcagggtgtgtgtgttggaagtagggggtgtatgtgtatcgggaagcatgtttgtggtggggggaagcagggcgtgtgtgtgtgtgtatgtgagtgttgggaagcaaggtatgtgtgttgggggaagcgagggctgtgtgtgtattgggaagcatgtttgtgtgtggggggaagcgagggctgtgtgtgtgtattgggaaacatgtttgcgtgtgggggggaagcagggcgtgtgtgtgtgttgcgaagcggtgtgtgtgtggtgtgtgtgtgtgcgcgtgtgtgctgggaagcggtgtgtgtggtgtgtggtgtgtgtgtgtgtgtatgtgtatgtgttgggaagcgggttgttccgaggactccccgattccctcctggttgaaacgtggcccagaaagagaggcacactggctagggcacacagccagggccgtccagccccgcaggaagccccggtcctgccctgtcccaggtaagcctggccagccctggagccggcgctgcggggctgcggggctgcggggctgcggggccacgggacaggagcgggtgctgcggtcccggcagagcaggggcggggtccgggcgggggcggagccgagcgcccgcgcacccggagccgcagcccgagccggagccggagccgggagtcgtggcccggagtgggccttggagtcggcgcgcaggcggctcgcggtgagtgctgtgcccagcgcctgggggtgggctggggggagactgtgggcgccgagggtcccacccccgggacttgaacacttggcttctgagccgtcctggccgcagggcttgggcaagggttgcctcggtttctcctgggggagtcccagaatgtagatgggaagtgagacggaaagggggcatctcgaggttggggaggcccctgggccactcttttgatttccttcctctctgtgggactcagtttccccagcttcaccatgccagtgagtgggtgggtataagtgagagagtctgcctggaggatcctgctgctgctctctgtacctcttatgggaatctcctgcctcctccttctcccttgttgggtgtgagatctaagttcaaatccatcccttcccagacagcccacaccaggacctgcgaggccacatcccccagctgtttgctctcctatgcttctcaggttgatggagcagccatctggtcctgctttcattccaacaaactgaaaagccctccaccccaatccccctggggaggacctcctgaagctgcatgagggctgggggctggacccctgcttctgagtttgctctttctgagcctctcctgccatggccttggtttccccatgggctgtgacctagcctcctccagggtccttgttctacagaggggaaacacctgccctgtcaccctcccctgaccccttagtgaaaaagaccagagtgacatccccaccacctgtacttgcctgtcccgatcactcagccatggggctgctggggcccctgagtttgttggctgctcaaggcccctttgcctcgctgcaccctgggatctgaggctggaagcatcctcatccagcccacctccctcctacccagtgcagagcccctctgtgacacatgcccagtggtggggagcttattactgatgaggtggctttttagtgccttgcagctcttgtttcctttagctaaaatctgtggcttacagattctacaccttggttccatgtctgtctcccggagccatgcagagcaagtcagttctttcattctttccagcagtcatcattcatgcactggatgagacacgagacagagcagtaggaaaatcagacaaaaccccctgccctcatggagtgcacactctagaaaggaatggacagcaatgaaataagtaaatacatggcgtagcaggtggcgggaagtactacgagtaaaacaaagctgggaagcaggatggggtgctggggctgggtattgcattgtatatagcacaaccagggaaggcttccccaagaccacgatagctgggcaaagtcataaggaattgaggggtgagccacatgagtatctggggggctgggaggctttggttttcactctgagcatgatgggagcacgggtttggaacagaggagtcacctgctttgacttggggtctggcaggcccatctagctgtggggtggagaatggatcatggggggggtggggtaagggcagaaggagagcccgttgagcggatcattgctgtcattctcgggagagaccatggtgtcttgcccatggcccagaggtggttaaaaaaaagaaaaccagacattcagatttgggatatatttcaaaggccgtgtcgatagggtttggggtgcaagagaaaggtagagtcaaagatgattctgagtgtttggctcgagcttctggaggtttgaagctgccatgaactgaaatgggagttgcttagcggagagatcaagagtttggttttgtgcttgtggagtttgagctgcccattaggcatcaatgatgagtaagcagttgggaaaagttaagggcggaggttggagttgaaaataaaactttgggcatcatcaccatataactggtatttaaagccacaagagcaggtgggctcatctagggatggagtgatatggagaagagaaggggtctaaccattgagtgctggggcccccagtgttaggaaccagccaagaagacagaaagagtgaaaatcagagagttggggtgtcctggaggaaatgaagaaaatgccccaaagaggaaggagggaacaaatatgaccaatgcccctggcagagcaagcaggctgagggctgaggattgagcaatgggaggtcactggtgacagtttcactggagctggatggggaactagagggaatgggaggggatgggaggacttggggacagcagtacaggcaacagacaagggggcctgctgtaaagggagcagataaatgggattggagccaaatgaagaaggggagtgtcaagagagtgctttacttttacaatggagaattagagtgcattgtgcactggtggggggatttgatctcttagggagagaacagtgttagggagggagaatgcaggatagctgggggagggtggggggcttggccccagcagagactcaggacacttgggaagttgagcttccctgggcttcccctcctctcctgtctgcaaggggtcagtgggctgagatttcagcacttaagcaaagcatttgctcttggccccagagaaaccgggctggctgtggtctcaggaaggaaggaggtgtccaggctcaggcctgggcctgggtttcagggagggcccacgtgggtcgccccttgaccctctctttcagcaaggaagtgatcctttctctacatgggcctcaccttggggaggacaatggtgtctttgaagttgtagtaactgaagtagagatcaaaaggcaatgcagatagactgacagatttcgcctgaagaggggaagcccgaccaggtaataaaggagtaagaggaaggatgttaaggacaattttaggaaacagataatgagtgaatattttttctctctctttcccaatttaaactgaagcaggagaaactgaagctagacataatgattaacttcccaagctggtgagcttcctgagctggttagtgagaacagcactaaggccaggttctcctccccagatgtttaagatgagacaggacaatgcctgctcagagacagggcctggctgaattggccctcaggattctctctgctctgaggtttctggaagaaggccagggcagaggtgtggtgatgtagctgctgggaggacagagctccgagtcacgtggcttgggcgggcctccccttcctggtgtccacagaagcccaacgtcactagctggggtgtgtatggctcacacgtaggccaggctgccctaggcttggtgtgcaagggaggggcccctacttacttgtggcctgtcccctcgtgaatgtgtctcatgtccccagtggggtttttcagtgagggtcatggtctccaggatgcacaaggctttgtgccagaattgcttggaattgcctagttctggaaggctggttggccaactctggcctccggcttttcctttgggaatttcccttgaaggtggggttggtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggtaagaggagcaggcattgtcccgtcccagcttgatcctcagccttctttcatccttggccgcgacatgctcccaggcctggggtcagatggggagtgctgactctgtttctgggctgttttctggggagaatgggtcggcgggtttttttccccaggacctgggcagggtcaatggtgggggccgctgtcgcatccttggctggtgtttccacagctgagaaccactccagggccaagcccagagcttattctacccttttttgtcctctcttcccctgtcctcggccaccccaccctcttggctcctctgcttagatgtgggcacaaggaggagaactccttggcctgagagaactaccttagatcctggcttccagtggcctctgcaggggggtacaccctctctcccaagcagccagacacacaagtaacctcattgcctcagtttccccatctgaccagcacagggccccctgtgccccagcagcgttctgagagattggagctttctccttttgcttaccttggctaccgtatgaggacggatacagagtgttccccccacccccagcccaggggatatttgattcatgaacattccctcagtgtctttgtgggggacaatgctgtgccaggctcagggatgccaggacgagtaagacccaggctcccacgtggcccaggcagggagagagacacataaacaaccatcaggaaagaggtaaaatccccaggccacttggcatctgctcccttgagtgtctgggaatgtccctgatttataaaaagaagctgacggccctctttgttgtccatgcctacaccctttcactttcgtttcttcggggcactgcagcagcccttgtccacagaccccatgacaatcgcagaactgaccatgctgagagattttcttggctgctcagggaccctgccagggcttgaagctcctggagggtcacttgccctcaaattcccagaacgcacagcaggtcactgatgatagcagtggcagcagtctgtgcacggtggtttcgagggcgtgggagggaggtgagggccctagggcaagtgtgtgtgggaagtgttgatgggggacaaggcaccagaacgctcggaaacaacttagtttgcaccgtaatttttcacttcgcctaggacaggacctttagagcaatattctgagtctaccccttggagtagcagtgtgcaaaacacacagcacgggcttggggcccccgtggggaacccaaatgtaagagttagagacatgcattccggagtcatacatggctcgtgttgaaatcctgactctgcctgtctagctgtgacacatcgtacaaatcacttagcttcttggtgcctcagtgtcttcctctgtagaatgggtagatcataggcactacttcagagtggctgggagggttcagtgaattcctgcaggagagcacttagaatggcacttggtgtgtagtttatgcttaattaatattagccgttactgaaactgctgtagcctgaatccagccagcatgaaagagcccctctcaccctgcttcgaagagaatgaattccctgattgtttggaagatctctctctctctctctgtcttttttttttttttttgagaaacggtcttgctctcttgcccaggctggagcgcaatggtgccatcttggctcactgcaacctctgcctcccgggttcaagtgattctcctgtctcagcctcctgagtagctgggattacaggcgctcgccaccacgcctggctaatttttgtatttttagtagagacagcgtttcaccgtgttggccgggctggtctagcgctcctgatctcaagtgaccttgggagatctcttgctcctaatattacctcaagcctttttaaacgttttaagccggagaccaagcatggatatgggagttaggggtcttgatttaattcttggttgcttcaaactctgtggaaccttgaggtgtttcttgccttctctgggtctcaattttcacatctatatggtggggagcttggattgggtaatgtctgaggctagaaccatggccaactcgggttctgctggggctgacttgccctggccttccctgaccaccctgcatctggcttctggagaagtcccgcactgaccttgttctcctccccaggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggtgaggcactcctggtgtgcatcacagagttctcaggaaaggggtgcttagtcaccaagactgatttgtcctcatgaagtcagcctgtggggtaacttggtccatgggatttcccctaaaaaggtagccaggcaggtaaaatttgctcttgactcttggcaggaaacgtacaactctttctttcttcttttcttttctttttctcactctgttaccctggctagaatgcagtggcacaatcatagctcactgtagccttgaattcctgcgctcaagtgatcttctggccttagagtagctgggactacggctgctgtaccaccatgaacagctaattttttttttttcttttagagatggggtgttgctatgttgcccaggctggtctccagctcctggctttaagcaatcctcccgccttggcctcccaaactgttgggattgcaggcatgagccactttgcctggccaacagaacacttctgccgagaggaagtgtgtggtggccaggaactcagattctggagccagaatggtgcaggctcaaggtcaaccctgtgtgatctcaggcttccctatggagcctctccagcctcagtctcccttgtttcagtttcctcatctacaaaacaatgttaatagtcaaatggtgcctatcctataaggctcttgggaggattcagtgagttaatttgagtaatgcttaggatagtgtctattaccactggctgctatttattatttctgttatgagtgatactctgtacttgtacacttttatttctgtctgttttaaattaacagcacaacagaccataacactgcagtatattgaatttattttataattaacatagcatattataaactaatatagcttaaatgtttatgtaggatttctgacatgaaattgcattagatcatagatgttcagagttggtatataacagcccctgagaatgtagtaactcagcagagaccagaaggtcagagaaatgaccactgagtatttttgaaactcttttgttttcttccaaatagtgattcttagggctcctgagaggcagatggaacaatcattaacattccactttataaatcgggaagttgagaccaaggaaagtagtttgaataagctcacagtagttaatgagggggccagtgctggaccaattggccagcactggtcattgacttattcatccatcattcatttattcagccagaatctattaggtgcttcatacatatttgcttaaagtttgttgtgttcatagagctttgcacacggtaggtactccataaacatttgttgatgaaataagtgagttactgaatgaatgattgaattagaatgacactgcagtgttaaaatgggctgggttggggaacattttagtttttgtttttgtctgttttccaaaaatgtatgtgttgttcacatgagtctggataaccctagattgagattgatgacataaataaatttgtcttcaaggctgcactaaagctggctcacatggctaggtatttacagagcagaagtggtgcagtcctctctgattagttgcacgtacagaagacatattcgttattggactgaccttagtttctcttataatttgttaggggaattgaatcagcccatctgagaagttacaagattgtgtcttgtcatctttaaaagttcagcaatgtgatgtggtacagatggtctgaggggtttggagaaggtagcctagatccctagggcccagagaagacaggatgtgaacagaggaagtacatggattggtgaagaaaagaaatgggataactcatgggtcaaagaagaaatcatgatggaaatcagaaaatattcagaaccatacaataatgagaatattatttatcaaaatctattggatgcagctaaagcaggacatagggggaaatttacaaccttaggtgcctagattaggaaagaaggaaggcatttgtttatttatttgtttatttatttatttgagatgggggtctcactgtgtcacccaggctgctggagtgcagtagcacgatcataaatcactgaagtctcgaacttctgggctgaagtgatcctcccgcctcagccttccaagtaggtgggacacaggctagcaccaccataccaggctaattttttttttgtagacacagggtcttgctatgttgaggtctcaaactcctgggctcaagtaatcctcctccctcggcttcccaaagtgctgggattacaggcatgagccactgcgcccatctaaggctgaattttaatgagctaagaattcatcttaagaaagggctaaatagacagcaaaagcaaacattgaaggttgggactgagctgagtgggtagcagggatgggagacaacagatctgaggagagcaggagattttgaaaggattgcactgcctgaggtttaagcctttagaatccagctctctctgagctccctttgagctctgacattctgtgactctgatttggtggccttcccttagtggccttactgatttcatttggatggtgcttgtggtatatccaaccaacatgtcttcccaaatggccttttaatttcctataaagaagtagttgtcattgattgcaggttagggacagaaaatgctgtggaatgaaacaaaatgcaagttaaagaactaaattccaaaaatacccattgctactattgactgagtgaattcctactgtgtgccagacactgtacccagtccattccctgtattgttttatttaagcctcacaagggtatagtgtgactacactgtttcttaacaatgaagaaactgcccaaatcgcccatctgggaagcggcccagctagaatttgaatccaggcctgttttcctccagagcttgtgctattctctgtctgtcataaaatgtgggggctttgtgtggtaaacttgctcagttgggcatagcagttgttaggaaacctgaggctggtaacaccagctgtaataccagctgtccgtctgactcatgcaactgttaaagttgatagggctgaggtgtcagactgagctctgaattgcctgattcctataacaatattaacttaaacattttttaaattgggaaatgcaccatgcatacagaagagtgtgtatatttcatatgtatagtgtaaactgttcccatcacccaggttaaaaaacaggatgttgccagtacctggggccttctttaactgcaactgctagaggtaaacactggcttgacttttgtgtaaatcatctctttgcctttctttaatgttttagcatcttttaaaataaatccccaaataatgtattgttctattttgaaaaactgagtagcaagccaaaaatagctgtgtaaagaaaggtcacttaaattaggctgggtgcagtggctcaagcctttaatcccagtactttgggaggctgaggcaggtggatcacaaggtcaggagatcgagaccatcctggccaacatggagaaaccccgtctctactaaaaatacaaaaaattagccaagaatagtggcatgtgcctgtagtcccagctactcgggaggctgaggcaggagaatcgcttgaacccgggaggcagatgttgcagtgagccgagatcgcactgcttgaacccgggaggcagaggttgcagtgagccaagatcgcaccactgcactctagcctgggtcacagagcaagactctgtctcaaaaaaaaaaaaaaaaaaaagaaaggttactattgccttttcttagatgaaggttcccaaggcagggaaagctaagtggagtctcagggacttggtctggcttttccttccctgggaatttataaggacctcttctgggaagtcagtcggcaatgccatgaatgagtctggggaaatattgggctcattgcaactggagggtctggtaggactgatgtgaattaggtgctgtgtccggaggaaaatggccagaggaagtgggctgctttgtacagtcagtggtaaagttgccaaaggctattatagctcacaggaatgggccaaggctaaacactcctgtggagtgaaatgaatgtcctcagctgactgaggcagcgggagttgaaaagaaacgatattagttcatggtgaagacaagtcaaatatagataaaggttagggtcaggcttgcctggacatctaggagataactgccctcaacttgtttgaatcttgagtcactgctccattttgtttgaactggtggccatctacttatagtatacagccatcaacctgagatttccctacatggtcttcctgccttggtctcctgtatcctgaatcctatggcctcttcttccctggtttactacattttgctagaccgtatcctccagtcaattccttagaatgaatgtatgaaagttaaaatttctgaggtctcacatgtcttaaagttccctcatactggattgatagtttggctgggtataaaattctgggctggccatcattttccttcagaattttgattgcattattccattatcctctcttttcaatattgcttctaagaattccaaaacctttttttttttttctttttgagacagtgtctcactctgtcacccaggctggaatgcagtagtgtgatctcagctcactgcaacctccacctcctgggtttaagtgattcttcttcctcagcctcctgagcagctgggattacaggcacccaccaccacaccctttagtagagatggggttttgctatgttggccaggctggtcttgaacttctgactttaggtgatctgcctacttcggcctcccaaagtgctgggattaaaggcgtgagccaccacacccagcctccaaaaccattttaaaactctttctggaagcttttaaaattttcttttagtccccagaattttaaaatttcaattatgtgccttggtgttcttccattatgttagtcacccaagaggtactttcaatctggaaacttctctatgttttgggaaatgttcttgattagtttacaggtgatttcttcctctccattttatctcttctcttttcatgaaactactattaattcaatgttagaattccttgactgatcatttaattttcttctattttccatctctgtgtctttttgctctacttttctatgatagtcacagctctatctttaaactcttgagtttttcatttttgatgtcatgattttaatttgcaaggggtaggtttgactgattcttttttgtagtatcttactcttgttttatggatgcaacatcttctttgacttaaggatcataagataggtgggttctttgtttgtttgtttgactgtttttcaccctatgtaaactttttctacaagtttctttccccttcccccctttttggcttctatctcccacattagatgctttctctgggctcatgatactctttggttttctttctcaagattgacaggtaggactttaaaacttgttgagcatgcgggtgaaacttgtctaccatgaatttcactgtagatattttggagattgacagtgtttatatctttagatctcgcctcctgggttgatcaagttatctgagtacaccacagaccttttgcctggggataaaccagaaatctgtttcagaaaccactttgattcagtcttccttgttttagtcatttccttcagttccggaggtccctcatgctgatcattccagagccctttacagatcctagggtacacactgcatggttttcaactttcttgttttggggttaagatttggctttcaggagtctcctcagtccgttactattcattcaatcagcaagtccttgagcacctgatttgtgccagacattcttctaggtgttagggatacctcagtgaacaaaacagacaaaaatctttgtcttggaaatacacacactccagtcaggggagagggacaataagccaaaggaaggaaattacagcgtgtgctagaaggtgataagtgctgtagaaagtaagtaaagtgggtttgggagttgagagtttgggaaggggataaatgatggcaattgtaaatagagtagtcagagttctcacttagaaggtgaaattcaagtaaagacttgaaggaggacagggaattagccacatggatggctaggggaaggcttccaagctgagaggacagccagagccaaggcccagaggcaggagcatacctggtagttttaggaaacaggaggccaggatgctgagtggagtaagagggggcatgaaaggagaaacttgggtccacgtggttctagacaggtatttttgtctgttttgggccctgaaggttactattggacttggactcttactctgaggaaatagggacgctattgggacgtttgtacaggagcaatgtgacctgagttttgtttgtaaaggattagactctggctgtggcattaaggctaggctgtgggggcaggaacagaagcagggggaccagttttgcagcctgtgcagctttccagataagcagggattgtggcttggaggaggatggtatagaggaggtgacaagaaatgactctatgtctggtatgtagatattggccacagatggcatttgagcactagagacctggctggtccacatggagtttccataagcacataatacacatcagatttcaaagacttaatatgaaagaaagaatgaaacgtaccttgctatttctttcttttttttttttttttgagacccagtcttgctctgtcacccaggctggagtgcagtggtgtgatctcggctcactgcaacctccgcctcccaggttcaagtgattctcctgcctcagcctcctgagtacctgggactacaggcacctgccaccacgcctggctaattttttgtatttttagtagtgatggggtttcaccatgttgtccaggctggtctggaactccggaccttaggggatctacccgccttggcctcccaaattgctgggattacaggcatgagccaccatgctcagccatatcttgctattttctacatggattacatgttgaaatggtaatgttttggctattgtggattaaatagaatatatgattaaagttgatttcatctatttcttttaactttaaaaaatatgtctgttagaggatttgaaattccacatgcggcttgcatttgtgacctgcatttcatttctgtggaacagtgccctttttgggacatgctttgaaggtggagtcaacaggatttggcagattacagacgagaggcttcaagggtgactccaagacttcggggcagagcacctggaagaaaggggttaatattagccaagatgaggaaggctgtcggtttggcaggtgcatgggcaggttaggagtttagttttgaatatgttggaggtgtttatgaaacttttaagtggagatggaaaataggcagttggatgtgcaagtccagggttcagggagacagttcaggctggagatgaagatgtgggagtctgaggagagattgtattcaaatattcaatccatgagacttgatgaaatcacttctcttccaaatgatttacagcctgcagaatcattttccctatctttgtaggtttatgtcttcattttgtttcatttatttttcagttattcactgttttagtgagttttgagtaggagccagattggatgcatgcgttcaattcaccatccaacactgtattaactacttgaaactcatgtggttgttcggttgtttttttgaccttttattctggatggaagagagatgcttatgaagttgcagtaatcagtaagccttcccacattgctccatcagccttcctggaagaataatgtcttctgcctttcctgtaggcaagaaggctgcttgatcttgccacggtgaaagcgaatggattggctgccttccttctacaacatgttcaggaattaccagtcccattggccctgcctttggaaggtaggtgtatgttctcagttaatcagaaagggaagggcagtcagtgcagatccatggttaagagcagaacacacctcggttaacatcccatatgctggcagtatagcctccctatgactcaatttccttgttttaaggctagcaccaccccgtctcattgggattttgggagcattaaaaggacaaaagcgtgtaatgttagctattagctttcattatctcccacacagtatactgacaattgggctaccatatattgagggctaactaaaggtgttacttaccatccaaactctcattatctgtaccgaaaagatatggacacatgttttgagttagggctggtatctcttgatctctgaaatttagcagctcacaatgggaaactcaagaaccaagtggatctagagactctggtatccctcagtgcccagggtcaccacccaaactcaggaacaggaggggcttggaccgcaccacttgaacataccaggcatcctgccaggtgctttatggacaatgtctaccctttgcaacaaccctgagaagtaggtggtgtttttttccaccttatagatgtggaaactgggcagggaggttaagtgacgagggaggggaagatgggtctgattgtaaattgtccccacctacactttctcttttcttgggagaagaaatgtcagttgtaaagagagagtgcaagcctggcactctttagggcttgttcctacaccactgtagggaaagctcattggcactgaagccccctgagctgtgtgtggtgctggcagatgggtctatcaccctgggctgtgtcctctgggcagcaagcaagcctgtgggcggggtggctggaagtctgtgcctggcactcgcgagtgcaccgtctcattgaagaacaggatctaaacatcagtgcgccacagcagggtgcgcggcacggagtgcaggccctggtttggcccttggttgaggtttgctgttgacatcatcaagcacagctagtcactgtaagaccaggccagggtgcaagattccccacacttctaaaggtgacaattggtgtgtttatttctctataaaatgacattttttttttctggagaattttagtatcattggtgatgactggaaaacctgcatcagaaatcaggtcggaagaggaagatatatatctgatatgtactggagaggaagatatctatcttatggtctaagttcagggatcctggtatattcagagggcagaaagctcagcaataatcatcaactctgggaacagaggtgacataaacacagggcgtcccctttgtgtgactgcagatagtcatcagtgagctcagagctctatgaaaattacttgctagtttttgggttgaaaatagtgggccagtgtttggttgggggcagtgaggctgtgatggcgggggaccatgccaagctcctaccagcctgggacgctaaaccagcacttccccatttcctgaaaggggaactaaactctgacacaggaaatggtttgcttgcattactttcaggatgagaaaggaagagcactggccttccaaacacaccccgtgcatgaaaactctccctgcatggggtgcatggggaggatggggaagtggaggcaggatcacagactcttgttcgagtgctcagctggggcaccccggtgaccccgaggccttcccttgctaggtccacccagatcaatcaggatcatctccccatctcgaagtttaactttatcacatctcagagttccttttgccacgtaaggtaacatattcacaggttctgagaatccggacatggacatctttgagggtctattgttgtgcctactatatccatgaataataatgataataagcaccattttttgagagtttgccatgtcagatattcttttaaactgtattttatctcgctgcctcctgaaaaaatccttccaggtgtatattgtccccatttttacagatgagagaactgaggcccagaaaggctaaatggcttgcccaagtgtatggtggacccaggttttcaaactcaggtgtgtctggcttcagagactgggctcctgagcccttaagccctttgttcccctttagaaaaagtcacctgaggctgagtggtgaagggatttatccaaagccacccggccactatggcaggacagatatcagaatacaggtcttccgatcccagcccagagccccttcccgtcatctagaactcctcctggtgtcagtaatgataacggcagtcactgatgtcttttgagcacttactttgtgttgagcacttacactgtgctaagcacttgacataggtcatcttagttgatccgtgtaaaactctgtgaggtagtgaccaacatttctcccaccttacagaggtggaaactgagggttaggaagtttccttgactgtcctcaaagtgcacagcttgtgaatggaggagccaggatgggcgcccgctggctctcctatcccttcagttatgtcagcgtcccccgcagcagcccattgtctggttaggtcccgtcttcaccatggtgccaccttcatctgcctcttcttctgccttccagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtagtgagtgttactgggcattgctgttcaggtatgggggagcaccatcaaggctaagtgtgggagcaccgagctgggctctagaagtctgggcccagcttcgcctctgccaccctgctttgcaacactgcccagatcccttcccttctgggccttaatttcaatatgtgatgatgacagccacactttattgactggcctatgtgctgggtctggtgctatgctttccggaatgacctcatctaatctctacaaccaccctggcgggtaggcaggaatgttattatctccattatccttgacttgaggctcagagaagtgaagtaacttgtccaggaaatggcagagctggggttcacaaattgcatcattctgattacaggttttctgcctcccaccagtctatggatacacttcagaggctccctgaaaaccttgaggtcacttgcagaaagttttgtgtagtatgtgtccgtatcaggaacaacaccaaatcagaggtgacttgtgccccatcagagactttaacaccccaaccagatgggaatttcaggacccaagaaatagaaagtggctgcagggttacaactactgttggattcctgaggtagcacagtgtccaaacaggatttcagcactacccgtattgcttagagccccagccaaagatgtgaggttttgccctttggagaatctgtgcccctgaactcgggggcctctttccacatcttgggggcaggcaagggcagagggtgtgcctaggcctgcggatcagcatgcgacagattccccaacatccttccagcttgaaaggggattgccctgcttctatttagaacctataggaaagcagaagttctagattgaagttaaaattgattcccagcctccaggggctttgggctacacctggatgaccttaattgaccctaagcatgggacaaaccacttcctgagagtattaggatggtatacatcttctctgggggcaaagcaacaagatttatttttcatcatggaccaaacacatggatacccactagaaactgtgtagtgaattttgttaaccctgacatagggaccatggtctttaggttaaagcataataacaacataatacataacatatatagcgaatatatatatgtattatatgcaatgaatgtaaatatgattatacccatcatggtcttggaggaaacagatgacacacttaaaatgggtgttttgaggagagtttgaaaaacagattgtttacaagccatgggcaggagttaggaagagtgagagggttggtgcaggggcctggggttagtaacagctgggggagggtagacttgaagggggaaggggagggagactaattagctggggggaaggtatggagacggctgcctgagcttctgcaaagtggaagaataccgcttggccctaactcctcaccccaactcttgctcctggccagcgccttccaccagctggacccatcagggaggccgagtgggctgtctgctggagtagtccccaggcatcagcctcccaggagccagggacgggtagagaagggggagagtggatctggccaggcaaatggaaaacagccagcaccaaactctatttccctaggagggaggatcatgatactttgagtgggaatttggaaacctgtctgttggagcaatttccctgatagaaataagaatgtgcattttcctgggtagtagactcagtttttaccccaagaggccaggcatcactggcctgtgtgatcctcataggccagtccatctctggaattcttgaatggatcatccatccttgattagggatgtccccgtgattaccagggtgtgcagaagggctctgggaaacctgtgggtctgtctctgtgttcagagaaaggtgagggtggcctggttctagctcatggtgctcagactgtggtgtgtaaaggcactcgtggcaatgcagattcctgggcctgcctctagtgattcccattcagtaggtttggggtggggcccaggaaatctatatttttcacagacacccctggtgattctgatacaagtggtctcgccctgggagaactactggtctgcagcaaccagcttggttttccattagcaattactgtccttgagcgagttttactgctcttcaccttacacacactaaaactgccaaggccgtaggggaggggaagcaaccatgaggttgctgtgagtgcactgtgtgtgtgtgtgtgtgtgtgtgtgtgtgtgtgtgtgtgtatgagagagagagagagattgagaaagagaggaagggaggaagggggagggcacaggctcctctcccacagtgccaacctgcctctctcccacttgaagtgtttccatgccaactgaaatcctcagcctctaggaaaccctatatacacagtgcccctatataggtttctttagactctggctctctcagactctagagtgatggctttaaaagttttttgaatgttacccacaatgattgagaaagagagagagagagcacgcaccaccatgtaaacatggaacctaagtttcacaaaatgacttcgctttatgaactctgagacactctgctctcttctgttctgttctatttccattttagaaatgctgctcaggaccttcaaaatgatttgcatgacctgcaacctgcagtctgaaaaatcactgcactacagaagtggccataagaggccctgagggagaagctgcacaatgtcatggttaagagtggggtttggagccaagccgcctaggctcaaagcctttatgtgccgtacaaccttggcaaagtcacttcgcttgtctgtgcctcagtttctttctcacgaatgctcataataatggttcccatttcactggcttgttgtgaggatgaaatagtgttattattgagaagtggtaagggtagtgatcagtgctagcgatcatgattctaggtgacttttactgtgtaccgggtgctcacaaggctttatgtgcacagcctggtgaggctgataatactattgttccctctttttttttttttgagacggagtctcgttctgttgcccaggcagggggtacagtggcacaatctcggctcatgcaagctctgcctcccgggttcacgccattctcctgcctcagcctcccaagtagctgggactacaggcgcctgccaccacgcccggctaatttttttgtatttttggtagcgacagggtttcactgtgttaaccaggatggtctcgatctcctgacctcgtgatccgcccgcctcggcctcccaaagtgctgggattacaggcgtgagccaccgtgcccggcctgttccctcttttatagatgaagagaccagcaaataactagtaagtcgctgatcaggatcacaatatccagctgaggcactccagagcctgagctgttaaccattcagtcagggcctcccaagtttgcctaaagataaagaatcatgtgcacagttgttaaaatatacagattcctgggccccaccccgcagatacttgattgccagctccagggtatgggcctgagaatctgtcttttagggaagctttcagatgatgttgtgatcaggtgagttttgggaatggtgccccaagaggagtggcagacagggcttgctcggcagggactagcctgttggagtggtgccattggggttaaggactgggcagcagggcctcactaaccacagcctatatgcctgtttctgaagttttggccactctcatccagctggtctactgtctgctgacctagatgatggtaaattgtccccaggggtagcctgtctagttcaggctgcacctttcgcatatatcagctcctttccaccatcatcccctttgtgaggctgctgtgattatcatgttccttttgcagagatggaaacattgcctcaaattagctctgtcatttcctaaggattccagggttctttagtagggggtctggatcctacgtcctgggccatccccatcatagtgcaccacgtcacctccctggccagggaccgtggggtctccacttttttggggtgctccatctatgcagggtttcctggaagcacagatgctggcacttcagggatgaatgaaagtctttttgggggatttgtagatttttttcttgtcttactagctccattttcaaatgtatttattttgtctctttagtttgcgcgataacaatatctcagaccgaggcatctgcaagctcattgaatgtgctcttcactgcgagcaattgcagaagttagcgtaagtcagcctgggctgtggacaatgggctccaagtgccctggtctcaccccaggtcgtgcagcctgggaagctgtgagtgatgggctggggcaggggctgtttgcatgatggggggtgcaggtgattcctgcccagaggggaagggcaaccctgggatttggtgctcactgtccaatgtgctttgcttctgtgtctcctctcttctggaactgaacagtctattcaacaacaaattgactgacggctgtgcacactccatggctaagctccttgcatgcaggcagaacttcttggcattgaggtgagcccaggttttccttattccctggaaactattttttgccccattcctgagtcagtctgatctggtcttggcctggcactgcccacactggctcctgacctcctgattgaatgcagggacagtgtctcattttaagcaggggttctctaatgctgtgatctccccagtaaactctggactagctctgctgaggacttcctgtcttttgacctttagcccgtagggcaagaaagcttttctaggcccctttccttttctgtgtctaagagtgtcacagctttctgggtttactgagttccacgatgcatgttgagctcgtcctggtgggggaggcatacacagttacttgccaccccagctgtggcagcgagttgctgcaacactcccaggaggtcctttcaccactcagagcatgcaaggtttgcagtccatctggttctgcatttctgctactccagtgtctcccagtttcaacaggagtctctctctctcctacctgatgcctttaaattgcccctctagctggccgctgggttggcctggcttctctctccttctctctctctcagatattcttgcctcctgtgatttgtgaggcagtaaaaaaagacaaagtaaagaattgcttccatctattcttttacctcttgggctgggtttgtggatgggagccgccattttaaaatggcgggccacatagctcagtctcggcaagggctactgagatcagaaccacaggtgccaatttgtacaaaggactcagtcctgctaccactgcctgatccctcagactcacaagcctggaataggctgtggccagacctggctggcccatccctgagaagggtgctagtttcagaaatggaggctgagtttgtggccaacacagtagtcctccggtatgtgcaggagagatgttctaagaccccagtggatgcctgaaaccatggagagtatcaagccctacacataccatgcttttcccaatacctacacacctgcaataaagtgtagtttataaattaggcacagtaagagagtaatagcaactcataataaaatagaacaattataacaatcaatgtactataataacactatgtgaatgtggactctctccatctccctcaaaatatcttcttgtactgtactcacccttcttcttgggaagatgtgtggtggtaaaatgcctgtgtgatgggaggaagtgaggtggatgacgcatgcagcactgtgctctagcgctgggctgctgttgacctgaccacacttcaggaggagaatcatctgctcccagagatccctaatctttgagcaacaatgaggtcggcagctggatgtcaggagcagacgatcttgatgattaccaaatgggagcgtatagagcgtggatgcgctggacggggggctgattcacgtcctgggtgggatggagctggatggcacgtgatcagaatagcatgcaatttaaaatgtatgaattgtttatctctagaattttccatttaatatttttggactgcagttgatttcagataactgaaaccatagaaggcgaagctgcggataagcagggggcagggattaccgtatatcattgtaatagagagcacaggctctggagccagactgcccgaggtttgaaccctcattagctgcgtgacctcaggtcagcccaatgtctgtgtgcctccgtttccccttctgtagaatggaggtaataaccctggctacctcacaggctgtagtgatgagcaagcaagttaatccacatgaagggctgcaccgtctggcaggggctttatatagtaagcgagtggctgaaagatgatgggtaaatcacacaagcactcagcttgtttctccttatgtgagtccggtcctccaagcagggattcaatgtgccacccatttattggggaaaagtcctaaaaggggaagtggggaagggagctgggggaggctgggaggtgtgtccctgagtgaaggagagagggaaggaaggaaggttgagactgggcaccttggacttcagtgcagtcctaagacatcttggcaaggctgatgaggagttcttgaaccaaattcaccaggcaggggagcctgatgtctcaggcaggggctggcaagtgcagatgcgaggatgttagattttggagcacagcagctggggcccttggctacctccaaggagctgaggctggagacctgaaaggcgagttctcctagctgccacaccccttctccaaggatacaataatatctgccttataggattgttgtgagctgagtggcttgacgttccttgaaagaatgaaagcgtatagttatcccaggaagcctagggttgcaggtgagagctctggggcttctccgaagctctccgaggtgtctggattcagttgcagcaggagccttccttgctgggatcttcccccacccctagccttggccctccctctctccttcctttctggaaggctcagtgggccccacccctccctccagccacctggacctgcccagcgctcttgtgcaacaggtaaagcctacctgtagcaacaacagatctgggaaggctgcagagggcacgatggggtctggatcgagggcggctgagaccagagggaaaggtgtgaccctgagtcaccctcgctgtcccggggaaaccacctcccaggacagctgcctactgtggctcctgcctggaattgtcacactgctgtgcaaacagcgtcccgctgcccctttccctttgctgggggaaaatgaagttgtgggagccgctgagtaaactagacctagcagcgagggcacctgatgtggctgctgcctcccgggcaggtcttcaatgctttcttcctgtgtttccctggccagggcacagacggccctccttttctgcctgccgctgtgttctctcagcctcctctgtcttcccttccaggctggggaataactacatcactgccgcgggagcccaagtgctggccgaggggctccgaggcaacacctccttgcagttcctggggtaggttggattccaggaagagggacctgcatggaggggcttgggacttttgaggatttaggggcaggtgaaactcttcagccaggaggccccagaggcagcccagctccagtggggaggacaagccagggagagagtgggcggcccttgactgccaccttcatacttggtctatgcctgacaaacaggaagtttgggatgttggggctaggggaggacagtgcccacgagctggtgacaggaagccctctgatcctcagggggcgctagggctgtactttagctgcatattaaaaccacctggaagcttctaaacactattgccaggcctcccaccccagactgatgaaatgcaaatatctaggtgcaaggcccaggtatcaggagttttaaaaagcttcccaggggatgtacagccaggggtgaggacccctgacctaagaaagagaaggaaatggggaaggataggaaggcacccaggataagaggggctgtgctaggtccctcggagctcttgctccctgtaggaccatgctagggcctgccagggaggggagtaccccaacctgcagccccagggtgggcttcctctgtttgctaggcacccaggcttgcacctgtgctgtttccagcagcctctctcctatcctgtcatgccctagtgtgaactggagtccatttgacaagaactgggagttttagaacctgggactgtaggaagagagaataaccttagggcctaggtgttccagcccatttcacagggaggcaagttgcccccaagctcagttttttgttttgttttgttttgtttgagatgtagtctcactctgttgcccaggctagagtgcagtggcacgatcttggctcactgcaacctccgcctccttggttcaagcgattcacctgcctcagcttctcaagtagctgggattataggcacccaccaccacgcccagctaatttttgtatttttagtagagacagggtttcaccatgttggcccggctggtcttgaactcctgatctcagatgatccgcccgcctcggcctcccaaagtgctgggattacaggtgtgagccaccgcacccggcccccaagctcagtttgagccacaaatgggactatgttgctctagaaatcaacatcttttccacactgcattagtagcaacagagtctagaacaaaggaggccacagccccactgaactctcttctgcttgaggtcacatctgccacatcaggggtatttacctctttcaacacatatttattagggcacctgtctgggccaggcgttgtgctaaaacccccaaacgctgtcatatgatacaaagtgttctgtaacttgcttggtttttttttttgtttgtttgtttgttttgttttgtttttgttgttgtttttttttgcttcgccatatattataggaatttttttaggtcattatgacctctttatttacttaattatctatttatttattttactaatatttacagaaagggtctcactctgtcacccaggctggagtgcagtggttgcaatcatagctcattgtagccttgaactcctgagctcaagtgatcttcctacctcggcctcctgagtagctgggactacaggcacaagccaccatgcctggccgatatttttatgttttgtagagacggggtctcactatgttgcccaggctggtctcaaactcctgggctcaggtgatcctccctcctttgcctcccaaagtattgggattacacaagtgagccaccttgctcagcctgacctcatttttcaaagagctgcagagtgttacataatgtatttaactggtcactttttgatgactattaagttgttttcaggttttttgttattacagtgtcatatccctggggcacagagcagtgctggcacatagccagagctcaatcgatacatacctaatgaatgaaagtacagtggacatcctaattcagccattctttgctaacttgtgtacatacctgtccagggtaggtccctagaatacagtcaataagtcagaaggtgtgagttgggatctaccttttggaaagggatgttttcaaactacagtgagtcagaggaggatggcccagaagctgggggagttgaagctgatggcgtgaaggaattaggggtgttaggaagaagcaggagataaagagctagcttgcagaagaagtgttagacttgttatgggcaggtactggagggtagctaaggacttgtgggtggcagttaccaggaagcgtatctgaactaagtgtcagaaaaagtgtcacaactgtaaattactcttgtcagtgagttcctgtccttaagggttagggctgggtagccctctactattctctaagtctgtaatgtaaagccactgaaaactcttgggttaagtttggccatcccacccaaaagatggaggcaggtccactttgctgggaccaggagccccagtgaggccactctgggattgagtggtcctgcccctctggctgggactgcagagggaggaggactgttagttcatgtctagaacacatatcaggtactcactgacactgtctgttgactcttttggccttttcagattctggggcaacagagtgggtgacgagggggcccaggccctggctgaagccttgggtgatcaccagagcttgaggtggctcaggtaagcttcagagtctatcctgcagttttcttggggagatcaggtgaagagggaggagctggggccagttctgaaggtctttgaactttatttctaccccacaatgttaggcaatggagtaaggaaaaaagaccattggatttcaagagaggacactcgagtctttctgggtgacttggaaatgtcccttgtcctctcagggttttgatacagtatctgtaaattgaagatattgggctggatcaggtacattttatcttaaggaccaattccaatccattggtagtgggtgcccagtgcaccacattaaaaagaattctaaggctgcacctgggcttaaagaagagcactataatcaattagtgatgtctaaaaaagctaaaaaaaaaaaaaaaagagcactgcattcaattagtgatgtctaaaaagggtagaaaaaaaaaaaaaaagaaaaaagaaagagcaccgcaatcaattagtgatgtctgaaatggagcagaccaggagagcaccacgaattttgccctccataggttagctcatctctgaggtctttccctgctctgacatacttttgttccatgattacctccagcctggtggggaacaacattggcagtgtgggtgcccaagccttggcactgatgctggcaaagaacgtcatgctagaagaactctggtgagtttgggggattctctgctctggggaagtggatcacaatctctgttgatcccctggcctcatccataggagcggttgtgtggacagacaaaggtggatgattgagtgattgactgattgattgattgtgtttgtctttatatgtactgagtggtatgaagcttatagagcctggtatgtacatgctaatttttttatttaataaaatatatgggtttgctggtttggtgactgcctccacatggcataagtgttaagagcacagactctgtaatcaagcaggccgtgatcttaggcaagttaaataacaatttcagaatctcaagtttcatgtctgtaaaatgagggtaagaatacttccaaccataaaggatttttgcaagaattagataaagtagtgcctgtgaagaccttaatatagtgcctggcatatttgtaagtgctccataaatgttaaattagaataatggcagggttactactactattactgctgctgctgctgctgctgctgctacaactactatagtactgtgactactactactaataaagttttgttattttaaagtgattttgagttcctaggagcactgggtattcaagtcttaggtcattttggaaggtgtaatggagttttgatagttgaaagaggaaccatgaatcatgcttatactgttgacctgaagcagattctaagtttctcatcctttagatgccactagtatagttttctgacatgttctgggcagcttcagattatgtcagggagataaaatactgaatgtttgattttcccgggaagcagaaaggcactgcaacatatgggcattgccataaacagattttatggatggaccttggctgttgcagggcttactagctctactcaagtatgattgattctatcctgactggattttgccacttggaatttcttagtagaggagaaccttgttatgagagcatcagttatgattactgttaaaagaaaaactttaggcaaattaaatttagcagaactggtttgaacatacagcaatttatgaattgggcagcattcagaactgggagtgctccacccagcaaggtaggcaagcagtatctatagacaggaaaaggaagtgatgtacaaaacagcttgattggttgcagctgggcatttgccttatatgggcatggtgtgatgaggcattttctttatatggatatagactgatcagctggtagactgtgactgactgaagcctggctgctgtgattggctaagacttagctgtttgttataaggatatgttgttaggttgcagtttgctacataggaactcaaagtacagaggcagtctcaggccaaatttagtttaactatatgttaagctgcaggtgacagaatacctccatctatagaggtttaaacaaggaaagggtttattttttcctgtataggcagctggatgtaggcagtgtagggtttgtacagtggctacaagaggccaggaggggtctcagctctgtctcattctcttcctgttccatcattcttagcctgtgacttcattcacatggttggttgtctcatgatcacaggatggctgctccaggtgcagcactacttctgtattcccggattcgatctatatacccaggaaagccatctgggttctctcctttaaaaagcattcctggaagccccacctgtcgacttccccttatgtatcaaccatgtgtatgtcacttgaccaacccacttgtatgttgtttgaccagccctggctgcaatggagagtgggaaatacagttttttcaccaagtgcatggctgtccaaatgaaatgagacttccattaataaggaagaaaggaaagatggagatcaggaagctgggggatcagggaacttattacattgagagcccttggagtgaattctcttgcaaatatgtccctggaattgagaatccccacaacgtactttatctgttctttctttatccatgagtttgggttttcagatgttggatttcctatatggggggcatgtgagttcatcatcttccataatcaatgttgtatcaactggattttctctcttcttctcaccagcctggaggagaaccatctccaggatgaaggtgtatgttctctcgcagaaggactgaagaaaaattcaagtttgaaaatcctgaagtaaggaacccataagcaggaaacaggacaataattgctggcctttggaaggggcatttctgaataagatctgggccgctctccgctgggctaactcatgtgaggtggcctggtagaacagcttgccttggtctaggtggacaaggattccagtgcaagttgtttatctgggaggtggtcccagtaaatgctgataggagagtggtgaagtgagatggggaagtgaaggtaaccaataaaggggagttatcaagccagttatcaatgagggaaattggagctcagtactctggggcactcctggagccagtgcagaacacacatggtcacctacccaaccaatgggcaagaaagccatggcatttatccaccaaccctctgtccttcctatgttgatgtgcgctcatggggcactgattctccagcacttccagctcaccctcacccagctgaacatgcttctggggtcaggagaatggcctcaggcagagagtggaaggtcttctctgcaagcagtggctggggaggtgatgtgatggggagtactgtggcctcctccagtggctgactcagtggcttgggacttgtgccacaaagagatggacagctcaggtgaacatgaacccacctagtgaccatcatgggtttgtcagggtgctctctgaggctgatgccaaaattcttatttcaagtagacctcaggaaccccatcagatggctccttttgctggaggaaagtggcatctgcctaggcaaatgtggtcctaggaaaacgcttgcctttagagacagacagacagacagctgcctctgtgagtgccagctttgctgccaggctgctacccactctggcgacactcatttgtgttgctttcacaagctaggaagtttccaaatatttggagaaaacacttccactaattatttgggtggaaatgggctgggaagttggggtgaagcccggatgtgtctgagccagatgccagctttgcactgagggtcggcctttgggaataccaagcccattatcaaccaggtgtggatatggcaggtttgtcttccctccttgtcacagccttactccacttgactcccatggatgccaggcaatgaggctggggttggtcccatgccaccctgtcatcagccttatttttcagcatcctaaactatatcatcccccacaaaaattgaacttctgatatatcttttataaaaaagagaaatgcctacatctttcttttccaggcttagtttctgccaagagttggttgagagcccaggcttgctgggtgcagtggctcacacctgtaatcccagcactttgggaggctgaggcgggtggatcacctgaagtggggagttccataccagcctgaccaacatggagaaaccccatctctactaaaaatacaaaattagccgggcgtggtggcatacacctgtaatcccatctactcaggaagctgaggcaggagaatcacttgaacctgggaggtggaggttgccatgagccaagatcacaccattgcaccctagactggacaagagagaaacttccatctcaaaaaaaaaaaaaaaaaggatgagaaaaataataatttaaaaaaaagagtccaggctctggaaccagacagcctgggtcttacccctgctccaccattaccagccagttcttcttggatgagtgcctcagttgcctcaagtgtaaatggagataatggctggaccttcattataggccatgagcattcactgagagaatgtagctaacaaaagtgagttgtaggttggagcaaaagtaattgtggtttcagaccatgaactttaaattattataactaggctaaaatacatctttattaatcaaaataggaaccattaaaatcaacacatttttgccaataagaaataagtttgtttattcctgtagcataaaaattcatgcttcgggattcaacaaactcttggaaagcattttctgcatcctcctggttgtggaagcatttttcctgcagaaagttgtcaagattcttgaagaaatggtagtcagttggctagaggtcaggtaaatatggcggatgaggcaaaacttcatagtccaattcattcaacttttgaagctttggttgtgtgacatgcagtcgggtgttgtcgtggagaattggaccctttctgttgacgaatgccggctgcaggtgttgcagttttcagtgcatctcattgacttgccgagcatacttctcatatgtaatggtttcgcagggattcagaaagctgtaggggatcagactagcagcagaccaccagtgaccatgaccttttttttttggtgcgaatttgcctttgggaagtgctttggagcttcttctcggtccaaccactgagctagtcattgccagttgtataaaatccacttttcatcgcacgtcacaatcagatcaagaaatggttcgctgttgttgtgtagaataagagaagatgacacttcaaaatgacgattttcttggttttcactcagctcatgaggcacacacttatcgaggtttttcacctttccaatttgcttcaaatgctgaatgaccatggaatggtcgatgttgagttctcaagtagttgtaagaaaatcagctttgatgattgctctcaattggtcattgtcagcttctgatggcctgccagtacactcctcatcttcaaggctcttatctccttcgcaaaacttcttgaaccaccactgcactatacgttagttagcagttcctgggccaaatgcattgctgatgttgtgagttgtctccgctgctttacaacccattttgaattcaaataagaaaattgcttgaatttgctttttgtctaacatcattttcatagtctaaaataaatataaaataaacagaaagtattaagtcattagcaaaaaatcataaagtgagaattgtgcattaaaatgatgtatagcataaccacatttatttaagaatgtattccaatatcaaatggcaaatttcaacaatgcaaaaactgcaattacttttgcaccaatctaatagaagttcaataaatactggcaattacaattggcattgccttagggtcaacttgtaagacattcctgaaattgtgggaaagggggaggacctggagtggacattattggaaggcaaagctgtaaccaaaagagcaacctgggaaacacatgactcctctgttgctgtccctggccctatcctgtctcccctccctgttgtcagctacctcatatgttctctaatctctgtctctgtgccctcaaagacccccctgaaaatagaaatattactgctcattggttattttctatcaattaagtactgtattagtccgttttcatgctgatgataaagatatacccaagactgggcactttatgaaagaaagagttttattgaacttacagttccacgtggctggggaggtctcacaatcatggctgaaggtgaaaggcacatctcacatggcagcagacaggagaagagggcttgttcagggaaactcccctttttaaaaccatcagatatcatgaaacttatttactgtaatgagaacaggatgggattcaattaccttccactgggtcgctcccacaacacgtgggaattcaagagatttgggtggggacacagccaaaccatatcaagtactgtgcaagtgttttaggcatgcagagagtggtgggtcttcccagcaagcagagtgtggggaggtaatgggggactggtggctgacttaatggcccaggacccatgccacaaggagatggatggtggatgtgaataggagcctgcttacacccatcacaatttagattcttatgctcgatggcacgggtactcttttaggcccattttaccaatgaggagattgggactaatttgctcgagatcaaaaaagaagtggtgtaggtgggatttaaacccaggatgtctagcactaaaatgcaggtacttaaccactatcctaagggagtggctacttaatttgataaactcatctagtgaatggaagagagacggttacatttcactgatggtactgagcctttgttgatgagctcattgggaatctcagacatgagcaggatgtgtctaagggacaggtgggcttcagtagactggctaactcctgcagtctctttaactggacagtttcaagaggaaaaccaagaatccttgaagctcaccattgtatcttcttttccaggttgtccaataactgcatcacctacctaggggcagaagccctcctgcaggcccttgaaaggaatgacaccatcctggaagtctggtaaggcccctgggcaggcctgttttagctctccgaacctcagtttttctatctgtaaaatggggtgacgggagagaggaatggcagaattttgaggatcccttctgattctgacattcagtgagaatgattctgcatgtgaaggatctgattctctgtctaagaaagaagtctttacctctttaagtagggagcaatgatttcatttttaaaccttgactatttattcagcaacttctctgctctatgagatagtgtaggaatggggatgtggttgaagaatgaaaagaaaagtcagctcccgccctcctagaaattgcatctgccttcacaggtcaaggatattggatcagaccttctgcggttctgaatggagattacacaggttaggagcaggttgcacagtgtttccaattctctataattaaagccatagactttcatgtattgaaaaaagcaagaattgcattcttgacagattctttcattgccttaaaaagaatgactagccttgggagtctgggcagctgggtccagtgttgtagactttctctctgctgagccacagcttcaaagatttgtccttcttgtttccagggatctatttctcagacaataagtaaaggctttccctggcctaatgtgctgtaagtgaatgctactatatatgttccaggcactgggctagagactaatatttaaaagccaggaaatttcctatagaaaatctatatctcagggttttctcaaaagagctgggaactctggatgcccattcatgattccagtagttaaccagagtacaagaagggctgagtcttctcagatgggcaaacccactctggctgactgcagatccaccaagcctattgtcttagaccaggaccctttggcaactcattcccataagcctgtgacccttgctttaaatatgcaggccttgtcttctctcaaaaagcacatcaaggctgcagcgaatgcagatatcaaatgatgaagttaaaaacaaaagctttgctgggcgtggcagctcacacctgtaatcctagcactttgggaggctgaggcaggaggatcactttaggccagaggttcaacaccagaccttgtctctcaaaaaataaaaaattcagctgggtgcggtgtagttcctagccacttgggaggctgggatggaaggatcccttgaacccaggagttcaaggctgcagtgggccatgattgcatcactgcacaggcgacagaattagatcccatctcttaaaaaaataaaaaatttaaaagtgacttcaaaaatctatgctgtgatggagagatttttccttctgtatgattgtgatagctctgtggcctatgacgtcatcaggttctgggcaaagtgtaggttttctgtttctttgtttttgaaaccattgcacagtcctaagaaacatcacattctgggtcctgggcaccagccaacatgaggttgatattttaaggggtctgatgttatttgctgcctgttgatggaacttgggagggcaccagggtttgctcattgcattcttgacagattctcttattgccttaaaaagaatcactggccttggggagtctgtggctggctgggtgcagtgttgtggactctctctgcagagtcatggagccttgttcagaatgcttcctgagctgccctggttggccaagggtaaaaacagccctgacttccctgcaagaaacactgcagctgggccagagagtcagcccatcccaggcatgggtttaaaaagtggaggcttttgtttgaaagccctgctctaattttgtcctcactcaaacctctgttcacttgatctgctttaggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaacagccatcttccttgtgaccaaacatttaaaaatattctggctgggcacagtggctcacgcctgtaatcccagcactttgggaggccgaggtgggcagatcacctgaggttgggggtttgagaccaacctgaccaacatggagaaaccctgtctctactaaaaatagtggaggttgcagtgagccaagatcacaccgttgtcctccagcctgggcaacaagagtggaactccatctcaaataaataaagaaaataaaaaataaaaatattactaaaacttgtcaaattttaaagcacaattttctacttgaagcggaggaaaatgatgttttcaacccgataatgtatagcttaaggcaaaagcaattcttagaaaatagccaggcaatcaaaacacttttggcttcagtttagaaaagtttaaccccgtgaagttttcagctgtgcaggagcctccccgtacccagcctaaaaggctgcaacacatgtgaaaaggccccttggcccccctcgattccctcaaagtggctccaggagtctttaacagaaggatggagaaggtttacttatggctggctctccacagcgagcagcctctcatgcaggccttgtgttaaaatagtgcttagctgcgtttaataagcaagggatcaggtggtcacccagcaaggtaaaatcctacttccttgaaaggttttgcgtctggctgactcggtggtgtggcatctccctggaccctgcatgggagtgtgtctatgggttttctttgtgattggtgccctgttctgcccagaccattgtttctgatacagcagatcaggaggaaggtggtgttgagtctcctttcgctgaggagtacacacagcagcccatttgcatagcactgtattgggttgtcagtttgtcatctttaaattcattcagcaatgaggccaggcatggtggctcatgcctgtaatctcagcactttgggaggctgaggcagctggatcacttgaggtcagaagttcaagaccagcctggccaacatggcaaaaccctgtctctaaaaatagaagaagaaaaaaaaaagttagctgggtgtggcagcgcacgcctgtaatcccagctacttgggaagcagaggcaggagaatcgcttgaatcttggaggaggaggttgcagtgagctgagatcatgccactgcactccagcctgggcgacacagcgagactgtcataaataaataaataaataaattcagcaatgatttattaaccagttatattaggatgaccagtggattgacaaaacagacatggtcctcaaggtgcttaggtgagggtggagggagaggcaggcagaaaacaagtcagttgaaaaagacatgaaaaagtcttcatccaggcactgtggctcatgcctgtaatctcagcactttgggaggccaaggtgggcagatcacttgcggtcgggagttcgagaccagcctggccaacatggtgaaaccctgtctctactaaaaatacaaaaattagccgggcatggtagcaggtgcctgtaatcccagctacttgggaggttgaagcaggagaactgcttgaacccgggaggcagaggttgcagtgagctgagatcacactactgcactctagcctgggcaacagagcaagactccgtatcaaaaaaaaaaaaaaaaaagtcttcaggctgttaaggggctggtccgagacaggttgtctgaggaggtgccaggtaagctgtgtccccaagaatgagaaagatatggccaagcaaagagtgagagggaagaagggagcattctagtaatgggggacaagaggtacaaagaccctggtgagggaaggagcgtggtatgcatggtaggctcaatagtcactcccgaacatatgtagatcctaatccccgggacctgggaatgttgccttacctggcaaaagggactttggaggtgggattcagttaagggtcttgagatgggaagatcatcttggattacctgggtgggtcttaaatgcaatcgcagtttccttataagagaaatttaaaggacaatgtaaagcaaagggaaatatgacactggagaagaaagaaatgtgatcaccaagtaagatgctacactgctggctctgaaggtggaggaaggcgccatgagccaaggattgcagctctagaagccaaagaagaccaagaaatagattctcccctagaacctctgcaagcagcatagccctgcctgccttggctccagcccattttggacttctggcttccacgactataaggggataatttgtgtcatttcctgcagcagccataggaaactaatacactatgttggaggcaagctaagggaaaggtgtcactagatgggtttgcagaggtaggtaggaccagttcaggaaaggtctcactggccacagtcaagagtttggtcttgatcttggaataatgtcaaggccttggaaagttctaagcaggggagatgtgaaccaatttacagttaaagaagatcttgtttgcttctgggtggagataggacaggaatatgtaggggtggggatgggaggcagaagaagtggggaggctgcctcagagctattgcaggtgagaggcggttggcagtggaggtggagagaagaggatggattccagagacattttggaggtagattcccaagagcctacgaatgggttggatgggagggatgagggaatggcaaacatcaaggatgactcatagatttctgacttgagaaactgggggcctgggaaagttgggtaggaaaccagtttggaagtgggagggagttctgttttgaattgtcaagtttgagacaccgaaatggggaagttaagtggagacgtcaaaagatggtgtgaatttggagctcgtgggaaaggtcacagccagagataatagcgtgggtgtcctcagtgtcaaactgagaatggggccctcgagtctggatgacatgagctagaaagagattatggagaaagaagaggtcaagagggtctaggtaagatggtactgagatcttgatatgtgattcctggtagagttcagagtaggagaaattccctaattttcaaaagtccagcggataccaccaaaagcctcctgggcctgtgtagggaactagggaagtaggattcttgattgtaagcttctctgatagggaagttacctgaaaggtacatgctcatggccagaagtttatccatgagcagacggattccagttttgcagctaagaatacataattcttatgcacagaaaaacaacgtattagagcagaattttaaaaacagcctcagactttcataatattcatcatcatcctggaagaaaaaggatgccagtctgagggcccttccctccccatagcaccaaacaaaaagctgaaatgaatacaccccacagaaatgtgagagttggagtcatattccaagtggctgagctgagactagcgcttcattccattgttgtaccaggacagcttcaagcctccttattcactccggtgagtggtccagcccagtgtgtgaagtgcccagtactcagggcaatgcctggaagtgcccgggcacgagaggatgtgctgcctcgggccctaggtggagggttccaggtgagctgtaaggtcataaaggacatttcccctggagaatcgcaggcggagatcgcagcagggaagactggcaatccaggctctttgattggcttcccttggatcgtttttttccctgtaaatttaatcccaacctattattatttcctgaacaatccacagatccagtcccctaagcatcaccactcccctgatcactcaccctgaaaatgcttcttttcaggagtgctacatctctttctgctttgtaacaacttctcgatatcttcagttccacatccccctgcacccctccctctcacctgctctgcctccacccccaggaaacaagggggtccctttgggatccatccttgcctgggttactgcatcagtctccctgttactgactttgacctgaggcatgaacctattaaaacataagtcagatcagctactgctctgatgtaaaccctccaggacttcttgttggtgcagggtaaaaggtaaggtctcatctgacttggaccccctgtatcctctctggcctcccctttgccactcacacctgttctctgggctccaacctcactggcttctttgctgttccctgagcataccaggcacattgctgaggacaccaggcacattgctgcttccagacctctgcactcgcctttcccctcctatgggaacactgttccctgagacagtggtgtggttggcttcttcatttccttccagtcttagttcaaatgccacctacatgaggtagtccttccctgaacaatctacctaaatagcagtttccagccactgcctgccttcctttgtattgtcttctctgcatgaactacctgatgcatggtcatttttcccctcccctagaatgtcagcttcttgagaacaggaaccacgctcactgcagtgtcctcagagtctacaaaggtgcctagcacatagtaggtgctcaatacatatttgttgaatgaaggaaggatccactttctttattaaagggggcagaaaatagaagttggggcagcttataagaatgagtcaccctttttctgacatcatttgtgtctccttggtaaaggaggaagattccctgggacatggaacaatccctaatgcatcaactgcccaaaatgggatccagatgtagcagaaagttccctttaataaagagctttctgtgtgtgttttaaaaatcaaacatagaaattatttgtcattgataccagcaaatagctcaaatgggagagcatggatttatagttcggctggattagtttaaagatgattaaagtaatcccctttatcttatcaaaaagagcttttaggtggtcagagtaaaagtcctcagacagaatgttcagttgcacttggaatttcccttccctaagagataagcacatctcagagatggaagacctcagcccgttatccatggatcaaaacactgtgctgggctactgtggagaaagcgcctgtgacgtatccttgcttgtgcggatacctggtccagttagccacttggcctggtgttcattctgaatgcccatattcacaggattagtgggaaaatggctggaaccatgggaggttggatggacatctgggagttgccatttactaagatggggagtgcagagggattgcagggggtggtggtggtgaatatcaggagttcgcttttggctgtgttgagtggagatgctgagaaggcagtaggatataaaagagacaccaaatttggagagactgcaagtaggaggtaccccgtggtaggcactgggaagcatggagcagggtctagtcaataatcatgaccggtgccactgagcaggttcccttgagtcctgacggtgtgttactctatgtcccatgcccctagcaggctacctggagttcaccgtcctccgtggggaaagctccattcaattcaatagctttatgttagggtcccgctgtgtgcaatgagagaactacataagacagcttagaatcagtgttaggtcaggcacagtggctcatgcctgtaatcccagcactttgggaggcaaaagcaggaggatcacttgaagccaggagttcaagaccagcctgggcaacatggtgagaccctcatctctactcaaaagagaaaagttagctgggcatggtggtgcgtacctgtagtctcagctgctcaggagactgaggtgggaggatcacttgagcccaggagacgggggctgcagtgagctatgattgtgccactgtactccagcctaggcaacagagtgagaccccatctcaaacaaaaaacaaaaaacaaaaaaagaaccagtgttatgttccctgcaaaacccttcacaacttcccattgctcttgggatggagaacaacccctgtccttggctcccaaggctcttttgtgccttcattgtctgcgctctgcctcttccagtttcttcaacaggtcatgcactttcctgtttcctatttctggagtgttccccctcactcctgcctgccagttatctttcccatctcatctcaaaggtgacttcctcaaacaggccttccctgagtggccaacctccctttaggcatgctcagagagattcttcttctgaggcttaccacagccataattaagtaagtgatcatctaatgagtattttagtttgcctttttttttttttttttttttgccagagggagtgtggcatctctcttgtacactgctatgtttcctggaacctgctcagtaacacaaccgctagttccatgaacccaggaccaggctggatggaagaggctgtggggtggtggattgagagaggtcattagtgagggctggagccctctgtgaagacatgtctgtaaaggactttgactaggtcctccatgaagggaggatttggaaggcagagatgatgagcatttcagttggggaatccattttaacagaggtggaaagagtcttggcttggaatcagggtctcggcccatctcctgagtgacaggggcttgtaatttactgtctttgggccttcatctactacctgtaaaatgagaggctggttcaccaaggactgcaaataatagcaccatgacactatctccccatcttatcccctggcagatatctctcttcccggtgagcctgaatataagttcagaattagctttaacgcaatgttctaagcagccattcccaattgataggaaatgataattgagataagccccatttgtcaggcttgacttggatgaagatcccttagatgaagtcaggccccggcactgattcagtgaacgtatgacaggacagagcctggggacgaaagccctatggaagtagagacctcagcagcaccaaacaccatcaacagaaaggacacaaaaataggccgggcacattggctcatgcctgtaatcccagcactttgggaggctgacgcaggcagatcacttgaggtcaggagtttgagaccagcctggtcaatatggtgaaaccttgtctctactaaaaatacaaaaattagctgggtgtggtggcaggcacctgtaatcccagctacttgggaggctgaggcaggagaattgcttgaacctgggaggcggaggttgcagtgagctgagatcgcaccattgcactccagcctaggcaacagagcaagactctgtctcaaaacaaagaaacaaacaaacaaacaccccagcaacaacaacaacaaaaacaaaaagaagggacatgaaaatattctagtccagagtggcaaactcagatgccttaagggaccagtggatgtagatcgtgcagataagagaagtggtcccagtggtaacatgagaatgtttgccttgcctaaaaggaccccaaatctctctccttcacattcttttctccttcctccttatcgtatgggttaggcaaaaacaaatttcagctgaaattttcttccagacagttggactgtgacctctgagtcctaccagctttgttggagaatccagatgtagatgagaacggtgttgcctaaggccacacttcaagccaggcccgttgatttccaacttatggcttcctacagcagtgtggtcatgaagcctggaaaacaggaagataggagtgacaaaagagggacaggagtagaatgaggcttaggttttcaaaagatgctcatttcattttggatgactatggcaaggaagagtggtggcctgtctactgctactgttagtcatcactcatgtgactgtttttatgtattcattggtttaaattccctggatctccagaaacatgtcactttccactgggggaaatttgtgtcatgattaaaaacacacacacacacacacacacacacacacacacccctcctcctttctcagtgttaatcaccttctcctataattagcacttaaaatgtcaaaggagaagaaattaattaacaggagtatccagtgcagcaaggctctaggactgattataaaaagcacttccttaaatattttgagtgcttttgggaatcagaagcctcccttctaattgaaagatccttaactacaccctaagtcctggctggtggccaggggtgcggggctgagtgaggcggcgtgtggaaatcccttcttcaccatccttgggaaaattccctccaaactgggataggtggcaacagaggttcggaaacagcaagcgtcccaggctgaatctgcggaggaggaagagatgaacctttcctgagctggtactgcgtgccaggaactttagctcggtattttgccacaatcctgtaagacaaccgatactatgatctccattttacagatgaggacattgaggctcagcgtggttgtgacttcctcaggtcacgcagccactgaatgaaagcgccaaagattcaaactgaggtctgattctaaagctttgctctctcacggcatcctggaatcctatttcaaccttcatctggactcttaacccagcccaaacctaagcgtctacagttttgacagctgaggcgggagcacgggaggcggagctggtggcagcgcagcgccccgccccggctccagcatcagccaatggtgacgcggcacccacagcctttcgcccaatcagcttgagcttcccgcctccatccgccgctcttctctgccccgccccttcgctttccctttggttccaccgagcttgacagagcggaaagtcccttcggccggcgccgggctggcagccattggaggaaggtctgtcacagggaggcccaatcacggcccgctcaggagcgcagctcggcctacgattggctagcgcggcggctgccccctccgcccccgctccctccctcttccctgtgcggttcggaggcggggcaggtgggggcgggcccaggtagcaggtttggctgcgcgggggccgcgcgtcggaggtaaatactagggcggtgggtgtggggagccggggccggcccgggacgcgggctggggagccggggcgaggggcgacgccccgccgcccgaggttagtgaatgagcgggcggctggcggccggcgggcggccggatcccctcggcgcagccgcctggcctcagggcgtccggagccgccgcggcgaccatcgggccctcggcgccggcccgttagttgcccgggcccgagccggccgggcccgcgggttgccgagcccgctgacgtcagcccgggtttcccccccccaccggggcttccccatcccccgaggcttcccgggagggctgcgagtccggggagcgtgcggggtcgccaccatcgggacccccagaggagagaggacttggggcgggagccgcgcgggacgctgtccccctcccgccccccaccccatttacagattgggagactgaggcacaggccgctggcgggccccgacggccacggttggcctcaggagcccggggctgtgattcctaccgaccgcgccgcggggcgtacgtaccgatcgattttgcgggtgttggtggctcccgtccaggaatggcagtcggggttctggccttgttaatggcgtgttctgctttttctttcagtttccccctttctagggtgaggatggttctacacagccacccggagttccttagttgaaaggtgcgccctgctgtgacaggtattctttctttatgtttttctttcatgttaacaatcgaggggggtggggggcgaatggggggcgggggcgaagtcatgaaatcttcaggagatggtgttgagtttggtactcagctgggtcagctgccggttattcatgtacttggcatcgtttctcttccaccccttggcatttgaatgttttaggatagttgtcatcttccagccaccaagcctgtggccttgcagtctcc

SEQ ID NO: 1151 - DNA, 43530 bp, Homo sapiens
agaaatggaagcccactctgccagaggtcccccaaggagcgggccaggcaagacaccaccaaagtcaggcccaggagagcctggggttacccacaggggattgggaagcagttccagtcggctgggcacaggagagacaggttacagagcaatggttcctgggaaaccctggggaaggaagaacagagtgagcaggtcccttgatgcttgaacacggtgggttttttttgtttttctgtgcaactgggtccccagaatagagatttttttcagatgtgaactggagttggagaagaaaagaatcaaagaaacagcatgtttcccctccagaagtggatgatcagggcttattgatagaaagaagggaagtaggaaggaaagaaagaaggaagaaaggatggaaggaacccgcctgaaacccctagccaagagccaggacactcttcactcatcgccctctgcagctccacatgtagcaatcctgccaacccctggtccattccaaggtcttctctggacaacctgatccccacctttggtgggacattttccctgcctttgtggtgtcaaaagaagcaagtaaggccctggagactaggattcgggagatctgacttctaattctggttctgctactagttgcatcgacaagtgtttactgggggctttctaagtactgggccctgtgccagacactgctgggggacaagagggataagccaggatccctcctccagggattcacagtctagtgagttttgagggagacggtgggcagacagaaactgcagtctgcagtcagtgctgtgggattacgaggaggtgttggttaatttcaaccggaggagtcttggagggccttgccagggaaggagatttcagtgcaggtccttgaacgttggaggtggggcagggcagaagcattgcagatagaagagacaacataaggatatataaagaaaggagaatggagattgggtctgaggacaaaataatttgatgtggtggcagtggagcagcaggctggcaccatttgcagagggatgaggactatgaattttattatctctgcaagggggacacagtagtggcaggaaacagtaaggaaacagtagtggcagctgaatgcagaatccatgaatgtaaatattctgtctttgtacagaccctggcaaagagtaggtatccaagaaaggtttgttgattgaatgaaacgtgtataatagtttggagaaaatgaggtggatatgaggtttttccattacctattgctgcataacagccatcccaagatccagtggtttagttggatatattttgctcatggatttgcaactggggtagtttccaccaggaccacttttctctgctttactccaaactagagactggaaggttcatctacttacgtttggtggttggtgctggctgttggctgggacctcagctaggactggggccagacagctacacaacgcccttctgtgtggccacttggctccctcacagcatggtggctgtgttccaagggccagtgtcccaagagaagaccagtcagcagctgtatctccttgaataacttagccttaaaaaatcacataaaacaacttctgctgtaatcgtgacccatcagatgcaaggagaacaaacacagacccccacctctcagtggaggggtgttgctgtcacactggaagaaaagcatatgtattggcacgaccaccttgggaaaatatcatctgccacatagagcaatacaatagtccaagggagagatgcccaacacttgaaccaggtcagaggtgatggaaaagggcccatttgttgtgtaactttaggagtaccactaaatctcactttccttacctgtaaaatgaggagaccaaacaagctgatctctgagatcccgtccagctctagcagtgagtgattccttaattccacacagcaacacacccacccatgagtggttcctctgtttctcctcaatagccatcttcacctccacctcttgcctctgctctctcatcctgggtgcacttggagccaatggttactccacaaatagcaccatgatccatcctgcatatttatgtcagactaaaaataagtggtgcaggagaccccttaggacaagatagaagcccccaagactgatcaatctcccattttatctgctgtgtttgcatcacagtagcatctaactggaaaccacaaacacagggaattcattatctaaccgggaaaagaaccaataggcatgaaaaaacttggatatgaaatgtcagaagaacaatctggtgatgttgaggatacgtggaggggtgttcagaagaaggagggctctgagtgggctgggtcagctcggaaaatttcctgggcgattttggtccttctgcatggtaagggctttctcaggtacaaaggaaggtggtgaacatcttcataaagcaagatcccaagaggagtcaggtgtgggtttccccaccaatctatacttacccccagatgagaaagagaaggggccagtttcagtttcctctgcctgaaaacttaatagtcatctgttcctttgatttaaagactgggatttttagacacaagaaggggcttcaagtgaggctgcaaaacttagcaagtactagaagctccagaattactatataggagggactgatggggagaaagaatcctattataaggaggctgggacatttgtctgaaggttgaatttgcatgtattcctttttaaatgtatttactaagcacctaatgtgtacctaacactattctagaaaataggttggttttgttttaaaaaatgccctgagagtttgcagaactagtgcactgttttgacatatattagggggtttatttttgagtgccttcaaaggattaaaaaatatgaagaaccaagacatgctttgggcaaccttgccaggaaagctggccctggaggagatcccaagctcacttggctactcaatgcctccagccaggttggagctttgtctctgtccaaggtgctgaaaatactttacggcaggctcagcagaaaaccagggagggcagcccaggtgacaagactgaggcactcttcaggacacagtgcattagatggtcaccccaaatcctgaaaatgcctctggagctggacagtagctcctggaggcagcacggggtgaagcaagagctgggtttgccagtcaatgctgagaaaaccatgtctcatgtgctttcagagtgtgccttcctccctcactcctctgacagccatcaggaaaagatatgaataaacccctgaactttacacttgcaactcttgggatttcctttgggagtttctgttgctttatgaaatattagagccagaagcaaacactttcatatattagacaataaaacagatattcacagtgacaaggactccgcctcaaggttgtgccacaagttagaaatggagctggacataaaatagtgtctcctggttcttagttaagtgatttttccaccacaccaggccaggtgggagattacataccacatataacaagagctaaagaaatttgagatatgtgtgtgagagagagagagagaccagagaactccagatacagaggttgctctgtcagctctccagaacttttgctgttcattctgctgatatcgggcagaattaagagcctaccccagcttggaataaaaatgctaacccaacactagcttcatatcctagcccatcccaaggatcatcagctgctgagtcagccaacaccaaggacctgagaagagaactcaggttcaaataggtcttgcatggtcaggaacggtggcttacacctgtaatcccagcactttgggaggctgaggcgggaggatggcttgagcccaggtgttcaagaccagcctaggcaacatagcgagacctcatctctacaaaaagaaaaaattagttgggtgtgatggcacacacctgtagtcccagctatttagcaagatgaagcaagaggatcgcttgagccaggtaagtcaaggctgcagctacctgttaacttttctttttctgagatggggtctcaccctgtctcccaggctggggtgcagtgacacaatcatggcccactgcagccttgacctcccgggctcaagtgatcctcccacttcagcctcccaagcagctgggactacaggtgtgcgccatcatgcctagctaatttttgcattttttttcagagacagggtctcactatgttgcccagtctggttttgacctcctgggctcaagtgatccaccctcctcagcctcctaaagtactgggattaccggcatgagccaccatgcccaggtgcagtgagccgtgatagcaccactgcactccagcctgggtaacagagtgagaccttgtctcaaaaaacaaaaacaaaaacaataaacaaacaggtctcccactccatcttctccctgatatacccacaaacaattatccagagctttctatgtgccccccactgagaagtgttcctaaggaaatatatgatatacaatacagtccctggccttacaaaatttgcaattcgttgagaagacaatattttcacccatgattagacaatattacaggagccaaatacaaataatggcagctgacaagagaagttacacagtcctagatcccaagtctaagaagtggtgcagaccatgaatgctttttctttttctaaaaatgttattcatttttgtaaaatagagacaggatctccccatgttgcccaagctggtctcaaactcctgggctcacgcgatcctcccacctgggcctcccaaggtgctgggattacaggtgtgagccacggcgcccggacagaccatgaatgctttgacttcagggtctgaaggaatcgttttaaggccagaaggataagggaaggcttcacaagggaggaaggcttcgcaagggaggaaggcttagggagaatttggctgagctgagaattgtggtcaggacctcatctctgtccctctgggggaccagcagtccagtgcagggccagacagagccagtgagggtgtgaaggtgacggcagaggcctattgcaatgctggggcgctaaatgtccaggaagagcgcattcgatctttcccggctgaagaagaacaggccctgagagctcccccttctggatccgcgcagcagaacaacatctcctctaggaagtgggctcagcagtgcccggctcagcagtgcccggctcagcagtgcccggctcagcagtgcccagcgcagacggggctggtgcttaggaaaccagacgacagactgggaaccccatttcctgggagcccctcggaagcctcaggtcatcatcaacagcaaatatgtcagggacgcctctgggaggtcactgggagtcgggcatgtaatccatttggggagagcaggaaaaaagacaagtcaccaatgactgaaggttctccagggcttgaagtcaggatttccacatctcacagatcagcagggggctctaaaggctgctcctcccaccctggtctggagagagggcccagcccctcctgggggcacctgagagggttctgtccagacgatcccagtgacagttgctgtggaatttccatgctgggcacacttgaggcccaaagctccgattcccaagaggcgccacagcaaccatgccaggaaactgggccaggctgagggtggcaggagagggagacaggaggaggcaggaagggggcagggcctgtcagatggatccctgacaaccatccgtctcaagtccgaggtaaccttatatctttgcctcagcagataggatgactttgtatgtagggccttcagagcccaagacagggcacctatggtgagcattcaggaggcctcagcctgcccctgaaaccccctcgttctcactctggatccccggaataaaggacaatttcggccaggcgctgtggcttacgcctgtaatcccagcactttgggaggccgaggcgggcggatcatgaggtcaggaaatcgagaccatcctggctaacacggtgaaaccccatctctactacaaatacaaaaaaattagctgggcttgatggcgggagcctgtagtcccagctactcgggaggctgaggcaggagaatgacgtgaacccgggaggcggagcttgcagcgagctgagatcacgccactgcactccagcctgggcaacagagcgagactccatctcaaaaaaaaaaaaaaaaaaaaggaggaaatttcaagttcccacggatgggaaagccttcatatccacacagatgctcttggcccaaattagctttggaggggcagggcccagatgaggaggctggtcagtgagggagcccaggatgcacaacccatggacaactgcaaaactgtgagggggggagctccccagctggggagcagggagggggcacagggagatgctgccccgccctcaggtgggctccctggggcagagcctggtgaacctcttccagagacgcttctgcctcctggctgacagacccagtgacctggaaacccaagaccttaccctggcagtggcaggggtctgccagcctctgggggctcttgggagtctggaccaacttccaccttcccaagggaaatgcaagaatctccaggccttgatcaaccttcaggtttagattcttccttcaacaccactgccctgagtgtgtgtgtgtgtgtgtgtgtgtgtgtgagagagagagagagagtgcacgtatgcatggatgtatgtgtgtgtgtccgtttgttcaggctgctgtaagaaaacaccaaggaccgggtggcctaaagacaacataaatttatttctcacagttctggatgccgcagtctaagatcaaggtgctggcagattccatgtctggtgaggacccacggttcatagacagtgccttctcactgtgtcctcacatgatggaaaggtctggtgaggacccatgttcatagacagcgccttctcactgtgtcctcacatgatggaaaggtgagggatctctctggggtttttttcttaagggcacgcatcctattcaggaaggttcctccctcacgatctcaacacctcccaaacaccccgcctcctaacaccatcaccttgggggctaggatctcaacttatgaatttgtggggaaatcaaacgttccccgaaacatttgtgtgtgtaagagagtatgcatggatgtatgtgtgtgtgactgtgcatgcatgcatgtatatatgtgtatgtgtgtgcatgcatgcatggatatatgtgtaagaaagtgtgcatgcatgcatggatgtatgtgtgtgcgtgtacgtgtgtatgtgaagatacctcctgagccttcggtttgacacaccccatgtggtctgtgcaggaagcagggaggcgcagatttgtcccaatctgctcctctgggggtgggcccaaatgagccaccttgggaccccagatggctggtgtagacctaccacccgatgccgttggctcctttcctatcccctgggtctccccctcccttcgtggtgtctgatcccacgattgtgctgaaatcgctcctcctcggctctctgctgccctcatgtggctgtctcaagaagggctggggctaccagggggcgcccaggatcaacacaggagccccttcagaccggcaaccgcgtccacagcccggaaccctcagcatcccagaagccgccccaacgccctcaccaaaggctcagcaccaattctgcaatctggaagctgagcaaatctctccgccccccagcactcagcatgagttacatcctcgggagggggaggcctggcggcagctgctccccgcccctctcccgctgctcccgcctcccttccctcctttccccgctccccacccgtccttgccagcaggcaggaaggaagctgctcatagtgcaagggtggggtacttccagctcacactgaacagccccgggctgggctataaagagtcagggacttccgctcagtcacccctgccctcaccacccaggcccccatgcacacaccccaggcccaaggccttcccttcccagcacagccctccaaggtcaaggcgtcccccgcccagccctgcagagcactctggtctgagagggaaggcaggggcaagatttgccgcctctttggcattatggagggggcagggggcacagggcacagccctccccagggagggatccctactcacccacagaaggctgtcaccttacccctggggtctgggccagccctccccgaggcggaaacacagccactgtcagggacaagggggctcagttcccaaccagatcatctccaaagcccattcagcttcagatctcatgattgaagatggaaattctttcagccgaacaccaaatctccaaccttgaaaactgttttttcggaaagtcctctttaaaacatggttaccaatatgagcagtcagccactaagatgcatgggcatcattcttggcagggctgcaggcatagagcaggccagcaccaggcagagccctggggacggcaggcctcctccgacaggcgggggaatcaactgttctcatcagagcaccctgatggaaggcaggacactccggacaacactggccacggcccaagaaaggggaagcagggaatcccctgtccagagagcattcatctctgactttttctgtctgtttaacttttttttttcctccttttcttaagaccctgccatggcatcctctgccccaattcaaacccaatccaggcctactctgaccctcagctttcagcgctgactgtactgaactggaccccatcctccctgtgaccctcagccttcagtgctggctgtactgaactgtaacccatcctccctgtggccacagagtgctccttcttgcactcctccccttcacctagactgacttctttctgcccacacagacccatctagcctcagccaattcccttctcagtggaccctctccattgcctccagagcacagcttccagtccccaggcggctgcacacatttgcaacaaaacaagccaatgtatgaagcaatcccactcagtgcaggagctcaacccagcagaggatccccacagagaggaactgacctgtgtcttccagagcacacaggttcagagcacacaggttcatttaagtgagaacccacacttacagagcaagctgcccaaaaaccacgaccaggagggcccagagaaagagctgtccccggggccttggggacagggtgacagccacccagagatcatggagaaggggacgtaaggaagacctcacagaggagtcatcctgcgactgtgttggttgggtccttcaggaagcagagtcccaggagttggaagcataagaggaatactgcgggcaatgcctgagaaagataacagggaccgggagcaggagtgagttgggcaggggaaggatcaggcccacaatgccaggctcacacctgcagaggagggaagaagaagaagggcctcacatcagcccagcgggggatgttacgcccacagacgccccggggctcagttactgtctaagtgttagaaataaattttcggtgccacaaaagaaatagcactcagatataaatgttcccagcaaggcaattttacttctatagaagggtgcatctcacagatggagcaatggcaagagcacacctgaacaagggaagggaaggggtttttatccctaaggcaggtagcccctacagctgtgttgttcccctattggctagggttggaccacaccgtctgagctaattgttactggctattttaaagagagcaggggtaagagccggattggcagggtaagtagtttggcaggaaggacggtcacagaacaggtgactcaggatgactcaggtcagagcaggtgaccagtggtgactcagttcggagcaggtgatagaagctaggagggggttgtttactgaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcaggtacctgctctctaagagggaggcctgggtggtgcacctccagagctgcccaggctgggcctcaaggaagaaaaagattttcatttgtcagaggcggaagggagaggtggagggaacagcacagcagcggcccaggggcagggaagcacaggaccattagggagacacgagaaagcccatttgtctagaacagaggattcaagcagtgcaccaaggaaaatgagggccaggccaatgtgctggagtggctttgttcttggctgagggttttgggtagtgccaaagcgtaaggtaagccctgctttccagaagaatctagcagagtgtggagcccagatgggactggaaggcctgggaggggtcaggtggccacagggacgggccacagccagtggtgcaggcaagaagacaatggccatccatggtggctcacacctggaatcccagcccattgggaggtcgaggcaggtggatcacctgaggtcaggagttcgagaccagcctggtcaacatggtgaaaccctgtctctaataaaattataaaaattagccgggcgtggtggtgggtacctgtaatctcagctactcaggaggctgggtcaggagaatcgcttgaacccaggaggcggaggttacagtgagctgagatagcaccattgcattccagcctggacaacaaaagcgagactctgtctcaaaaaaaaaaaaaaattagccaggcgtggtggtgggtgcctgtcgtcctcgggaggctgaggcatgagaatcactccgggaggcagaggttgcaatgaaccaagatcacaccactgcactccagcctgggtgacagagcaagactctgtctaaaaaaaaaaaaaagacagaaggatgtcagcatctgatgctgcctgtcaccttgaccctgaggatgccagtcacagctccattaactgggacctaggaaaatgagtcatccttggtcatgcacatttcaaatggtggcttaatatggaagccagacttgggatctgttgtctcctccagcatggtagaagatgcctgaaaagtaggggctggatcccatcccctgcctcactgggaaggcgaggtggtggggtgtggtggggcctcaggcttggggtcatgggacaaagcccaggctgaatgccgcccttccatctccctcctcctgagacaggggcagcagggcacactagtgtccaggagcagcttatgaggccccttcaccctccatcctccaaaactggcagaccccaccttcttggtgtgaccccagagctctgagcacagcccgttccttccgcctgccggccccccacccaggcccaccccaaccttatcctccactgcttttcagaggagtctggccaacacaaatcctcttgtttgtttgtctgtctgtctgctgctcctagtctctgcctctcccagtctctcagcttccgtttctttcttaaactttctctcagtctctgaggtctcgaaatcacgaggcttcgacccctgtggaccagatgcccagctagtggcctttctccagcccctcagatggcacagaactacaaaccccagcatgcactctggcctgaagtgcctggagagtgctggtgtaccccacctgcattctgggaactgtagtttccctagtcccccatgctcccaccagggcatcaagctcttccctggccggctgaccctgcctcagccctagtctctctgctgacctgcggccccgggaagcgtgcgtcactgaatgacagggtgggggtggaggcactggaaggcagcttcctgctcttttgtgtcccccacttgagtcatgggggtgtgggggttccaggaaattggggctgggaggggaagggataccctaatgtcagactcaaggacaaaaagtcactacatccttgctgggcctctatccccaagaacccaaaaggactcaagggtggggatccaggagttcttgtatgtatggggggaggtgaaggagagaacctgcatgaccctagaggtccctgtggtcactgagagtgtgggctgccatcccctgctacagaaacggtgctcaccttctgcccaaccctccagggaaaggcacacaggggtgaggccgaaggcccttccgtctggtgccacatcacagaaggacctttatgaccccctggtggctctaccctgccactccccaatgccccagcccccatgctgcagccccagggctctgctggacacctgggctcccacttatcagcctcagtcctcacagcggaacccaggcgtccggccccccacccttcaggccagcgggcgtggagctgaggctttagagcctcccagccgggcttgttcctgtcccattgtgtatgggataggggcggggcgagggccagcactggagagccccctcccactgccccctcctctcggtcccctccctcttcctaaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacaggtaagggccaggcagctaggagcaggtgggcaacaagggtggtgtcaaggcctgaagcctggggctgggaaggtctggaacttgtagctgagtcgggagggccaggtcacaaatgcaaaagggctattaatgtgcatagaacaggacagtctgggaggctcagaaaggagaccaggatcagagtcggcaggtgaaagctgggagtaagggtgccagctatagaatctggccagggtttgaatgctgctctgccgccaggagctgtttgactttgagcaagttacttaatctctctgaacctccatttatataaaacgagatatggcaatacttactccatggggaagtaagtttctagctcacagcaagccttcaacagcagcgatgattatttagctggagaagaaaggagctgacagcagtggttacaggagtgagaaagtggggtctcccagaagagggagagagttgggcaggaaactcgggcccttggggtaagcaggctgagaagacagagccaccaggcttttttcccctgctccagccccctctcctcgtggctgtcacccgaaaactggaccatgcagttcccacaagagtcctcccgggggtagaggtcccaggagggaggaaagacccggaggcctggtggggtgccaggccgggggcaggctggggctgcaggcagctatgcagggaaggctgagggccggggccctgctgctcaggcgcacccttggcctgagtccctcccttcctccctgccgctggtggctctgggaggaagtgataaggcctgcgaggcttcccttcacacatggggctgctgtcaggaggggttgtgagtgcggagggaaatcagagctgaggaatccctgcagggcttccctccactcaagcaccaggctctgtccccctcagggtagggcttatagcagctttgcggggggtggacaccccatctccagaagaggtgaggtgggcgctgcaggtgggatgcgaacttagcctcgggtcaggggctcaggagctcagcaccagcagcccctgcagcccaggaccctggtctataaacggaggcacagctcgcctctagctcctaaggcatggggaacgccagaaggcatgcggcaggtgggctgtgagatcgccagtgctgtaacaggggcctccgggtgacatctgggaaggctgaaaggaaacaaacccttcctgatgaccctatccctggctcccaacagccccccgagctccccgctaacccagcccccagaggggcccaagttccctcgtgtgaagaactgggaggtggggagcatcacctatgacaccctcagcgcccaggcgcagcaggtaaggccggcatgccctgtccccatcgtctccagggaaagggtgggtaaggcctggcctcagatggggccggagagggaagctcaacccttctttgaattggtcccttgtttccaaaaagaggagaggactgggaagaaccagaggagttgagggacatgcacgggacttgggtgaccctcagcctccagccttacccccaaccctggctcaaactctcccccatcccacccctgcacccctttcccccctcccacccctgcacccttcctccctctccccccgtcccctgcctgcattcctcctccctctccccatctcacccctgcacccctcttccctctcccacccctgcacccctcctccctctccccgtcccaccctgcactcccgccctctccagcgtcccacccctacacccctcctccctctgccccattccacccctgcaccccctcctccctctgccccgacccacccctgcacccctcctccctctcccccgtcccacccctgcatccctcctccctctgccccgtcccacccctacacccctcctccctctcccccatcccacccctaaacccctcctccctctcccctgtcccatccctgcacccttcctccctctccccgtcccatccctgcacccttcctccctctccccgtcccatccctgcacccctcctccctctgctcccatcccacccctgcacccctcctccctctgcccctaccccacctctgcacccctcctccttctccccatcccacccctgcacccctcctccctctgcccctaccccacccctgcacccctcctccttctccccatcccacctctgcacccctcctccctctcccctctcccacccctgtacccttcctccttctccccgtcccacccctgcacttctcctccctctcacccatcccacccctgcacccttcttccctctcccccatcccaccactgcacccctcctccctctccccctgttccacccctgcacccctcctccctgcccccaactcccatcccacccctgcaccctggcctgtcctgacctttgcactccctcgacccaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggtgacagcttcccggacgccacagcctcccttgtcccactgaggccccagaaaccccgtgacgaccttcccatgaccccctcccttcccagatcctaacaccacgtgggcccctcccgccctcccccagcacttgcacaaagcctggaggagggcctccctgtcccacacaacttcctgcttgtccccttcccacccctctcctccccaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgcggctggccagcgactgagagacccgggcgctaccaaaaggggagcggggtggcggggcagttcctaaggcttcccgggggctgggaggtcccaaactgtgggggagatccttgccttttcccttagagactggaaaggtagggggactgccccaccctcagcacccaggggaacctcagcccagtagtgaagacctggttatcaggccctatggtagtgccttggctggaggaggggaaagaagtctagacctgctgcaggggtgaggaagtctagacctgctgcaggggtgaggaagtctagacctgctgcaggggtgaggaagtctagacctgctgcgggggtgaggaagtctagacctgctgcgggggtgaggacagctgagcggagcttccctgggcggtgctgtcagtagcaggagcagcctcctggaaaagccctggctgctgcttctcccccaagagagaaggcttctcccgccaggccagtccagtgcagcccctcacccacacccactgctaccccagttcccctgcttcggcccgcaccctccctcacaccccagcccacagactcggggctggccttagttactggaacgcctgtgaccacagcactaagagaagcaagctgccccatgggggacttggtcccatggccttggcctccttcaccatcactggccgccaaagagtttgaaataaagccacgtgcccagtgaatcccaaaggaacctcaactaaaataaaaacaatcctatctgacacttgcctgaccctctaagtcattcaaagctttagctcaacttcgatccatctgagctgccatagtggaccccactcagagctgcgtccctcccttgaccccaggttggtccctgccactcccctgcccctgtcactgacacatgtttcctcctccctcaggcaggagtgggacctcccagcctcctcctggggcctccactcagaatgtcaggatgagcagggtcctaggaggcctctggtgcagccttcccttcccaccatccatgtgctcaaagagaatcacccgtcctttcttgaatgccatggatcatgggggatttgctgcccacactcctaggcggcctcttagacatccgttggtgcctaacccaagcatcagtttggcagaggccgagtccctcctctgtactggataccaagtcagcttccatagggatggggagacacctggcccagggaggagatgagaagcagcccggatggtgctacatatgtcagagagcagggcaggaagggatcagtgtggctgccaatggtcaggagggcgccatggagtgaaccatggcccctgcctcctcaccagcagctcctctggagctgatactcaagaccccccgtctctctcctcaccctcctctcccgctgcctcggctggctcaggtgttcgatgcccgggactgcaggtctgcacaggaaatgttcacctacatctgcaaccacatcaagtatgccaccaaccggggcaaccttcggtgagtgccccccaccatgccaggccccagccttcttccccaaggcagggaaggcggggctctgaccagctctttccccatgcgtgccagctcggccatcacagtgttcccgcagcgctgccctggccgaggagacttccgaatctggaacagccagctggtgcgctacgcgggctaccggcagcaggatggctctgtgcggggggacccagccaacgtggagatcaccgaggtgggcaccgagggccacccatgagggtgtccccaaggtggagaatgaggaaaccagtgggagaaggctcgggggatccaggcaggaagaggggagcctcggtgagataaaggatgaaaaacaccaaaggaggggtgcctgggtggtcacggagacccagccaatgagggaccctggagatgaaggcaggagacagtggatggaggggtccctgaggagggcatgaggctcagccccagaaccccctctggcccactccccacagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgtgagcaccaaagggattgactgggtgggatggagggggccatccctgagcctctcaagaagggcctgcaagggggtgctgatcccacaccccaacacccccaggctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggtgaggtgcgggatggggctcgggcaccgaatgcacctgtccaaggcaggagtctggctctcactccatccccaaaatgccagccacggggacaatcagagcaggtccagggttgcctcctaaatgggaactgaggacaagctctagaaccactgaagcaaaggggtagggggtggcaggggtgtgtgtgggggtgtgagtgggtgagtgtgagagtgtgggtttctggggtgtgcagtgggtgagagtgtgggcttgtggggtgtgtagtgggtgtgagactgtgggtttgtaggggtgggtgagtgtgggtgtgtgggggtaggtgggtgtgggtttgtgggtgtgtataggcagtgactgtgagactgtgggtttgtgggggtaggtgactgtgggtttgtggggtgtgtaggggtgagtgtgtgtgggtttgtaggggtaggcgagtgtgggtttgtggggtgtgtaggggtgagtgtgtgtgagtttgtaggggtaggcgagtgtgggtttgtggggtgtgtaggggtgagtgtgtgtgagtttgtaggggtaggtgagtgtgggtttgtggggtgtgtagggggtgtgtgtgggcttgtaggggtaggcgagtgtgggtttgtggggtgtgtaggggcgagtgtgagagtgtaggtatgtgggtgtgagtgtggatgtgtgtaggcggtgagtgtgaaattgtgggtttgtgggggtgggtgggtgtgagtgtgtgggtttgtgggtgggtgtgggtgtgagtgggtgggtgaggggggcatggggatgggtgtgaacatgtagttgttctttcaggcataggacccatagctctagagctttcatcagattctcaaaggggaccttgactcggcaaaggttaagacccattttagagatgagaaattaaagcctggagctgaggagcgactggcccaaagtccctctctgctctgaggtgccttcgcaggcaaaaacctgaaccagccccctaggcagccaggcctcccaatggacaccactcacctcactccttccagccatgtacgggaaacagagatagtctccccaccccacccccgtgatcacctctgtccctaccgatgccacacacccttctgccccaggatgtggctgtctgcatggacctggatacccggaccacctcgtccctgtggaaagacaaggcagcagtggaaatcaacgtggccgtgctgcacagttaccaggtgcagaggcccagactggccaggaaggcaaagggtttgcatacgggggcagcaggggcgggggatggaggagaggcagccatttagaaactagggcaggatttggacaggcagaagaagttccgtagtcccagtgccatggcgcacactggcctgcggttcggggacagggcaggtactattccaggcgctgtcatctggtggcttactgtgtgccagggaccttgctgtttactgcatgcccagtcatgctgattctcagggcatattgggtattgcagtttgtgggacccgctggatcctggaaacaaataccaggatcaagggcacaccaggagtcgtagtttgaggaagccggggcctgctgagaatttctgtgggctatttggtttggggaccaggcatgcagatgctggagattagagctgcttgttgcatgttgaacctgcagcatgaccatgcatgatgtggtttggggtgagggtgacattgtggtttgaggggacacagggtgtgttagatatggggtaatcgagggcacatgtggtttggggtgaccggagtggtggaggaagaatgggcgaggtctgtgggtctggtttgagcctctccccctctctctcccttccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccaggtgcccaccctaactggctctgccagcctgggcccagctctaattctaagcagcccctggggacctctaacctttccttttctttacctcccctcccaaccccatcatctctctgcagccagacccctggaaggggagtgccgccaagggcaccggcatcaccaggaagaagacctttaaagaagtggccaagtgggtcccctgggagccccgctctcccacacacaccctgggggccccactctcccccacacaccctgggggaccctgccccagcagtgttctgggcctaccactcagtatcccaaaaccctgttgtgagggggttggacccttgcctggggaggccctgcctctgtgcacccaggacaccctcacaccttcctctcccgcagcgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtagggctgagcccaggggagcagggagctagaaagagggggctctatcagcatcttcaggggtgccctggaggacaggaagtgttacaagtcaggactcatgaggaacccggaaccacaggtgttcagagatcaagttggggcctgaatcttgcactgccagggaggccagagtgaggagggcagggcctccgggggccacagcacccaggacatctgtcttcccacccacaggtcctgtgtatggatgagtatgacgtggtgtccctcgaacacgagacgctggtgctggtggtaaccagcacatttgggaatggggatcccccggagaatggagaggtgagaacttccaggaaaggggctgctgggaatgaggagagactcagaattggagtgactgggcaggaacctctgcccaacacacacacacacacacacacacacacacacacacacacacacacacacacacacacacacacacacacgccaggatggaaagggagatgctaagagacccctggagcctgaaaccccacacaagctacgctcccagcccacccatgtggctgcctccctgcaagcacatttgcttaactgcgcgtccccaagtcatttccattatcagtgcaagtttttaatacaaggaaggcacatcctggctgaccaagaggttagactgtgctcgggcactgacaagaaaaacagggatacgtcactgagggcggcttctaggatgcgggtaatgtttcttaatgggatactggttacacaggtgtgttcagtttgtaaaaatccacagagctgtacatttacaacatgtgcaacactattccagcattttattttatttgttttatttattttgagaacctatttacgttgcccaggctggccttgaactcctagcctcaagagatcctcctgccgcaggctcctttttcaaaagaagaaattgagcgctgtttagatgccaacatagattaaataacttcactttttaaaaagaaacacaaagctagagtaccatcattgaattccttctcttgcaagcttaggtatctctgaggtgccccaggctaggctcatttctgagtcttacctgctccagcttctaggtgttaaaggccttattagcactaagtacttcctcagtactcttttttcttttttcctttgagacagggtctcactttgtggcccaggctggagtgcagtagtacaatcacggctcactgcagcctcaacctcctagactcaagcaatcctcccacttcaacctcccaagtagttgggactacaggcgcatgccatgatgcctagctaatttttgtattttttatagagatggggtttcgccatgttgcccaggctggtctctaactcctgggttcaagcaatccacctgcctcggcctcccaaagtgctgcgattatagacgtgagccactgcacctggccctcagtatcttaagcaagttggaatctcgtgaaaccctttttgctgccttagtgtccgtttcagccctcattctgacctaccttttcaagaaaaatagcaccagcaattgacttttttttagcataaaggtgtatagacacccatataacctacagccttcacaaggcatagcacattttcaccaccctggaaagttccctcatcagttcctcacgtgaatcccttcccagtctgtctccctgccagaagtgtctgtcaccacagaatagtttcgcctgctctagaacggcacctagatggaagcacgcagtgttgcggcgtctcctgctgaggctgtttttgaggcgcactcgtgttgctgcgtgactcagtatttcactcattctgctgctgagtgccgttcattgtgtgaatatccccagtttgtttacccattctcttgttggtgacacttgggctgtttccaggtcggggctattatgaataaacctgttatgaacattcttgtacccggcttttgtgggcttatgtttttatttctcttgggtaaatacctaggagtagaattggtaggtcatagggtagatgcatgtttaatctttcacttttttaaaaaataaaactgccaggccaggcgcggtggctcacgcctgtgatcccagcactttgggaggcccaggtgggtggatcacttgaggtcagaagctcaagaccagcctggccaacatggcaaaaccctgtctctactaaaaatacaaaaattagctgggcatggtggcgcacgcctatagtcctagctactcaggaggctaggcgggagaattgcttgaacctgggaggtggaggttgcagtgagccgagatcacgccactgcactccagcctgggtgacagagcaagaattctacttaaaataaaatacaaataaataaaataaaactgtcaaacagcaaagcaaattaaactgccctttaacatctgtgcagttcaatgtatgttaattttatcccaaatttttaacaaatctaggaatacagctcacagaaaatggggtatattcactaaaaataaggaatatttatagcaaatttgtttgtaataccccacactggaaacaattcaaatgaccatcgacaaatactgataaattgtggtatattcaagtgccatatcgcactaagtgtgaacgaaacacaaccacacacaacagtgcaggtgaatctcaaaaaatgtgaagagaagaaaaagccagaccaaagaatacatactgtactacagggttcactttatataaagttcagaaacaggcagaactaatccacggagttagaaattaggagaggagttagtcactgggatgggggtggcagtgacaggaagaaggcacgaagttggcttctaggatgcgggtaatgtttgtttgtttgtttgtttgtttgtttttgtttttgagctggagtctcactctgttgcccaggctggagtgcaatggcgtgatctcggctcactgcaacctccgcctccccggttcaagcgattctcctgcctcagcctcccgagtagctgggattacaggtgcccgccaccatggccagctaatttttgtgtttttagtagagacgcggtttcaccatgttggccaggctggtcttgaatccctgacctcagcctcccaaagtgctgggattacaggcgtgagccaccacgcccagccacgggtaatgtttctcgatgggatgctggttgcacaggtgtgttcagtttgtgaaaacttacagagttgtacatttacaacatgtgtgcacctctggacttgtgttgcacgttgacaaaacattcaaaaatgaaattcaaatcgttcttgctaactctggcgcacttgggaaccagcacccagaggcatctgcagttgagcaccagatgcagttccttccagcttccttccccctgggaggtccgcttgatgccacttcttcatggcagcacaaacaaggccatggtcttctgaggagggcaacctgcacaatgtctgctagtgaccaggacactgctgaaggaactgagagtttgtccacccatgaaatccactaaaacaggaaagattttgctctagccgttgttagccaggagtgaggaaagagctgtgccctcccctgcagctgcgaggacgatctgcctgccccaacaagtggggattcagcaactccacttctaaggattacccagctgaagcatttaaaagtgggagcaaggcacacgtacaagggcgtttgagagagcacctgttcccagaccaccgagctgcccttcagtctcagtgaagtacaatgtagccactaaaaagactgaggtcatgttttggaaagtccaggccggaggatcgcttgagcccaggagttcaaggccagactgaacaacacagcgagactccatctcttcagaaaatttaaaaattaaccaagagtggtggcacgcacctatagatctagctactaggaaggcagaaaaatcccttaagcccaggagtctgaggttacagtgaatgatgatggagccactgcaccccaacctgggcgacagagcaagacccatatctaaaaacaatactactacttacgtcaatattgttgtattgacctggagggatgtctgcaataaattattgattaaaaccaaggaagtacagtatggtaccacttttacttaaaaaaaaactataaatatgcacatgcacgtaagttcaaggaaaaagggctggaaggttaacacctgtcaatggcgcatatgcccggagggaagatggggtggtctttgtcttatcactttacacatttctgtaatgtcatttttcaaaaacatcagatcgcttttgaaattttcaaaacaaataaaaattaagttacaaatcaataataatgaggatcagctggtacagttttaaacttctatgtagtttgaaatgaaacaaaactaaccctgatgcaaacactcccctcgccagagctttgcagctgccctgatggagatgtccggcccctacaacagctcccctcggccggaacagcacaagtgagttgggtgagagtttgggggagctgggggagctgatgcatttggagacacaaacagaaagggggtctgaaaagctctccctctgtgcctcaagtcgttttcccaccaaaagccagggctccaggatgccctccattccaggctgcaatggcagtccagacctgcctgcttctgagagccgggacagtcctgaggtcttcagagatgggggtgtggtgtgtcagggccccaggctcggaaccccagggatgctggccctcagcccctcccaagggcagggcctttcctgtcccagaggcagagaccctgaagccgtccctggggctggggctgggcctagcctgtatccccagggccctgtgacaaccttgtctttgtcctctcttgccaggagttataagatccgcttcaacagcatctcctgctcagacccactggtgtcctcttggcggcggaagaggaaggagtccagtaacacagacagtgcaggggccctgggcaccctcaggtcagggcctcaccaagaggggtgcaacgggtgggcaagctgcctgggcaaacgtggcctgcaaagggagctccactgacgacccctgcaccccaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggtgagcccagcccagcccctgctctgactcctgccccctgggatgcctcctcctgcctcactctgccctgattctgtttggttctttggtcccttcctgttccttccaaaatccaccctcatctctccatggcatagccagctcttctgggtcaggggcagaggatgacatggccctgccgaccacaggggtgcctagcccaggcagaagtgcagccgaaagagagcaggcagggccctggcaggagggagcttcagccaggcacaggctgggcctcacaagtgggcgcacaaagggagggggtgcagggcagggcaggggaccccacccaggatgggcaggatggagggagaaggaagggacagagagaaggtcagacagaggcaagggctgaagctgaggccagcacagaagccacaggaagccagaggccagacagcctggggcggtgcctgcaccgcagaactggtcccgggccgggcaagcaagcacagggagaggtggatccctgggggctgtggctttttaagcctgggcttcctcaggggcagtgctgcctgtctggggatcatgtctgcagttgacaagggctcggtctccccagtgccacactgttcagggcagtgctgctgtcccggggcccaggctggagctcagcagatttgccttgattggaggaggagggcatcctaggaggagagggagtgggggctacctcagggacggggaggtcaggctgcagaaacacataggccctgattgggaagaagggaacggaaaataagacttaaagaatttaaacaaaaagagccattgcagcgggatgagaccacatcatcaggttttgggaataggactttagaggcgtaggatccattacagcatcaccgaaccagaagcaggaaggctgagctaagcagagcagcagcagtggagataggaaggaagggagggaggggccgaggaaggaaggaagagatataagacttcacacgcaccacaaaagaaagattaacgggacttggtgatatgaggctcagccaatcacgggtgagccctgcatttcaagcctgggactggcccagcagttttccagctgtgtgcctgaccaggagtagacgggatccacaccctcccagggatctgccccgtggggtcccctctgccgcccgaattgtgcgtcccttcccaggagcacttactatctgcacgcactttgtggaaagctaagggctttacataaagtatctcatttaatcttcaccagaacacaatgaggtgtaaagatggggaaactgaggcatgtcactgtaagtacgggattcggaatttgaatgcaggtctgaacacacagacgccttcacagagctaccgtgtgccaagcactatgcttctcggatcacgggattaacacgcaccagataaggaacgatgcaccaatcaggacgtgcagagaaagagccagccgggtccctgggcccagcggccaatccatgaaatgggctggcggaaaaggtgctgtccttggcgccggcctcagccactggggctgccaaccccccaggagcaagacgcagtgaagccgcccaggcgcctcactagggcgacccctggtggcgggaggtcctcagccctcaccggcctgtcccgcaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtgggccctgccctcaccctaacccggctggttctctgaggcccccacaccccgggactaaagcactctggggccaggccctgctccctagctcaggctgcctcatttgcccctccccgcccccaggtctgatccacgtgcacaggcggaagatgttccaggctacaatccgctcagtggaaaacctgcaaagcagcaagtccacgtgaggacgacggctttaccgcccccccacccctgtcctgaacaccctgaccctggaccctcctcctcccacattctcccgcccccacccctctctgactccccataagtgcccctctccccacccccaggagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtgaggggcagcctgggaagcaacagggcacaccagccccatgcccagccccacccccggccccaggcctccaggagctcaggacccgacccagggggtggccacctcctccacagctcagcaggcaggctcagagctggctgtgctgcccactgccgggctggccttgttgctggaccatccccacaccctcaaatgcacccccaccaaaaggctgtcccctccctctgggctcctctccgaggctcccctagcaatctagcttgctctggagctggcactggggctatttgctgccacatcaatgcctgggctttatttaaaataagggggtggagtcagaggcagaggagcccagaccaacccagtccggccaggggcccccgaacaatacactgaggctacctagacaggccgaccccgctgctcaagggcaggctctctaacagtcaccaaaacacaaacatcagcccaggtactgcagtcctgctgggccctgtcctcagagctccctgtgcactatccccaggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggttgggggccaccccaatgaggcacaggggctagagagacgggatgagctggggggaccccagtggcaggaaacccccatgcaaagtcccccctggactttcttctcctggccgacatgcactggtgctttaagacccagctcctcagggaggaattcatggctggattctccaggtcttagagaaaactctattggcctgaactgagcagggagaaaccctaaagaggctcagtgggggaggggtcaagaagggaggttactaggaagggctatggggcctccaacccactgcatcctgccccgccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcagggtgaggcaacaagcaggagcaggcctggccacagcagggttgggaccggcccctctctggcccctcaccggcctctccttcccacccccagatgggctgggccccctgcactatggagtctgctccacgtggctaagccagctcaagcccggagaccctgtgccctgcttcatccgggggtaagtgagatggaagacttggtggggagctgcccagggtcagggtggcagctttggtgaggagtgtcactggtgaggggtgtcactggaaacaggaaggagctctgtaacatgtcaagggtgtggtgtcattaggtcacttcagaactctggctaagctttggctctctcattcatttagactcagagttctgccctgaaactatagctcccagagccagagctgggatcaaaccggctggccctgtggctttctgaaagcttctgtgttcctctctatgtccctgggctgtctgatgttgggcagcatggcacctgggaactacagtcactaaatcctcactcaatccagggagaactactagttagggttaagaccacccttggccttggtgtcaccaaggactcaaagaaggtgaaggttttggtttttttttcccccagagatggagtcttgctctgtcgcccaggctggagtgcagtggtacgatctcggcttactgcaacctccgcctcccgggttcaagagattctcctatggcgtgaacctgggaggtggagcttgcagtgagccaagattgtgccactgcactccagcctgggcgacagagccagactctgtctcaaaaaaaaaaaaaaaaatattctcctgtctcagcctcctgagtagctgggattacaggcacccaccaccacgcccagctaatttttgtatttttagtagagacggtgtttcactatgttggccaggctggtctcgagctcctgacctcacgatcctcccacctccgcctcccaaagtcttgggattacaggtgtgagccaccgcgcccggaccgagggtgaaggattttaagagacccttccttcatgctgtgtccagaagtcttgcccgctctcgcagccaggaaccaaaagtcctggtaggactgagaacagttcctaggctgccatcagctgggcctggtgattcaaatccacccaggtggctaaactacaaataaaccgtacccatctactgaacataaactaaataccactattaaggatacttaaaataaacacacttagtgaacccattatgaactgaaagtgtctttcacccttcccacgttttctaaatcccctgagtcatctaagtattcttcaatccaaaatgaactatatttcctttggtgcaatctccagaaaccacagatccaaggagtttcagcaagtagagttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtgaggctggggactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcagctccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacctgaagatagggagagaggggaggactcgcgctctccagcggggcacaccaaccacggccctcccgtggcctcccacgaccactcagccacccctgcacactctggcccacccttgtgccccggcccctctaggcccgcctcctcccgcccctgccccgcccctttggctctgcccctgttgacaccgccccagggcacgcaggccccaccaggcccgctccggagactttcacgtccagggccagccagcagccccgggctgcgcccccgcgcccacccccaccagggcccgccctaaccccgccgccccgcagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggtgcggaggggcgggccgggcctgagcgtgcggggttcctgctaaggtctccgagtcgggttctgatccactgtgctcttttccgacaggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctcatgtggattacagttttttttttttgtttttttttttttgaaacggagtctccctctgccgcccgggctggagtgcagtggcgtgatctcagctcactgcaacctccaccccacaagttcaagtgattctcctgcctcagcctcccaagtagttgggattacaggtgcctgccaccgcgcccggctaggttttgtatttttagtaaagacggggtttcaccatcttggccaggctggtcttgaactcctgacctcgtgatccaaccgcctcagcctcccaaagtgctgggattacaggtgtgagctactgcacccggcgtggattacaattataaaatgacaagatttctgttttaacctgtgcagttgtgggtatgtggtggggaaaggggtcattcttttgacagagtcctacacgccacttgaccctgcactctgaaaacatggtttccagccagtctgggctgctcccccgtgcagttctcaggctcgtgatcgagaaggcaggtgcagcactcagctgccaggagtggggcctgccagaaacaagagtcacagagatgtgcaacagccatgagcaagctttactgcttatttcatacaggatggggagccacacccacttcctgggacatcacacccgtactgaagtccaaaaacatcatccctcccgtctttccactgacaagtccccatcccctacaagccccaaggaacctgaaagtgctgctggcagccgccagcatgacgaatccacagccttaaagcccacctgcctcactgtcgcccttccatttagctcggcctcatccttgacctctgtcccccaccttgaggaaactcgaggacttcttcccaggcagctgctccaggacacattccagttggggatgtctccccttattccctctgggtgcagaccatctctaagacttgtttccagatgccatcagcatctcctctccttgcctaccttttctctgttctcggggcgagttcctcactgactcccaggtcctgcccaactaaagcacctgggcctgtcatctatggggcctctaacaatgactccttgtgtttttctactccaccctccaatctcctgtggctgccgaagccagggtacctgtgggaggagacggctcttggcaagcagtccaggggtctagattccagagatgaccacctcccatcaccccaaattcccaccactgctcccatcgcttcaagtcggactccaaaccaactacctatgccgtcctttctccctcccctcacaggaggcaatactgaccctgaggagtcgtctcagtcagtgcaagaggcccggtcaggctccttctgggtgtctgtggtcacctgaaaccctccggggaacagattccgggccttctgggttccccactgttgtctggggctagaggcaggactggagcctggtgaaaaaggccatcagctgggcagttccatgatgcccagtgtccaccaggctctgtcccctgcaggccccaccctcctcaccgtcacttgaccaggatggcttctcctcatcaggcgagggtggctgtgaggggctggagcagggcctggacaggatggaggctgcagcctcaccccacggctcctgctgctgctgctgctggtgaagctgcatggaaaggaggaggaatgagggctgcaccccaaggagggcagggccaagcacctgggctagaggcagagggcttttcagcctcctcctgccactctgctagacccttccgtagactccaccccacctcagtctccatgttgttcacctgccttctctccacatttctcctttgggcacccctctactcacctggtgcaggtagatgacatggagactcatctcggcagaagcaagttctgggagctgggccagcttctggcccccagtgcctcctggggacacagagctggaacataacatgaagcaggtcaaaagtcatgccctcctcccgccacaccccagaggactccccttctgaatcccccctcagcgccccagctccccactcctacaggatcagcccacccccctccacatgcccctgcatctcagcctccactcctcacctggggtcctgggcaattcgggaaatggaggcaaggaggctggctgtggccgcagctggacagggggctgtcgggctcagatctctcggaggcaggagagggtgcacgaagaggttggccaggaaggctcaggctgggtgcaagaggagagggaaagccaaagagggagtcagaagagaggacagaaacggagtagggaggaagcagaggcctaaagaaggcaggagagcaggctgggggcgggggctggtgaggcaggttactacctaaggtgagcctagaggggaagggtttggagaggagttgtgggggtgaaggcagaaggggaggccaggcttgggactcaccaggggcgaggtgcagttgctgagcacccccggggtggaggggccgcgagccgaggtggcaccccaggcagctgcatcttgttgtactcggccccagaggtgcccaagaaacttagagctgtgccctggggggcgccagagtggatgcgccagggagaaccgcatcaaagaaagctcagtcttgccgtcctccgcacgctgagacagcgaggcctcagtctgtcccgccgagagccactgtgagcaaggacagtctttcaggtgctaagaacactgagccttatgggaacaggtgggacaggaaacactgccccatcttccacgtgaaggaaacagaccacaatggggacttgttcaccatcacccaaaaatacagcagcagtgcagaacctgggcctgtcatctattcgtcacccctggactgattgccagctcggggatagggctgagcctcagtgctttgcccagggtgatcctgacagccttggtccaggcaccagtccttactcagccccacccaccggccaagcccattcctcacccccaggtggtctttgctcccatttactgacgttactatgtgccagcaactccatcataggctatacagacataatctgtgtgttcacaagcctggccttggctgtgctctggagagcacattgccattgttgccatctgacagacgagggcacgagagcacaggaagggaagtgacccgctcaacggcacaggtagcaagcaatggagccagggctggaactcaggtctgctcccgagaggcaagcgaactcccacccagcccaaacccccagggccagggaacggctctgacctgagggtgtccgtggcgcttcacatccataagggcaaaggaacagatgtccccaaccccagccacatccacagtgaagtgatgaaaaaagtcgataatctccagggcacgagggcggaaccagaaaagcagaaacagcggggtgaggagcggggacaggagctcctccaggagggagacctggggaagcagcggtgaggctgagcaggggtcgctgaggggcccacgcgcgttatcaggaccaagcagtccccagcgaccctcgccagggcaagaagcctccccacccagtcactccctagactcctggtatagtccgtttgtctcatgccctctcccagacagaccctccgcgcagacagaccctccgcgcagacagaccccacaacttcctcctcagcccgccgtcgcgcccaccctcaccgctcggtactgcagcagctgcgccatctgccggtaggcgcggtccctgccgccggggccgggctcctccgggaggtagtgcatgtgggccagggctgtctgcagcaggagctgcggcgcacgaccctggcactgctcttccggaatgaaagacctgaaaggcgggatccgtggggggaaggggcctgcgattaggaggacgcgcggtgggatgtagggctagagggccccagtggtgggagaggtaaggattcggggggaacctcacatggccccagatcagagaaaccaacacacaccaccaccccgggcatctgccgtcgcacctggcgacggtggcggtgaccccgagcgcggtcatggcggtgagcacgtgctccacggctagcacgtcctcgtcgtagacggtgagcacaagcagcgcggcgaagagtgcacccgcgaagaaaacgagctggcgggccagcagcgtgcgcaggggcgcggggggcgcagcggtgcgcaggaaggcggcggcggggcggtaggcgcgggccaggcgcgcgcgcagctcgtgcggcagctcgttgaagtggcgcagctgcaagcgcgccaggcgggaccagccgcgcgcccccagcgcgccaggctcgcgccgcagcagctccacgtggctatagaagacgtgcagaacctgccaggccagcaccagcgggctcagcgccaggttcagggcggccagcagcagcactgtgcgcccccagcgcgctgctagggcgccccgctggtcgctgcgcttgtaggcgtgcggcagctcccagcccccgcggaagagcgagaagggaccgcggaagagcagcaggtcgacattgagcgccaggccgcggctgaggaaagccgcactgcctccccagggcagcgggcagcgggccggcagcaggcctttgttggccagcgccacctggtagttggtgtagcgcaggatgcggtggtggatgtccagctccgtcaggggccgcggctgcacgcacaggcccccgctccgctgcagtgccaagaggcgggactgcacctctgcccagggaaccgagctcagctcctcctgaaaggggcactgatgagagccagcgaccccccattcctctccacagtgatgctcaagctccacacccctaagtgtgcggcctgaaaacccgcaaactgagtttgcgatcacaaactcgccatgaccaagctacatcgtccccctctcccacctttctctttctgccctcccttaaccctgtcactaacaagggcgcgccctacttccttcatcctcttctaaactgccctgttcatcatccctgccattcatgtggccagtagtcatgcacttcctggggacgcctccaggtgctggacctggcttctcagctccttaagggcctgaggccccctcagttgtacacacaaaacagactggctggccaggggcggtggctcacacctgtaatcccagcactttgggaggctgaggcaggcagatcgtctgagcttaggagctcgagaccagcctgggcaacatggtgagacactgtctctactaaaaatacaaaaaatagcagggcgtggtggtgtgcacctgtggttgcagctactggggagcagaggctgcagtgagccaatatcacagcactgcactccagcctgggtgaaagacccagaccctgtctcaaaagaaacaaaacaaacaaaaaaacaaaaaaccagaatgtctggcagttcgtgggagaatctctccttcccatttctagtgcacccaccaactctggaacagaatcctccccaccttctgcctgggcatgctttacactcccagccccacccgactccaggccatcttcggctctgtcaccagaagccttcccaggacctgggctatgtccacatctggcagtggggcactgtcagatctcatttgaaggctgcaaacctcacttcagcccagtttcactcagctttcccagtccaggttagtcaagtcccccaggctggcctctccagtacatcccagtgtcttcccttcccttcccctggaaggaacaggggaggaggggaaagaagggaggaggagaacgagacgggtgagcagtctcccgccagagccaatccgaggtccagcttccgctctcaccacctctgcttccccggcctcctccctctcctctgctcaggggccttctaagacctctccccttgctgcacataaaggctgtgcagagggctccggacctcccaggggagcaagggaagcaagctgcagaaggctactttcaagctgtgcctcaaagaaagaacttagatacagaggagggaggagcagactcaagatggtgaggaaacaaagggcagagcataagcagtggacagtgacaggccaatgcagtggcttcctgcaatgcgggggatggctttgaaggctctgttttaggctgatgggtccatctcctcactgcagcttccaaaagctcatggcttttccccaccttcctgcactggggcttagaatgtgctcccctcccctcctgtcctgcccttccgaagcccaacccaaattcctccagctctgaaaagccagataactgccctttctcttttctctaatcaatgtttttagcacaaacatgtaactatatgtcatcttatatgagccatctaaataaactaaactcccttagggtaagggccatgctctctaggtggtggtagccccctcctgacattattctgggcctagggcaggtgtcaataagacctcgctctttctgccctctttccagttggcccttccacctgtacagtcccacttcttcccctctcctctgcccaccctctcacggcaccctctgcacagacacagccacccagctcaccggggggatgtgcagggcctccctgtaaaacacctggatgtcccagtagctgaagaggttgcagactgagcgaagcagttggaccagccagaagccggcagccaggaccaggaggaggaccagcagcgggctggagcggatcctgtatggggttgggcgggcagtgggggagaaaggtgggcgcctgagaaagaggcagaccagacttcgggagtgaggaaaaaccatcatgaggagggggatctagctagaccagcagctctcaaggtagagcccggggcagggggtgggtgctgaagtggccttcacaaatgtgcaaagtcaaactttttccaaataatactaatgctttctgatgttttcattcttgtactctgagagtacagtggagttttccagaggctacaagacacgtgaacatgtcacatcacactgacagctgatgaaatgtgtgcttgtacactctttttttttttttttgagatggagtcttgctgtgtcgcccaggctggagtgcagtggcgcaatcttggctcactgcaacctccacctcccgggttcaaatgattctcctgtctcagcctccagggtagctgggactacaggcgcccgccaccacacctggctaatttttgtatattttagtagagacagggtttcaccatgttggccagaatggttttgatctcctgaccttgtgatccgcccgcctcggcctcccaaagtgctgagattacaggtgtgagccaccacgcccagccgcactcttacattttaaagttgttctcagctacaatttccttcttttttttttttcctttttattgaaacaaggtctctctctgttacccaggctgtagtgcagcagtagaaacatagctcctatctccctgccaaataacggcccaggtctggaacagttatttggttggttggcaaagagaacattgcaatccatgcttcagggaggaaggttgtgaaggcaacaatgaaaatgaatcgtctgctgggagggaggagggtgtagggatgctgcagtgatcagagacagtcactgtcttagcctcctgactaggcttagctaggactgcaggtacgcaccaccaagcccagctaatttttattttttatagagatgtggtctcactttgttgctcaggctgatctcaaacttctggcttcaagcaatcctcctgcctcagcctcccaaagtgctgggattacaggtgtgaaccactatgcccggcctaattttaattttttataaggtaaaatgtggatagatacgactcccataaacaaaagcttttcaggattctcaaccaattttaagtgtattaagatacacttaatgcactgtaattaagatacacttaaaaggccgggcacagtggctcacacctgtaatcccagcactttgggaggccaaagtgggtggatcacctgaggccaggagttccagaccagcctggccaacatggtgaaaccctgtctctactaaaaatacacgtggtggtgcacgcctataatcccagctactggggaggctgaggcaggagaattgcttgaacctgggaggtggaggttgcagtgagccaagacctcaccattgcactccagcctgagcaacaagagtgaaactctgtcttaaaaaaaaaaaaagatatacttaatacactttaagtacaacttaatacacttaagtacaacttaaagtatattaagtgtatttttggtcctaagaccaaaagctttgagaactgctgatctagatgacgggacaaagtggggctcccgtctactcctctacccactgcccatgcttcacccccagggccccaccaggttgtcactaacctctcagcacactgggctgagggtaggatggcatctgacagggtcactttgctgtggaacggcccaggtctggtatggttacttggttggttggcaaagagaacattgtaatccacgcatcgaaggaggaaggttgtgaaggtgacaatgaaaataaattgtctgccgggaggaagggggggtgccgggatgctgcagtgatcagggacagccaggtgggctcctgccccagcccccagagcagcccatggttatcctccctgaccctgcccctgctgagcccttgggctgctcgggaaagcatgggatggaagcagctggcacaattaaggaagcaaaatgacagaaggaagccatgggcccaggggaccgagttccgggcccgggctaagcgtctcaccccagctggaagacatcctccagcaagatgcaggcaaagccattccgctggtggtagctgtagatgtggctgcgtgtcaaggaacaagcctgaggcacggggggcctctcctgaggacacctcccctcagccccaacaagtctcccacccatgacgccctcacggagtctccctgccaagaacagtgccagctccaagaggaccttcccatgccacctctgcaggcctagcgcaaaggatatcttggtgaagaaactgtccaggttctggatgtgatgccaggagcctgggcacagaggggagagtgtcagcccctggcatgtgatcaattctccacgttctcaacccgctgccagaggcccagcctgggataagtactggagctcccaggcaccactaaccctctcccacccacacccacacacatacctcggagcccttcagggacatgaagcaggggttgctgctcctccccgtggatgggtgagtcttgggacccctcagggtcacagtcctccagccgctcataatcctgttcagggatcaaagggcctacccgcagcccaggagagtcctgggggcactgctgtgagggagtgggggttgccggggccaggggtggggtggagtgggatccccaggagggagatgcagaggcaggtgtcattgcaggttgagcctgtgttgggggggtggctgggatagggagagcactgtggcaagactgagaagcccctgtcccctgtagcactgagcaagggggccctgcggtgggaggggaaaatgaggagggggagcttcttgtatgaggggcaggggacagagagaagatggagatcctccctcccccaggtccccggcatgaaggaggaggaggaggtggcagtggcatggggaggaggggcaccgatccgggccccagatctccccaccgccccagccgccttcttctccccccccagcccattcggctcaccatcaggccacggcttctccagaaaggttggaaggatgggagctgttgttgcttccacaaaggtctgtgacactgagctgggacttcaacaggaacaatgacaacaacattactaggtgactcagcctaggcaggcctcaggcgtcccagctctcagtcacctgtctga

SEQ ID NO: 1152 - DNA, 74966 bp, Homo sapiens
tgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctcttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctagtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttggaggaaggagctggttcttaacagacgttcaattaggtcttttggctttctgtgttctttcaagcttcttccttttcctttgtaaataatgttagtattgaaagaatagattttgccaagtgattgtcttgtgtctgctgcccacttggcatgaaggtaactgctggtgaattgggggaaaaaaactaaacatttagaacaagcctgtccaacccacggtctgtgggccacatgtggcccaggacagctttgaatgcagcccaacacaaattcttaaactttcttaaaacattatgagatttttttaatgatattttttaagctcatcagctattgttagtgttagtgtattttatgtgtggcccaagaccattcttcttcttcctcttaaggcccagggaagccaaaacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctgtgcactcggcgcagaccttgacacttaggtccaaagcgcgagtgctcttcgccaaagcttgtctgcctgggctctttcctacctttgggtggtctgttcacaatgaccctttctctgaccagctgattgaaacctgccttctgattgtacctgggtaattggaacagaaccaggagtcatggttagcttgtagggctgcctgcatggctcatgagcagtataactggttgttaacggtccctgtcatgtgaggttttgggggtctgcttcccagacgagctcactgtgcttggacctactctatgcaatggataatcgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgttagctccttcccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagtcctcctccgggcagctgtgaataacactccgagagccaccccgcaggcagcttccctgactgtccaggggcctcgcgtttagcgtggactcagtacatggtgggcaggggcgagtgctagcggaaactgggtttgctttttgttttcatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatacgttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcgaccttcccaccggtgtccgtgcccttttctgttctgcatgagcccgggaggtgtgctcctctttctggccttgctgaggaagcctcctcagtctgttaattgtctcttcctgggtaatctctttattagagaaatcttttttttttttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttccatgttggtcaggctggtctcaaactcccaacctcaggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcagtggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctacaaaaaaaaaaaaaaaaaaaaaaaaaattagctgagtttggtggtatacacctgtggccccagctactccagaggctgccgagggaggattccttgagcccgggaggacgaggctgcagcgagccgtttgtgtcagtgtacctccagcctgggcgacagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtagagtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgagcagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtgggggatagtggaggagtagtaaattcagggtccctgcatcccacgagctggcggctgcatctcacttcataccttcactgtttttgtttttcccatctgtgtttgatcttgcctgtagatccttggtctactgttatagatgagaaaaatcagtctctgctttgcaatattttgtatatttttctgttatgccagagtgaggacttagaaaattaaattagaaatatttatatttgccacacctttcttcccttttgggaaagaatcctgttgagatagtgacgattcagtgttagcacttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggctgagtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgccgaagatcatagtttgtggtttttttctttcaggcggtggaagcagggcagagccgaagcagcccgctcctcaagaggccggtgcggacccaggcggtgctggaccagtcagatgtgtacacccatgtcctgtcagcctttgtggaaaagaaggtgggctgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatgtgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcactttttacttttgtcctcagcattacctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgatcattctcattttttttttgagacagagtctcgctccgttgcccaggctggagtgcagtggtgtgatctcggttcactgcaacctccgctgggttcaagcgattcttctgcctcagcctcctgagtagttgggactacaggtgcgtgccaccacacccggctgatttttgtatttttagtagagatggggttttactatattgtccaggctggtctcaaactcctgacctcatgatccgcctgcctcagcctcccaaagtgctgggattacaggtttgagccaccgcacctggccctggttgatcattctcatctccaaatagttatacaacctaagacatcatctttaggatagggaaggatcagggctgtctaatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctttctttgtccctcatttcatgccacatctaactggcaattaaatctcttcctttctaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagcctaacaagtaggtgggactgcagacgcacaccacttcacctggctaattttatttttgtagagatggaggcctcactatgttgcctaggctggtctcaaacgattctcctgtctcagccttccaaagtgctcatctctttttttttttttttttcttaaaaggaactagtatattagattgtaatagaactactttctatcccccggagatgataaaaagcccctcattttcttaatcttctacttcagtgcttcaatttagtgacaaagctataaatgaagcaaatcagtattgttctttcaaccgtgggtcatttttgtgcaaggtgaagtggccatagaagtaaaaggatcaaggacagtctcgagatgaagaaaggcagcaagcactttgctaagaaacgggaaatccatgagggacataaaaagctgttctgcagcactgctggtgtgagagctggctgccagatggactccttcatctcagtggcagggaggagctgccctgcctgctgacactcagatccattcaaggactggctccaggcctttgtgaagcagacagatcaggcctccagaaaaaacatcgacaacttcctaataaagtagtctgcaccatcatgaatcccctggatgggttttttcttttagaagaaatttttttactcagtatcatttatcattatcaaatgaccattagtatgagttcaaatacttgaaaagaatgcctcaggatagaattccctttcagtaatgtccttctattgtgccacccttttaagatgagaactcttacctatgtaactgagtaagacagggagaaatattaatccgtgagtggctcccagtaagaccatggccaaatacatcctgaagtagaatatctggaaaatttgagatttggcaaaagccaacaccacaatccctccaaattttgtaagtgtgattccactgaacacctaaaagaagagatactgtgttagaaaccacttttaccaacctgtaattgaacaaaaacacttccttacaaggatttctcccaggttcaagtgattctcctgccccagcctcctgagtagctgggattaaacaggtgcacgccaccatgcctggctaatttttgtgtttttagtagagatggggtttcaccatgttggccatggtctcgaacccctggccgcaagtggtccgccagccttggcctcccaaagtgctggggttataggcatgagccaccgtggccagcccttatggggatttcttaatattcaaggttcaaagcaatgggaactgaacccaggtagcatcatctactacctaacactatttgctgccttatgatcctgggggagaggtatgaccaagttaaaagctgtgtattctgcacagacactgcatcgtgtctcccaattgattatctttctttatattctcaggtgaaaacttaaatatttaaaagtgttacgaaacaaagttttagtttttactctttaccaggtattttctacagtggtaaagagataggctaagccagggtgtagagttgaaccaagacgactctccaggcaccaaccgcacatcacacgctgggttctggcccgggctcccctgcattttaaatgggaaagactgccagctgtctcatgtttaacttgtctgttattttcctgcttcagcacactgccacctaaaaaggagccgtaccaacaggtacagttccacagaacgtccgttctgtccacgatgtggcagctaattcatgaattgcctgaaagcttgcaatccttagaagctgctttgtaagtacaggatccagactcttcagtcactgaggaggattactttgtggtgcgactctgccggcgtggccctgctcagggtactcacggagctgcccatgtgggcaagtgcctcttccgcgcgctccacgcggctgcctttcatgctcaccgtgaacgctctggttatgtggctgcagaactccacggagatgccacagctctgaaataaagcacttcctttaggatggctctcttcctgttgaagaccctaggcagccaccccgttctgaggatgggtgctaattacccagggcaccctgggtgctagaggaggccaagcatcccattggacttacaaggcctccatcacaccaatcttactgtaccaggaactttttggggccctctctacacacagccaaaagcctggttttctgtggcacgtttgtgttgaccaggagaaattgctggaacccgttaaggtcaccccacccgcaccgagctggcgcattgtcacaacttcttttcttggacctcagtgctcccctatctgaagcagggctcatatctgagagtacggatacactgttctattttccatgaataccttctcaagtgctctcatctttaatgattaaaagtacctgataaccacataggaggcaaaaggcactggtcggagagctcctggggcggggtgcaattttctaagtaaaaagtgaacatcctgctgtcatcaggctacaggcttgtgcaatctctaaagaataacaaattacaggcagactagcccagaactaggccaggaaatcacatttccatggtcagaggcaccatcaggtatactagtatagccgcaaggaatgggacaagagaaaaaattgaacagaaattgcctgtaatgtgcctatgctcccagatgtccaactcaatgctcgctccctctatgccctgtcccaccaccatccagcactcctccagcactcatcctgcctctccatgtgtgccaagagcaagcgccagacttggtatcttactccatctttagggtttacatggaatctaagacagccaattcccccaagtgaaacaggagctagggacaaactgagactgtatgaggactcaccatcaccaggttgaccaaggatacagcgttcagactgatgccccagagccacataactccaaacatgttgaccaagaccatggcgatggtggcacacatgatgactgcagaccagagctcacagcccaggaggaccatggtcaccagaaatatcgcgcccagggacacaccgaggttgaagatagtgtcgtcaatgatggtcaggtactgttcgtagaagacataaaacacactggaggggagaggggaggcctcattaaagctcgctctcactcccgaacactgcgtgttcatcctgtcaccactgccaagtggtcagactcctttgggaaacatcccttgcagaaaaccttgctggctgtctacaagactcaccgaaagcaactcacttgacctctcatggccactgaccacccagagaagggcccagcagtgatgcaaaatgtatatttttgataaagtttctgtttataagcccaatctatgctattttatagacatttacagagagcattccacagcattctgaaaaaacacaaaaaaacaaagaatcctgatctatcctgagacactacctcaggctcagcggggtccgtgcaaggcctgaggaaaacatgctttcatttattttctgccagagctaaccggctcttaacttcttccaaacaaatccaggccttcctgctttaagcgagatcatggggaggcaggaaaaataaatcacttgtttctcctacctttctacagtttctaaattcagtagttcatacataatacttttcttcctgggaaaaaaaacccctaacaatataaaaagtctacatacaggcagcatcccaaataaccagcagttagggattctggttcattgttggccaagaatgtgggccgggccctgctctgagccgcctgctctccaagcgccccctgccttaagccattttccagtgtgtgtctcttgcagctgtgcagtggcgcagagatcaagttttgcgtctctagccctcaggccttcacagagactttagattctgaactcctttgcccagcacccatttcctttgatatactgccctgtgctcagaatggagcaggggccagaacccaacctgaaaatcagcatcttgccaagggaaccctccccactcccacccagtgtaggccctttgctgggtaaaccccattgaaaaagggcaggctttacctgtaaggaaatactcggtaggcactgccgttaatgcccatggtttcggtgacattactggctataagtcgggctttcttcagagcgtcaataaagtcagcagaggtctgcagcacggtgtggtaggtcatgaagtacgtggctccgaccctggtgccatggccaaggaggatgttaactgcagaactataggcagcatgtcccctgaggaaagaatcctgggtgtcaagagagtccaggtcttgcaaaatatcagcagaatctgagcacttgaggctaagcaaaatcacctgaccctggactcagaggtcagacccagctgtacatttcagggatgaagaaggcccccagataagggaacaccaaaggtttagcttgttctctcccagactggcttctttttttttttattttgagacagagtcttgctctgtagcccaggctggagtgcagtggcgtgatctcggctcactgcaacctccacctcccgggttcaagcaattctccctgcctcagcctcccgaatagctgggattacaggcacctgccaccacgctcaactaacttttgtatttttttagtagagacagggttttgccatgttggcctggctagtcttgaactcctgaggtgatctcaggtgatccgcccacctcggcctccaaaagtactgggattacaggtgtgagccacttcgcctggccagatgggcttttctcgattgctctgggttctttggtacatagctgctgtttctccacctggtttcatgtataatcaaaggtacagggtttactcagtcctgttgtgtaataggaagcaggaaagggcaagggccctgggaacaacctcagccctgccacttactggtcatgtaaccccgagcaaaatgaccacctctgagccccagtctcctcttctgtaaatgggtataccaccacctactcataggctgcgtgatgagaaatggaataatgtcagggagtgcctggcatgacgctggcaccctggaggctccccaggaacggtggctactgccttcagaaaaactgaatctacttcaacttattttacgtaggccaaagcatccagtcagtgagtaaatcaagctgcaagattcatttctacttaacttttaggaggagtcatcccatgatacctcgaataggtctcaaagcacatgcatgatataaatgattcactgatatgactctggtcagatgtatgttcttatgaaaaacctaagttcagggtttacctaacatacatggggatactcatcttccacctcccaaagcttccaaatcaaggccagagacttccggtcatcatcactatttttgggccatatatctggcttccgtgggtaactggctgcctggctggatgggggagtgagatagcccataaccctatacatggatgggctggcaaggagcatgacgaggctaaaagaatcgcaaccttaatgtgggataatgttactaaagctaagatcacgccccagctgccatcagtacaagtgaacaggccaagttccttcaggcctggattaccagcaggccgtcctctccctcagccccgcttggaatgtgcacaggaatctgcgttcattctcatgcccagggggccaggacacagagagagcatgagatgtgaatgcccacgctaagacagaatcagttgaacactatgaggcattttcttaaaaaggtgttttcggttttcctgcttccaccaaaggaccaggacagggtggggcggagaagagacgttcccatgcaactgtcttagcccagtcctctcctagttttctactgcaaattaaagttgcagtggatgcttatctgcaatggcagcagcacttaccctttgccacacttggggttagggttatccgaaaggaacatgggcaggaatctcatgaagtctcccccctgaggcctctgtttgccttccggagtcagaggcctgcagcgaacgcaggcagggtcaaccactggcggagacatgcagggaggactgttagaagaataggtctccagattttttgtaaaacattttaaaatactgacagtgaggggcattactttcttctctatcgattactttccttactagtgagggataatctttccccttatctaaaagcttcagccacatgtcactttcacagtttaatgaatctgaaataccattttcatcttaggcatactatgcatcattttctgccctgaagtagatctcctccttcaagtatggccttgactggtcagagcccggggcttctatgtttttattaagaaaattccagggcaacctcgacgctcctacaaaaccacagggtaaagtgataaagaaaagccctcctctgagaagctaaggccagataccaatcctgagaggcaatcgctggagttagaacaggatgagaaaccttatgtggaaaccacactccgaacatgtggaccttgttcagcttgcagccccgagggtggctgtctgagccaggaacaacatgacaatttcagaatgaatgactgaggaaaggaatgatgacacagggagacccagctttgatatacaaataggtataaactgaggcacgatgcaaatgatttttaaatgataatttgaaaatttttcagcaaaacaggaaagatttggtaaaggagaaggtacctgaagcattgcagaactggtcagtgatattgtccactcgacagcaagacgactgtggcttcacccagtcgaaataatcgtcgatccaggacgagggggcgaagcctattcgggtactagagaggacagacagggttactgacctgctccacagggaggaagtctttagtttcagtactttttcttaaaacctaacttccttttctacgttttatactgctaacagtcaaaagaaaaactacatgagcacttaatgaaaaaagccttcaaagtattaggtggtaaattagtcctttcaaaggttttttaaggtaaagccagatttaacatacattttgcataaaaacaacttttccaagaaagtctattttcagtgagacatttcaggcctgagctgactgcctggctgagagcctcctccgctgcttctgaagtacaagacaaggtggtactgactagttgtccagctgcgccgcgttaaatatctgctgcaccagggaatcattgttgcagcccatgccgccgcacaccatgttctgccccttggaagaagtgtagtcgtgcccttcctccaggacaaagtacacaggcggacccgcatgcaggtactgactgatggatttgaaataatccaccatgtaggagtcctgaaagaaagataaaagaataggagagagtgtgaacactctgatagtaactaagcaaggcgaggatcatggagaataagagggtgccaggaggttcctggctgagatgcctccagctggactcatgattcctaacaccaccagtcttccccccagggccccagggtgctcctcctgctagccccacaatcaggagagcatctcataaagtaacctcataagactagttattcgtgttctgcagctgtgcccagaggggctcagtcagaatgccagacagcccacaccagcagtgcactgcgacagttctcctaaccctggaaaccctgtcaccatttgcagttagaagcaggcacttgcttgaaacacctacgtgcatgttttgaaaaatgtattcatcatcagctaaagaagttaaaaaaaaaaaaaaaaggaagtcatcttacatctggcatcgaaagagactgatccaatccaatatctactttgttcaggactgcgatgctgaatgacagaacacccacaaatattgctatctggaacaacaaatgaatcataagacagagactgcttagtaaataagcttacgaccagaaataaaatcttaagcacacacaaaaagcaggattttttaaaatggaaaagcttaaatgacaggctaatagggagtacagggcagtgggtgagaccacagcaccaggagtccaaattcctgggtgcaaatcctgactctgccacttacgggctgagtgacttggggcaaaccacttcacctctcttggcttctatttcctcattattaagaggaaaaataaaagtttctttgcaactttctgtgaatctgaaactatttcaaaataaaaaacttaaaactcttgtttatatggactgataaaagctcacaggaaaaacattttatctactgttccacatttgcttttgctttttttttagatacattttaacagctttaagaatctccttcccaggctgtctggcttcttagaaggcatgtgataatctgtttcagtgagaggaaagagaaaaaccacagataagcgcataccacaattggtctcatccagtcctttagcagaagtggagaataggagtttttgaagaagcgaaacaaacagctctctgaggcctggacgcttgttccatcttcagcacctctgacacagcaaaagatgtctagccgatttttctgaggggacagagggaaacaaaggttatacccgctagctgcttcctctagattctagactcaaattaaatagactataatcctggcaccaacttacctcttgacgtttaatgtctaaccccaagagactcacgaaacaggtaatctgcagaagaaagtcaatgaagactgccaatcccgcaaagagagagaaggtgtgcacggctggcatcacggacaatgctcctgtcggggagagaagggctctgcgtcacttctgtttacagccgggggctctctgcaggtcttatgttcatgtgcatgtacagatacaaggagccagcacaggccaaacgcatgagaaggcatgctgcggctggacattacaccagaagtgggacaggaggtgataagccagtgcttttcaaagcacactcagcaccagaccatttgggaagccccatcctagttatgacaggaattcaaccccaattctactatactcaggttcacagcaaattcacacacattaaaatttgagaaccactaatacaggccatttcttatagtactttctgtgcttcactgtaagaaatggacagtattttccatttattacatcaacactactagcctcccagtttagttaagaggtaatctacaatcgagtgaggatcaaaggcatgagggtaagacttggaaactgcaaactggcagcccatgaatcagatggttcctgtttagcccacactgtatcaacccatcttaagattaaaaaacttttttttataagttgccaatatttaacaatggcattttacacaaaaatctagattcacagctttgcttggaagaaaaacaacaacaacaacacagaccttgtagcactgggttggccacacacataactgtctttttagataggacacgtgcagttggggtgccacaatccctactcactcctactgtcccaaggtcactccaaccttgaggcacagtctctgctgctattatcatcacacttgcactggttttcttataatagtagtgaaaaaaagaaagttttttcttttttttttttttttctgcacctgtgtttgtcaaaaggaactacagggctacaggtttcaaaagcacatggctttgtggagatgaagaataacaagctagcagtgtatctgtggtgaaagactaccacctacaatgaccttacaatggccctgattaagctgacctcccagccatgtaggcattgcagtttgtggcccgtggatggtcttctttggactgagtgattccagtccagcctcccctatagtggacagagtcactttgctcttactacacttcagacatggggcagacagccccactagtgggtctatttgatgattctctatgtgaaagaaacacagaagtgctgactttgttccagcttattctggctccttgtaatgtggtgagtcaagagcttctggtcattaacaaggctgcttccccaatgagttgtgtgcacagaagagaaagactgcctttgaaaacaacggcaaacatcttgtaagcgagtgcctgtggatttgggagctgctgcttagagtgtcatgtggagaaggattcagtggctactcaaggatgccattttcaactatcaacattcccagtggctactaaaaggggaaagtggcaagacgaactctaggtctctttcaccctgaaccccaacatcaatgctgtcctgacagttaaatgagaaggaagccacttgcaaaatcacacctaagttactgctgccaatttttctgtggtccagtgatactttcccagtgcagaacaaagcttaaaaaaaggagacaacacgggctgggcacgggggctcacgcctgtaatctcagcactttgggaggccgaggcaggtacatcacctgaggtcaggagttcgagaccagcctggccaacatggtgaaaccccatctctattaaaaatgcaaaaaattaactgggcatggtggtacgtgcctttaatcccagctatttgggaggctgaggcaggaaaatcgcttgaacccgggaggcggaggctgcagtgagccgagattgcaccactgcactccagcctgggtggcagagtgagactccgtctcagagaaaaaaaaaaaaaagaaaaaaaaaaaaaggaagcaacacaaagggacatgttcaggtagccagctccttctttctccaggctcagcagactacaggactggtaggattgaaagcataattacctaagaaaaatgctacagtctcagaaaaggatgacaggaacatactgggagccacttctcctaggaccctgcccagctgctgatccagggtttccccttgaagacgttcatctctcttaaaaaaaaaaaaaaaaaattatgcgacattaaaatttctcaataacaacgccatttcttgctgccttgtgttaactcaagggtaaaaataaatgattagtagacgattagcagtgtcttctaagcatataaacttcggtgggggactccaatgttctcagagtatttctgcactacagagctaggtaccaagtgagaaactaaagggaaagctgagccagccacattatcaggaaaacactcggaacacaggcggcaggggactggaccagtgaacatcactctcacgtgcactgagtctccgcccacgtcgggtctacaggacgactgagaccaccttctacagcagcgggacacgtgttgaccttttgcctttttagtggcacctttgggcaaaatgaatctaacattctatactatgctgaacatcattttaacagcagtcgtacccaaaatcttttccaaaagtgtgttagcccttcttgtacacatgatactatttaaaatgaaaagatactattaaaagacactatttaaagatacaatttaaaacacaattcttactttatatctactatttcaacaaccaaaaagaggggtgaaattcttggtcctaagatgtccacagcaagtcaagacgaccgatgagccacacagggaaaggaaacaaaacaccctcacaggtcacactcacgaatgcggagcccaggagccattcacagtccctgaaacttgaacagatgctgagccctgtgagaatatggaagtatacctggtaggcctgcaccagaatgaagatgttgtccactccaacagccagcaccaggaacgggatgacttcaatcacaatgagggtcaagggcaacccaatgtagctgaagacacccaaggagcaagccaccgagctcagcacgatcaagatgcccgcgatgcctagtgagaccttcgaatccacctgagagaggcgacagacacaatcaccaattagttacagggttgtctgtcccacttgttactaaaaggtcctcctttttactttacagggctgtattaaacctagagttgaatgtacaattctgtgtttcagagaggacttgtaaacatttctaggtctgctcgggcaacacatgttatgagtttgcattcttaggtgatggactggacaaataagaaaaaactggattatgtgaaataaactttaagataaaccaaaaagttggaatgaagaaaatagatgtaggcaacagaaacgttacatacaattaaaacatgggggaatttatggcagttttaaacataatggaataagaataaagaggcaaaaatatgacgttacactgtgcactgctgttaacctctagaacatacaccacccccccccggcttaccagaagcctgcgacagcttttcatgtgccccaaggctagggaaatatatagaaacatgatggcatagctaattacaacggtgaagacatcactgtcactttcacgatttagttcatcttcaatacttcgttcagcagtgaaggaaatggtcagattgggattcttgtagtttttcacaaaattaataaacctaaaaggtaagcaaaatgttatatttttagttaaactaactgacagctaagtaagaaacttctccctaactttcacgatacaaaggccacgttttcttttttttggttttgagactgattctcgctctgtcgcccaggctgaagtgcaatggcgcaatctcagctcactccaagctccacctcccgggtttgagtgcttctcctgccccagcctcctgagtagctgggactccaggcgtgcgccaccaggcccggctaattttggtatttttagtagagacagggtttcaccatgttggccaggctagtctcaaactcctgacctcaagtgatccacctgcctcagcctccccaaagcgctgggattacaggcgtgagccactgtgcccggctcaaaggccatgttttcttaacctttatcctgcattaggatcctttgtttgcttttgttcctgttttgaaatagagtctctctctgttgcctcggctggagtacagtggcactattacagctcactgcagcctcgaactcctcagcttaagggatcctcctgccttagcctcttgagtagctggtactacagagacgtatccccatgcctggctaattttaaaaattttttgtagagatggggtctttgccatgttgtgcaagctggtctcaaactcctggcctcaaggcattcctcctgcctccacatccctaagtgctgggatgacaggcaccatgcccagccactgcattagggtcttccacactggagactatcagattacagctaaggttccatacatgctgaattaaagtaagtttagggctgggctcaatggcttatgcctgtaattccagcactttgggaggctgaggctggcagatcacctgaggtcaagagttcgagactagcctggccaacatggtgaaagcccgtctctactaaaaatacaaaaattagccaggcgtggtggaaggtgcctgtaatcccagctacttgggaggctgaggcacgagaatcacttgaacctggaaggcagaggctgcagcgagctgagatcatgccactgcactccagcctggatgacacagcaagactctgtctcaaaaaaaaaaaaaaaaaaaaaaaaaaaaagaaatgcattcagtctactaaatcaaaaccacaatgagataccacttcacacccatgaagatagctagaatcacaaagtcagataataaaaagtgctgacgaggatgcgaacgaattggaagtttcatggactgctggtggtgacgtaaagcgctatagccactttggaaaacagtctggcagttcttcaaactattcaaggtggacttaccctatgactcagcaattctactactaggtatgtacccaaaagaaatgaaaactcacatccacaagaacttgtactcaagtgttcatagcagcattattcataatagccaaaatggaaacagcccaagtgtttgtcagttgataaatgcacacaatgtggtatatccatacaatggaatgaaaaggaatggagtactgatacatgccacaacatgaatgaaccttgagaatattatgttcaatgatagccagacaaaaaagtccacatattattctatgcacataaaagtccagaataggaaaatctccagagacagtattttagtggttgcctagggctgtggataggaggatgaaaagatggagggtgttagttaaagggtacagagttttattgtggagtaatgaaaatgttcctaaaattgactgtggtgatggctgcacatacacgtgaatatagtaaagctactgaattgtacgcttttttttctttttaaattctcttttttcttttttttagagacatgcaaacattgcctaggctggtcttgaactcccggcctcaagtgagcctctcgtctgggcctcccaaagtgctgggactacaagtgtgaaccaccattcccagcctgaactgtatactttaagtgggtgaactgcatgatacatataccatatctcagtaaaacaattttttaaaagtactggagggcataaagtgcaacctggcctcctaagtcctctcttcccattctctagaggtcacaaacacagttaatttctgaggtcatttgcttgatatttttttctaagcatggacagcagcataaacaatatatatttatacaaatatacatcatggaccatttacttcactgtcttttatgacagcacaatattctattgtattcattccttattaaatacattcagcatgctcccaagttttgctgttagaaaacaatgcaggtggctgggtgcagtggctcacacctgtaatcccggcactttgggaggccgaggagggtgaatcacctgaggttagtaggtcaagaccagcctgggcaccatggcaaaaccctgtttctacaaacaaatacaaaaattagctgggtgtgatggcatgcacgtgtagtctcagctactcaggaggctgaggtgggaggatcacttgagcctaggaggttgaggctgcagtgagctgagattcagtcactgcaccccagcctgggcaaaagtgaacccagtctcaaaaaataaatgaaataagtaaaaacaatgcaaggaacctttttttgcacacttttgcattcctgtggagggagagctgtttaaagcacctgctcaaaggtaaatgtgtttacagtttcttcttagcatcattagtaccaagtgaacaaaactacgtaactcagatctgccattggttaatttagaaaatgaagtttaagtgcttgccgcaagtgtctagcttcccacaatgcaaggacagtctgctcacacccatgagtgactcactctttttcccaggcctgggccctctggagcttctctgtatcattatagtaattattgacagggaaggtaatcacaagggcagtggcgttattgtagttttgatctagaaaggaaaaatgtgacatcaaaaagcagattacaagcatgcagaaaattagacacataccaggggaaaaatcacaacacagatttctcactggagctatggactgtatctctgggctctaagaattaaacaagagtttgctgaaatagtctttatgtacttcagttaatgaataaaaaggattttttatctgaggtaggcatggttatcattcaggaagagtaactctttttttttttttttttaaaggatacagtacatgcatgttaacaatttcaaacagaacagaaaagtgtttatcgaaaattctctccttctccaacatctgtttcattgtcttagttctcctccccatactgtgaccatctgcgaatctttccagagccactccacacacacacaagcaaacacacagattcttcccctttccctcttaaccacacaaacagtaaaatactattctgcacattacattttaaaattttgtatcttggagactgctccataaagagtttccttattcttttcctacagtattttctggtatactttagccaatcccccccaactgatgagtagttttgcaattttttctattacaaagttactataaatagcctataaatattttaatgtgtaaaacacatacttgtagaaataaatcttttttctttttttggggtgggggcctgacagggggacagtgtcttgttctgttgcccaggctgaagtacagtggtgcaatcgcggctttttgtggccttgaccacccgaactcaattaatcctcctgcctcagcctcccagtagctgggactaaaggtgtgcaccaccattgctggctaatttttgtatttatgtagagatgggattttgtcatgttgcccaggctggacttgaactactgggctcaagcaatcctcctgctttgccctcccaaagtgctgggattataggcatgagccactgcacctggctagaatcaattcttaaagcataatcaatgaatcaaaaactatgtatatttccaattttgataaattctcccaaactgccttccaaagaagcttaactatttttcattcctttttttcttcttttttagagacaggatctcactctgttgccctggctggagtgcagtggcacaatcatggtttactgaagccttgacttctcaggctcaagcaatcctcctgccttggcctcccttttcattactttagtcaagaaaatatttactgaggctgggcgtggtggctcatgcctatgatcccagcactttgggaggccaaggtgggtggatcaccttaggtcaggagttcaagaccagtctgggcaacaaggcaaaaccgtgtctctactaaaaatacaagaaattagctgggcctggtgatacatgcctgtaatcccagctactcaggaggtggaggcagaagaattgctcgaacctgggaggcaggggttgcagtgagccgagatcacaccaccgcactccagcctggacaacagagcaagactctgtctctgaaaaataaaataaaaaccttttttttttgtatttcttcttttgttatctttcacatgacctcacccacttttctttcaggttgttgatctttttttcacaacttttttttttttttttaagacggagtcttgctcttgtcgcccaggctggagtgcaatggaatgatcttggctcactgcaaactccacctccaggattcaagtgattctcctgcctcagtctcccgagtagctgggactacaggcacacaccaccacgtgtggctaattttttttgtattttcagtagagacagggtttcacattttggccaggctgagatgagatctttatttattaagaaaatgctgactgccatgcatactaatatttttgtccagtttttttttttttctggcaaggtctcgctctgtcacccaggctggaatgtggtgcaatctcgcttactgcagcctcaacctcctgggctcaagtgatcctcccacctcagcctcccgagtagctgggactacaagcatgcaccaccatgcccagctaatttttgtattttttgcagagacggggtttctccatgttgctcaggctggtctcaaactcctagctcaagtgatgtgctcgcctctgcctcccaaattgctgggattacaggcatgaataactctcggcccagttttgtttttttaactgtatgtttgttctccacaaatgaacatgtactcaacttcatcagtctttccttttcgggcttctgagttttgtgtcttgcttagaaatatcttttccacttaaaaattatttttaaaaatgcctcctgaattttcttccagttcttacatttcttttttttttttttttttttgagatggagtctcactctgtcgcccaggctggagtgcagtgacttgatcttggctcactgcaagctctgcctcccgggttcacaccactctcctgcctcagcctcccgagtagctgggaccacaggcacctgccaccacacccagctaattttttaaagaatatttttagcagagatagggtttcactgtgttagccaggatggtctcgatctcctgaccttgtgatccacccgcctcggcctccgaaagtgctgggattacaggcgtgagccaccacgcctggcccagttcttacatttcaatcttttatccatctggaatttattttggtgaaatgaacaagtcagagatcaaagtcaattgtttcccctatggctagtcagttgctgacaccatcccttctccaacaattagaaatggcattttcctctctgatgcacagtaaattttaaatacagattgcaacttctcccctgccaccaagtgaggagaagaaaacctatctggattcttaactggttgggcaaaacctgttgagcctgtaatttggcttaagatgccaaaggtgtcacatgaataatcacctcattttgtcaagtacaattggttctaaagtgctacaggaaccaggaaagagcaaaccagctgctcttcacactgtaagagtgtccaaatactcaactgactggcttagaagaaaaaaaatccatcaactttgtttctttttccacatacctcacatactatcttttctctatcacagaggctcttacctgaggtccatgagctccctagagggtctataaatgaacttcggaggcccatgaccttcaagctgaacaacaatgcagaggtttgcaattgcattattctggggaaaggtacttagccttcgacagcttctcaaaggcatgtgtgacctaaaaatggctaacccaatccacttcttttaaatctggaatgaaacccaaacccaaagccaaaggagatactattctgggattcaagaggtaagaaattaacaaaactgcccaatttatgaaatcttcataattaccacttgatgctaatgacaaaaccgagatgactttatctaaaaggaaaagtcaaagcttctcttacttaccatcatagcctcccaacacaagccacgggaacactggtccaccaaacgtacccagacaagggtcatggagcaaacttgtatcattcagagaggcaggagccctgccaaaaagtttagaaaacacctcccagttagaagggcctcaagacatcagggacctaaacatttacacagtgaacatttgatgaggctggctgtattctaaggacaacatgggccctgaggtttctcagttgagtaatacagctcagcactcacctttgggagctcagaatcactgggcaagaggcaggcaaatacagcccagtgccatcaatggcacatggtgcatggcgctatgcaggcacagaggagggagcaaacactaaaaggcaaaattatagccaagaggaagagactgtacagacccagagctccgaggatgagggggatttcaccaaagagggaggacaaaagggtgtctcacacaattacaactgtgggaggaaaaagggagggagagagaacagtgagagggaatgagagcaagatggtggtttggcaagtcctgtatgccgggtatggtggcacgcctaatctcaagtactcaggaagctgaggcagaaggatggctataacccaggagtttgagtccagcctggacaacatagcaagatcccatctctaaaaaaaaaataataataattcaaagaaaagatgtcctgtcctagagcatggggtgcccaccaagggggctcctgaaggagggggccagtctgggaagagtaatggacagacaaatgcaaaataaaaggactcagtgccagttaagtagtttggatttttattctggaggcactggggaacaattagagatttccgggaaagaaatgtcatgagctgttttacaaagatagcttgcgtggcaaagtggaaggtctggaaacggcaaagaaacaggaagcaggtggaacagtaagtggagatgttagcgcaatggcgcaggcaagaggcaactggcagtgcagtgcagacagacagttggccagtggagagtgaaccagcattttcggacagaccatcagctacaacttggccaggtgctgagaagcttctgcatatgacccacccgtcagagtggatgggtgacggcatgagggaggtcaggtgacctgcagcgagcagctgagtcccttcatccacagcagaaatctgagagagcatccagaggctcagacccgtaagaaccccatgaggaaggcgagggcgaggcagaattcagggataaagcctcaagcctgagtaactggtagctgtcactgcctttaaacaaaatggggagaagaagcaggtaagggcatggttctgggcaggccacctgccattactgcaggaccctcaggtgaaaaagtccaggaaaagctggagggagaggaaaggggacagcgctagggcgagactggggttatgaggacgcgcacaagcataactacaaaccaattcaggtccctgccaccaggagcctgccactccctgtaccgcttccacactggtgggaaccacgtccgctttgaggaaacacaaggctcacgcacctctgtcccccatcatttttgttgacttttatcttgtgccacagagagtaaactataaaatttatgtaacattaaatggttgtccaattataaaaattatgtaacattaaatgttttttgtttcttcaaattacccatggctcgtctgcaccgtctaccctgtggagaatgccggtttagggtatggagcataagctattgtgttttcatgagtataactcatgtttttaggggtgatattcttgaaacagagtaaatatagcccaactgcataaaaagtcttactccagtaacaaacaaacagaactcaaggtcaaagttctttagaaccagaagtgagagtccttagctcttgagaagtagtcggctgagcagtgtccttaaaggcaaaaaggaataatttctctgttcccatgctgaagaaatagccactgtggttgctcaactggctgaacaaatgtccctaggccaggtccctagcattcagggagagtaggcccatccggcatcatgctactcttcccctactgggagaagccttaagattcccctacaggtcaccaaagcaccgcttcctggggtgactattcccaattataaacgcaccctgcccagctagacatgcctcctaagggaagcagctgcagggccctccaatctaaagctgcggagctgcagacctatactgcctcaactcctcagagggaggctgcctcccaaatagctggggcactacaggggactgggctatatatctgagacagaacaaaaggcaccaaaggctcttctatctttaaatcttgtggggggtgtgatacatgacactgtgttagcgacccaggcacgaggtaaagggtgagaggcagctgcactcctcaatcacacaccacgagagcttcctgccagggctctgcacttgctgctggttctgccgggaactctcatccctgtgatgtgcccagctgtcctttcctctccctttgtgcacatctccacgcttaagcaatgcaccccccactctgtccagccttatttttctcctcatagcactaatctctagctggcacgatagcacatgttatgtgttcatcaaccgtctccctccattaagatgtaagcttccagctgggcatggaagctcacgcctgtaatcccagcactttgggaggccgaggtgggcggatcgcctgaggtcaggagattgagaccagcctggccaacatggcgaaaccccatctctactgaaaatacaaaaattagctgggcgtggtggcacacacctgtagtcctagctactcaggaggctgaggtatgagaatcgcttgaacttgggagccggaggttacagtgagccaagattgcgccactgcactccagcctgggcgacagagcgagaccctgtctcaaaaaaaaaaaaaaaagatgatgtaaacttcacagggcaaggtcttgttgtttgctcacctctgggttatgctcataaaacaagcttttgcccatgtaccctaagtcagacccaagaatggtgtctaccaatgattgtctcttgccacttaccgtacgcagtacagaaagtgcgtgtggtaatcggcatacacaaagaagtcgtcccctttcttgtggtccagcacggaatggctgttctggaagtaatttaacacactcaaaatggtgcagttcgtgttatacggtgaaagaggggccaagcagatgtcttgaagtgtcacagtctcattgtcataagaggcagtaatgttttcgatggctatttgtaagtcaagaacctgaaagaagattttaaaaataagcaaacccagaaacacgtcacatttctctcagatcttgattaatcagcattgccctgagggtcagaagacaaagagtatttggggaaaatacttcctaagatgagggagagaattaagatgcaatacagtaagaaaactggtcaggccacaggcccactctaacagcaaactagttagaggcgtccacagaggcggcgaggggtagggggaacaccatgaccagaacagctatcaacataggacacacaaccatctcccctccaccgttctccagtggtggccagcaggccagaggggagagtggagggggactcctggtctccctgaccctcctctcaatagtaacacataacctcctgccttgctctgcactacagccatttatatatgtccccttatttcctaacagagaagatgatcttggaggtaaatgactatgctgttcaccttcagcaacaagctggaaaaagcaacagacagtcactgggtagagaaaagattcaagtcttgggaccattttaatgcttttcaagattgcagactttcttgtagacatgagcaatgtttaaaggaaaaaccatgtgattatacattcattaaaaaagaagccggtacagtttatgcacaggtacagttctccaaggcaagtgtgacagggacaatgggaaggtttacatgcctttctaggagcaatgggatggatcttgccccaaatgcgcctctcaccaaaaacaggctgggtgcccatgttcaggcagtgagtgataagttcattcctacaggttggatcagggatggtaatctggcagctccttcctcagcccccaggacagcagtaagggcttcatgcctctgggtccttgcatattactttcagttaccaacagaaaacatttcacaaattcctaaggtgacttcctaataaatatatcctgcctcaatagagaaacgccactgaagtcttctttctctgctcatctcaatttcaagaaaaaggcaaggtctactatctgaagtaaatacaaaagtgagcaacaataaatattccattaagttcaacatcattcactttcttgaaacctaacttaaaggcagctttgccattatacgctaagattttcaagatataccatgacattcagccccaaatccccatctagcagtagtcaacatgtaaaagccagcaaaccacaaggtcatctagagtgacttatttcttcaaacagcaggttacctggtgcagtatctgtatgtcaagcggaggtccaaagggtacatcagctcccgaagggtatggctggtaaatgtgtttgtcagtgagaggggcccggatgatgagctgctccgtccggaagaaaggcccaaagtgctggtcaaagtactctttttccaggcgagcctggctgctgggggctgaccagaggtcaactggattggttgtgacccggacaaacaccaggcctgacgaacacgcagtaatgaagaccagcgagaagaaaatgacacagccagggtttcggacgcagaaagacccccagcgtgtgaacagccgcctcaagcagccctcaaatgctgcgctgacagggtcacagcaggacgcctctcctggaagaacgggagaggaagggaaggtggaggttaagagccaagccgttcctgaaagtcggaacagggaaagcattagttgctatctcatggcaggaatcaagcccacctggggacacatatgagacccctgccctcagctacctatctgctcagcaaagccacctttgttggctgccctcaatgagcgctattcccaccccacagaggagatgccgacacaggagcctctgaagggtgaggttcaaccctgccctgctattcccactcttgtcctgctgctttcgcgcctccccagctatgattaattacttggttctgctgtgccaccctgactagatggtagggccacaaaggcaaggaccatgtctgccttggtcgcagccgtgtcctcggcactggcacaccacctcacccactgctgcaaccccactgaggaaacgaatgctctcatgacagacagcatcatctgaacccttttattcatggacaaatatgcctacctttgtcacttgcattaacagaaaaagctatattgctatcgatgggagtgtactcggagacaaaataccgttttctgaaaaacagaagtgaagaaatagcattagtggacttcatcacagtgaggttgtttttgggacattcctgtaatcccatgaaatgctttcttcctcctcctggcctcctcctccctaattactgccttctttcccctaagtccccttgctctgggtccctctgctcaccagtctcaggagaaaatttaagaagatgttaagagaacaattaataaaggataatttcaccttgtggccctcattttatttaaaacttttaggtcctttaaaaacacactactgggctaggcgcggtggctcacgcctgtaaacccagcactttgggaggccaaggtgggcgggatcacgaggtcaagagatcgagaccaacctggccaacatggtgaaaccctgtctctactaaaaatacaaaaaggttagctgggtgtggtggcacgtgccttgggaggctgaggcaggagaactgcttgaaccagggaggcggtggttgcagtgagctgagatcgcgccactgcattccagcctggtgacagagcaagactccatctcaaaaaaacaaacaaacaaacaaaaacatgctactctttccagcagcaatgagcatacctagtgcccagatcttcgtttctacataccattctccaataaaaggaaccagagctccttgcagggcagggacagggaatatgtaagataaagctggggatgggaggtgtatgtaagaacacagaagccagccagaaggcactcccaatggcccaaagtggaaaactttgagtaacaagataaatgacagtgttggatacaacccacagaattaaaagtccatgatgtaaataactgagtaaataaatgagggagaagggatagctttctgtacagaagtccagttagtaaatgcagaggaagagagggaaagagaaaaaaatcactatcaggcaaacaccttagttataactgttgcagacaagacccaacaatgaatgctaaaatcagtggttgagtttcaggaggaacaaaatattagtatagtctcaaagcatcttcccccaagatatttatcaattacgaagggaaaagcagtaacttcacagtggagatagccagcagacatcaccttgagcaagtgatcaaggttaacatcaccaggaaagagacgcatcaacatcagggatccctgacatgatgcaccgagaaagacataacatgacttctgtgatgtacttgtcaaaacaccttatttcaatctcatcatgagaaaataccagataaagccaaatggaaggacatgctacaaaatacctgaccagtatcatcaagagtgttaaggccagaaaaggaaagactgaggaactttctgtcacagattagaggggactcataaaacacaaaaatgtaatatgggaccttgaaacagggaagggcattagagaaaaagctggtgaaatctgattaagatctctggtttagctaataataatgtaataataatggcatggtcgtggttttgatcattgtactatgagttttttttttaattattattatactttaagttttagggtgcatgtgcacaacgtgcaggtttgttacgtatgtgtacgtgtgccatgttgatgtgttgtacccattaactcgtcatttagcattaggtatatctcctaatgctatccctcccccaggcccccaccccacaacagtccccggtgtgtgacgttccccttcctgtgtccatgtgttctcattgttcaattcccacctatgagtgagaacatgcggtgtttggttttttgtccttgcgatattttgctgagaatgatggtttccagtttcatccaagtccctacaaaggacatgaactcatcattttttatggctgcagagtattccatggtgtgtatgtgccacattttcttaatccagtctatcgttgttggacatttaggttggttccaagtctttgctattgtgaatagtgccgctataaacatacgtgtgcatgtgtctttatagcagcatgatttataatcctttgggtatatacccagtaatgggatggctgggtcaaatggtatttctagttctagatgtactatgagttatgtaagttgtatcatcggggaaactgggttaaggatacacataaattctaccattttgcaactttttggttaagtctacaattatttcaaaataaaaagtaaaaaaagtactgtcctaaattaagatgcaaatatctaaaaggactatagtactccatttaattagatttgaatctgatttcgctcatttgactctgacttttttttttttttttttttttttggtgagacacagtctcgcactgtcgccagggctgtttgcaatggactcctgacctcatgattctcctgccttggcctcctaaagtgctgggattacaggtgtgagccactgagcctggccttgactctgactttctaaagaatgagtggccggctgggcacggtggcttactcctgtaatcccagcactctgggaggccaaggcgggcagatcacctgaggtcaggagttggagatcagcctggccaacacggtgaaaccccgtctctactaaaaatacaaaaattagtcaggcatgcaggcatggtggcggatgcctgtaatcccagctactcaggaggctgatgcaggggaattgcttaaacctgggaggtggaggttgcagtgagctgagatcacaccactgcacttcagcctgggcgacaagagtgagactcagtctccaaaaaaaaaaagaatcagtggctaatgcacagtgctttaaatcacacatcattttgaataaatcagtaaaattcatttcagatgttgcagtgttaaacagaactttgatggtttactatagaatagctgtaggacacaataatccatgcaatggtattcatggaggtatttgtttcttgtcctaagtaaccaagctctgacaaatgaaagctcaaagtgccagtgggcaattttgctctttttgccctggatgacaaacaaaactgcttacctgtagcaccacactgcaaaaaatgctccaaaaaacacaagcaaaaacgccatgtaggtgatccacatgatgacatacatggcgtccaagccaaggatcgtccagggagcaggaggaggtgggggctggggcttggggccacagacaatagagcagtcttggcagctacatggtgctgtgacctcatccacagactcgtcacagcctttggtggcattgttcatgggctccatcccatggactggaaaatctacagaaaggaattgtgttgagtacaaatctcaattaaaaacatccaaaattttgtattatacttaaactcaaagaaaagcccactgaaatacataaaacaactgaaagaagaaaaagaattggaggttttagtttaattaaattatgttttgctgcttcgtcctatggaattttaagttacctcaataaacttgcgcgtaggggtttgtcactgatagaggaatcctccaagtacaccacataccaaggcaacccttcaatcatgtcccatctccattctcaggagctaatactatagcagagctctagaaaagctgcctcccaccccctttttaactgcttattctttcaattatgacagcaatgcctgaaggcaattcatttcctcctccattcccactcccagcaccccctaaattagccacagcaggataaatgtaccagttacctctcttactgggagaaactatgaactagttacctgaatgtgtttatcttcctattgtagattatgcttcctcaactaagattcattcattcattcatggagagacagggctttgccctcaccaaggttggagtacaatgggatgatcgtaactcactgcagccttgaactcctggacccacgcaatcctcctgcctcagcctcccaagtagctgggactacagatgcatgccaccacacctggctaatgtttaattctttcatagagatggggcctcactacattgcccaggctggtctggaactcctggtcttaagcaattctcttgcctcagtctccccaagcactggtgagccactgtgcccagccagttccttggctttaaaacaatatcataaacacaccaaacttggaatctttatacctacctgaaaacacaggagtgatggtaaaaggtgcctgtccattgtccttattgaacatgtattcaatccagttggtggcattacaggcgtcagcgtccttcccacacaggagtcccagggccttgtcattacttgagggggcctccacatcccggcaggcattgtacattgctagaagaggaaacccaaaggaaaaaggagacaagatgcttgctgtaattcacgaggcaagatcttacaaaaggcctcttgaagggaaacacgaactccatatgcaccatgctggaatgctggacagcaaacactaactaagggcacgaacagagattccctttaaattggcttatcaccctgcaaataatatggaggcccgattccaagtaacttaaaagtaaaaaacagacaggaaagggaaaggcacacgttatctcatagctctcacaacagcttggagaagtcaaatccccactatatagaagagtataccaaggcccaggaagacgcagctaagagcctcagtacttcttcagttaacaaagctggttccagaaaacctctgccgcaggaagctacacagccagagaattatggaacttacttggaaaactggttttagagcagaggtcacgtgtcaataaacctaatactgttggccgggcacggtggctcacacctgtaattccagcactctgggaggccgaggtgggcggaccaccaggtcaggagatggagaccaacctggctaacacagtgaaaccccatctctactgaaaatacaaaaaattagccgggcgtggtggcggacgcctgtagtcccagctactcgggaggctgaggcgggagaatggcatgaacccgggaggcagagcttgaagtgagccaagattgcgccactgcactccagcgtgggtgacagagcaagactccatcacaaaaaaacaaaaaaaaaaaacaaaaaaaacccctaatactgttatctttttggattttattttcttacacatacacacaacacattatataaggatagtatcagtgtattacacctaagaaaatagctggaatgggtcctgtactgtcgattctcatttaccagtctctgcttgctagaaacttcccaggatcttctttccctaatcttcaaggagatgcttacacattcattttgttttacccttgttctggaaagacaggttaactagggtgacagtcatctccctcagaattctcaacagattattccattgccttccaggctctatcatggctggtaagaaaatctccaattatcattgtcttaaggtgatttgtgtcttgtctctatttgcttttaagatatttgtctttgggccaggggtggttatgcacacctttaatcccagtaatttgggaggccctggtgggtggactgccagagctcaggaggtccagaccagcctgggcaatatggcaaaaccccgtctctacaaaaaataaaaaaataaaaaaaaattagccaggtgtggtggcgctatataatttacaatataattacatgtaatttacaatttacccccttaaactatataatttaatggagtttagcatattcatagatatatgcaactatcaccatagtcaattttataacattttcatcacctcaaaagaaatcctgtattctagctatgcacaactacctccctacttccctaagccctaagcaaccactgaactgtctctatttatctgactatttcagacagttcacataaatccaatcatataatatgtggtctttcatgaccggcttctttcatttagcataatgttctcaaggttcatgcatattgtggcatgtatcaatacttcatttctttttacggccgaacaacatttcattgcaaggacatatgttttgtttatccatatatcaggtgataaatatctgagttgtttccacagtttggctattatcagtaatgctgctagaagcatttgtgtataagtttttgtgttgacctatactttcgtcttgtgagtggaactgatgggtcatatggtagttctatgtttgtttcaggaactgccaaactgttttccaaagtggggtctcactctgtcacacagattggagtgcagtggtgtgatctcagctcactggcaacctctgcccctcaggctcaagtgatcctcccacttcagcctctcaagtagctgggactacagatgtgcaccaccatacccagctaagtttttgtagagatggagtttcaccatgctgcccaggctggtctcaaactcctgagctaaggtgatccacctgccttggccgtccgaagtgctggattataggcatgagccactgtgcccagctgtttttggtttttggatttctttttaataaaggttcctattttccacagccttgtcaacacttcttgttatgtgactttgattctagccatcctggtgggtgtgaagtggtatctcattgtggttttgatttgtatttccctgatgactcatagtattgagcatctctcatgtgcttgttggtcatttgtatatcttccttagagaaatgtctactctattcagatcttttgccattttaaattgggttatttatttatcattgagtagtaagagttttttttttttttttttggagatggagtctctgtccctcaggctggagtccaatggtgtgatctcagctcactgcaacctccacttcccaggctgaagcaattctcctgcctcagcctcctgagtagctgggattacaggcgcacatcaccacacctggctaatttttctattttagtagagacagggtttcaccatgttggccaggctggtctcgaactcctgacctcaggtgatccacccgccttggccccccaaagtgctgggattacaggcatgagccacagcgcccggccaagagttctttatgtattctagatacaagtcccttatcaaatatacaatttgcaaatatattcttgtccttttttttgagacagagtctcactctgtcacccaggctggagtgcgaggtacttagtgcagcctccttaggctcaagcaatcttcctgcctcagataaccatgtggctgggaccacaggtacatgccaccatgcctggctaattattttttgtagacacagggtctcactttgtcacccaggctggtcttgaactcccgggctcaagcaatcctcctgcctcagccacccgaactgctgggataacaggtgtgagtcactgtgcccggccttcttgtcttttcttgatggcgtcctctgaaatacaaacttttttattttaatgaagtccaattaatcttttcttctgttattgctcttgtttttggtgtcatatttaagaatcaagtgccaaatatgaggccatgcaaattaatccctatgttttattgttttatagtttttagctcttacatttaggtcttcgatccactttgagttaatttctttaacatatggtgtgaagtagggcccaatttcattattatttatttatttttgcatgtgtgtatccagttattgcagcaccatttgatgaagagtattcttttctcattgaatggccctggcacccttgtcaaaaatcagttgaccatagatatattatttattctcagttatattccattgatctatatgtctatctttattccagtaccactgtcttgatttccattgcttagttttgaaactgagaagtgtgagtcttcctattttgttcttttttcagggttgttttactattctaagtccctcaaacttctatgtgaatttcagaatcagcttgtcaatttccacaaagaagtcagttgggattataacagagattgccctgaatctataaaacaatttggagaatactgatatctaaacaatattaagtcttttgattgataaacatggaatgtctttccatttatttagatcctcgttaatttcgctgaataatgttctttagtgtgttttttctgtttttctttttttgagatggagtctcgctctgtcagccaggctggagtgcagtggcacaatttcagctcctgcaaccaccgcgtcccaggttcaagtgattctcatgcctcagcctcccaagtagctggcattacaagcgagcgccaccacgcccagctaatttttatatttttagtagagatggggtttcaccatgttggccaggatgatctcaatctcttgaccttgtgatctgcctgcctcggccttccaaagtgcttggattacaggtgtgagccactgcacccggctgttctttaaagtgttttgccttctgttatagttactcctaagtatttcccatactaaagtaaatggaattgttttattttcactttgagattgtccattgcaagtgtacagaaatacaactgatttttgtatgctgaattttctctaagttctcagggttcatcccttatccactctggaaaatcctcattatccctttgattattattgtctctccccaactctctggagcttctcatgttatatgtcatttctttaatgatttataggtctttgtatctgtatgctgttttctgagtaattccctcgtatcttccagctcaccatttggttttcaggttttattttatgtttcaagcatacaaaacacatggagaataatacaattctcatttcctcattacccagttaactatcagtcataccatttcacaacatttgcctcaacattaaaaaaataatggactcggccaggtgcagtgactcacacctgtaatcccagcactgtgggaagatctcctgaggccaggagtttgaggccagcctgggcaaaaaagcaagaccctatctctacaaaaaaaaatttgtttttaattagctaggtgtggtagcatatgcctgtggttccaactacccagggggactacttgaacctaggaggttgaggctgcagtgagccatgattgcatcactgtattccagcctgggtgacagcatgagaccttgactctgttttgtagtactgcactattcagaacaactggctatggcataatttaaaaactaaataaaaataataatgcactataggccaggtgtggtggctcacacctacagtcccaacactttggcaggccgaggcaggaggatcacttaaggccaggagttcaagaccagcctcaccaacacagtgaggcccgtctcttccaaaaaataaaatacttacacacacacacacactctatagattcagttgaagctccccaattacccctccctgacagtagccccttccctaaggtaaacacaatcctgaatttgatgtttatccttcccatgcatgtttgtgtacttgttttaagtatgtagtacttttgtttcaaaatgtcatataaacatgtaaccaccattatagtatcatatagagtattttcaccacctaaaaatcttctgtgctctacttatgccttcctctctcctaacccatggcaatcactgactttttactgtctccacggttttgccttttgtagaacgtcatatagtggaatcatagtgagtagtcttttcagattggctttgcttagtaataggatttaaggttcatccatgtactttcatggcttgatagcactgaattttcatggctttttagcaccaaataatattccactgtgtggatgtagcagtttatttacccattcacctactgagagaaatcttggtggcttacaagttttggcacttatggacaaagctgctacaaatatccacgtgcaggttttggggtagacacatttttaactcatttgggtaaataccaaggagtatgattagttttgtaagaaaccgctaaattatcttccaaggtggctgtaccgttttgtactcccaccatcaatgaatgagagctcattgccagcatttggtgttgaaagcgtcttgaatttttgccattctaatagatgtgtagtggtatctcgttgttttaatttgtaattctctaatgacataatgttgagcatctcttctcatgtacttatttaccactgtatgccttctttggtgaggtatctgttcaggttgttttgtccatttttcaattgggctgtttgctttcttattgagttttaggagttatttgtatattttgaataacagtccttactaacatgtcttttgcaaatactttctcccagtctgtgtcttgtcttctcgttcttgaggtcttcaatttttcacaatcacaatagtgttacagtgggtgttcttatatgggtctccaggtttatatgcatttagagtttctctaaggcaggcatctataagtgaaatttctgggaggagggttagcttcaacttactacgtactgcaaagttgtttttcaagtagttttgaaacgattgtaccaaattatggttgtaagtggtggagtacattagtattcctattgcttcacattttcacccacagttgaaattgaccaactttttaatttgtgccaagctgatgaggtgtgaaatggtagtttactgttcaaatttgcatttcgctgtctgctctagataacagttgtttatattcataaatatttttcttatggtttctgcttttcctctcctgtctagaaatctttccatatttacttctaaaactttccaattgggatttttaatctacacaattgatttttttattttctgtaaaaattaaaattagataaatataatctattttctcatctcatttatcaactagcccaccttttctctcaatgatttgtaatgacacacgtgttacacatccactttccatacatgcaggcttctgtttctggacaaaatgacctctctccattcagtcaggttgccttgtatgtcacatcttttggattcctaagtgccttattttttgttgcttttgtgaatgagaccttttttctatggaatttttttgttacctttttactttgtcattataattaaatgttgtatgttggtcaatgctgggggatcatttctgctatctgttagacctgctgactttcctttatggtgatctgattcttgcaagtcatgacctcttctctgccaactattaacagttctatcttctcagtcttgcagtaatttatgacattacacaactcatgtctgttagagtcaaagatccaatggttactgaagtgtatggatgcaaacttgcacatactaaaattttccatgtgggaagttaaagttagggggagttaaagcaagcgctttaaggagatttttatattcgttgcagttcaagtcctaggatacaagcaaagcaacaactcttatttcctggccaatggaactgaaaattgtgattttccagagttgacaggacaactaaaaggaacaatttgctctgctgtcctgatgccagctgtaaaagaggaataattaaaagtttacttaccattggcaaaactctgtccgacgtagtattgtaactctttcacatttgttttcgtctggtttgtaacaggatcaacataatcttcagtagctgtaacattcaaaaactgactctgtcgagggctacatgtcagctcacaaaacaggttcagtaggttataaaaacaggatggacatctaaaggaaaagtaaattatattctgcatgatctcacacataatagggccagcaagaacgattttaaatagacaaagaatattttaaacttactgtaaagtgacaaattaccaagagaacatattaaaaaccagcaattctaaacttaaaacttcatgttaaaataaaggcacacctttaaaaaatgccctaattactttctgcatttattgtgtccaattataatttcaaaaagagagagatgcttctctgaattctgcactttataatttagagacatacattctctgacctagagtaaagggactttggagcatcaggaagacaattattattattttttgagaaagggtctcactttgtcgcccaggctgagtgcagtggtgtgatcacagctcactgtaaccttgagctcctaggctcaagcaatcctcccacctcagcctcccaagtagctaggactacaggtgcacaccaccacacctggctaatttttaaaatgtttttgtagagatgtgggtctgtgttgcccaggatggtctcaaactcctaaactcaagcaaccctcctgccttggccttccaaagtgctgggattatcgacatgagcgctgcaccagctgacagttttgattaagaagaaaataaaataatgagaattatgagaatcttcatcttataacctattgaaaggttttctttcaagccccggaaaatcactaggccctcctgaaacacaaggagaaatccccatggtttgtaaagatagagaacagcaatgttgttctctggctgcatgcacttcaggagcacacaactgcacaagaaccataagctgcctgctatccttcaggttcaaagtttaagctcctaatgttgacttgttacatgataaaagagctctcttttccctttggtccactgttacttgcaaaagctgtttcattagacttgcattcttgcaatcaagattactttagactccgattcagtcccagtgaccatgtaagacaaagaatgaaaaaagtgtgtcctggccttcaagagtctctgttctagtgaaggagacagagaagcacagactctctttctttcaggagccccactgctttactgcaacaaagccagaaaccacaattgtattattctaataggaatcactcttggggtacacagttttcaaaccttttccatgttactacatttaatgcccacaatcactaattttgacagctgtatatttttccaaatatcaggttgtttctcctgtttgctattataaatcaagctttggtacctctgataatatggagaaaggttggctatctttttatgtttatgtccgtatgtccataatgcctcacctacggtggatcctaaataaatgtgttttgactgagtgtacaaggctccaatttggttccatcaatgttcacaagcctttcataggatatgctggcccaattacagcctcaacttttgttgttctgaaaaaacaatttagtggtggttttccattctctattgttaacttttggtaagaagcagaatttcttcactggaagccaacttgtgccctatcaccacctgcagtgatatttgtgcagagaagcattttccctttttaatatttgcttcccaaacatctttatcagtgtgctgaagtctgaaaaatttagaaagataccacaatctgctgttctaaagaccactaccagcttgctcttttgcatatttgagaattgctggctaggcctagagaagaacatctattaccaagccctttttcactgctcagggtcatagccaacagaacagataaaaaactaagtttgacaaaaccagccagctacagcagaacaaaatttttaacagctccccgaggccggctctactgaggacctgactctatcacaacccttcaccagagggagggacaagaatgatgtgcaaagcaaagcatggggggagaggaaggactgcatgatgagagtctcaggccaggcacctgagcaggacccctaggaacctctcttccccacagtgcacagctcaagtttgaaaggagcctggccgcagtgcagacaccctgcagggtgagaacatcgcagaggaaaccaagcatcaactctgaatgcaactgggaagtgaaccaagtctggtaattattgtttttctctttatttctgacaaattgtaagagtgctttcttaaaacaaaacaaaaactgactttaaaaaaaaaaaaaaactggctgggaactgtggttcacacctataatccagcactctgggaggctaaggtgggaggatcatttgagaccaggcctggccaacatagtgagaccctcatctctagaaaaaaataaaaattaggctaggtgcagtggctcatgcctgtaatcccagcctgtaataaccaggctgaggcgggtagatgacttgaggtcaggagtttgagaccagcctggccaacatggtgaaaccccacctctactaaaaatataaaacttagctaggtgtggtggcatgtgcctgcagtcccagctactggggaggctgaggcaggagaatcgcttgaacccgggaggaggttgcagtaagctgagatcatgccactgtactccagcctcggtgacagagcaagagtctgtctcaaaaaaaaaaaaaaataaagaaaaacataaataaaattagctagacatggtagtgcatgcctgtagtcctagctactcaggaggctaaggtagaacaatcactggagcctaggaagtttaagctgcagtgagctgtgatcacaccacaaaccactgcactctagcctgggcagcagagtgagactctgtctctattatacacacacgcatgcatacacattatacatacatgtatttttaatacataaatatatattcacctactttacatgtatacatatatgtataaatatataatatacatataatatagacatataataaataaaaatatgtaaacaaagaataaatggaaagctgagcattaccagttcacaagtatctacagcccagttgttctgtttccccagcagaacctacctggacagaaactgtagaggcagctgcaggttgtcttttagtgtctgaagctgccgaacatcacaacagagactgacattgccaaagaagaatcctggacagagttcctttcaggtgaaagagcacagacacgggagtaggcaacagttagagtaaggtcaacattcctcagtgaactaagacacattcattcatgtaatccttttgaagtacaaaagggtaagacacatcctgtatttgcaaagttattatagaattattttaaaaggctacacatttactatttattcacaagtagagatgtttctaattttctttttatttggaagctttctctcctctcctgacaatcattttatgtcttcttagggttttttgtttgtttgattcaattcaaccagagtgctacttactatttctattagtaattccagggaaagttgaaacctttaataattatgatgaaagcagcaagtgaggacaggtactgtggctcatgcctgtactcccagtacttaggaaggctgaggagggtggattgcttgagcctaggagtttgagaccaggctaggcaacatggtgaagccccatctccccaaatttttaaaaaattagccaggggttgtggcatgtgcctgtagtcccagctacttgggacgctgagttgagagattgcttgagctcaggaggtcgaggacacagtgagccgtgattgtgccactgcactctagccttcagccaggataaaagagcaaggctccttctgtctcaaaaacagaaaagaaacgaacaagtgagcctaggaactctgttatcatgtcgacttgacttttgattactttaagcctctaaaaccaggcttttcacatgatttttccagttctaatatccctgtgtatcacaggatggtaaaaaaagaacaggaatcagaatcctggtagcagccaaaattcacaggctctcagtggaacacagagaaaacactgaaatgaccaggggacaaggacgtcaaagccacttagcaacagagtccatttgagtcctgaaatctaggaatcaaaaccagctaacttctaatatattttgcagatgctgcaagggcaacatacgaagtaccaaggtcagtctctaaatagcaacctgctattgggaaactttatgagaggtataaagtcagcccctgaaaaattaagcctttggagttacggtgttctttctctgcactgtatgccacaggttagagtttgagagtccgggataagacttaagcctgttagtctcatctccacctccaccctgcaataacatttaaggaataattacagaggatcttgtgatcagcattttgtgttcccagtgcctaagataatgaacttacctgcactaagtcatatccatcctttggcaatggttttggtgggccagaatattcgcaattgtacctcttgtccccatatgcaattccacactctccataccaaacacaggactgtgaaaacacctacagaaagtcaacacaaacttcagtgttaccagggtctcaatggtaaatttcaacaagaagtgcccactcaagtacaatcacagaaacttccaatgctacctgcaaaattaagtaacagcaacaggcacttaacattttgaaaaatattaattaaagcagaccaaatgcctatttgtcaagtcagtgaagtaggtaatggaaattgcttatttacataatttctatttcctgcttatttgttgataagaggaagctatagttccatgtaagaaatactcaatcacagtagagagaaaagcaagatagtgacttagcaattactaaagcactatttttgcacatctgcaccaggaactatataagctctaagtaatgaaagaatatttccatatgtatttaggttaattaatatcaatacatcatgagtaacatgaagaacaaaacaacaaaaccacaaacatcaacaccccaatgtaaagagcgagaatgaacttcctgtccttgaggctgaagtagaaagcaaagaatgtgctaactttaaggaaaaacaccgaggcaatctcaaaagaaaattttaaaacctcttatgtaaagatttctcaaaaaccactcacatttcccatgtgagagtcacaaggttgtcagaaaattcagcggaggggaggggtcagtgtgaatcatcaggtcagtgccttgctctgaaggctgctgcccaaaacgcacctgatcctctgcctcacaatggactcagaaagccacagagggcccagcttgccagggccccgggcctgcaatcgtctgttctacagggaaacagaagatatcaagaagcagccatggctcccaagaaccctgatgggaaagccataaaaaaaaaacaaatctgaacagaagtcacaacatgaaattctctccagtgacagtggcacatgacctgcacacaggcaagaagctaagtcagtctgtgttggtccttcagtatcaaaatacaaatcccacaacagtccctgaagcccaaaaacatgagaaaaagtcagcaggagattgggatttgtatgtgtggggaaatccaaggcatcaatatcacttttctctgaattcatttttcagatgttctaaaataaaaattaggacttaactcctcttgactctttgaaagtcatgtttaggccacaaaggagggaaattatacaaataaggaagtgacaacaagccttcaacaaagccacatatgaaccctgtgccaagattccaccactatttttatataaagagaatcccaattgttattcccataaacccggtgattctaaggaaaaaagaaacgtattgcaactctgggtttccaactaatggaaaaaagtcctaatgagtaaaagtcattatccatctaactaaagtttgaaaaggcaaaagctgactacagaggcagaggaaactgctgaagttcacatgaaattttaaatacaaagaactcttccctagacctcgcagaactctccagggattggcctgtctctgcctcaggggcactctggctggttacccacaggagcaggagtgacaagagacagatgtgcagtcaacacactgcagctctggcctgacaaacaggacgggtgtctggagtctaaaatccccttactcagcacttggtactatagatgtgaataaagatggcccactgctgtttaggttccttttcacaaagatcattcgttacttatttcaaagcaagtgctatttccacccacttggtggaagaggggtgggtgagaaggcggcacggagtgggatcgagtcctgggttctgatcccaagagctcctgaggctcagtgtgcttgttgagctggattgcacctgggatcacacctggagcaggttacgtaaccacgtaggagttttcctacctgggaaatgaagctcataagctctgcctacctcacaggttcctgtgaagatcaaataagggcctatctgtacatatatagtaagtactcagtaaactacagagcaccacgcaatcaaatataaggaattattattaatgtcttctacctgcttgagacctcggcaaagaggttccaaagacttaaaaaattaacacctgagcccaggaaatttgggcttgaatcaacattcaggtttgcttctcaaaaggtcatcttctagagacacagcagagaagaccaaaaaaaaaaaaaaaaaaaaaaaaaaagtcatcctggctggaagtggtggctcacgcctataatcccagcactttgggaagccaaggcaggtgggtcgcttgagcccaggagtttgagaccagcctgggcaacacagtgaaaccctgtctcttaaaaacaacaacaacaacaggccgggcacggtggctcacacctgtaatcccagcactttgggaggctgaggcaggtgaatcacctgaggtcaggagttcgagaccagcctgaccgacatggagaaaccctgtctctactgaaaatacaaaattagccaggtgtggggggtgcatgcctgtaatcccagctacttaggaggctgaggcaagagaattgcttgaacccgagaggcggaggttgtggtgagccaagattgtgccattacactccagcctgggcaacaagagctaaactgtctcaaaaaacaaacaaaaaaacaaaacaaacaaaaacaacaacagccaaaaattagccgagcctagtggcacatgcccatagtcccagctactccggaggctgagctgggaagatcagcttgaacccaggaggttgaggctgcagtgagctgagatagcacctctgcactccagcctggacaacaaagtgaaaactggtctcaaaaaaaaagtcatcctgccgaaagaagcaacctaagccagcaggacccaaagacttacaaagcactggcggtgtcctaggcttaggcactattttaaatgctcttcacattgtgtccggaattggtgggttcttggtctcactgacttcaagaatgaagccgcggaccctggcggtgagcgttacagctcttaaggtggcgcgtctggaatctgtcccttctgatgttcagatgttttcggagtttcttccttctggtgggttcgtgatctcgctggctcaggagtgaagctgcagaccttcgcggtgagtgttacagctcttaaggcagcgcgtctggagttgttcgttcctcccagtgggctcgtggtctcgctgggctcaggagtgaagctgcagatcttcgcggtgagtgttacagctcataaaagcagtgtggacccaaagagtgagcagtagcaagatttattgcaaagagcgaaagaacaacgcttccacagcatggaagaggacccgggcgggttgctaatgctggcttgggcagcctgcttttattcttttatctggccccacccacatcctgctgattggtagagccgagtggcctgttttgtcagggtgctgattggtgcgtttataatccctgagctagatacaaaggttctccacgtccccatcagattagttagatacagagtttccacacacaggttctccaaggccccaccagagcagctagatacagagtgtcgactggtgcactcacaaaccttgagctaaacacagggtgctgattggtgtgtttacaaaccttgagctagatacagagtgccgattggtgtatttacaatccttgagctagacataaaggttctccacgtcctcaccagagcagctagagtgtcgattggtgcactcacaaaccttgagctaaacacagggtgctgattggtgtatttacaatccttgagctagacataaaggttctccacgtcctcaccagagcagctagatacagagtgttgattggtgcactcacaaaccttgagctaaacacagggtgctgattggtgtatttacaatccctgagctagatataaagactctccacgtccccaccagactcagaagcccagctggcttcacctagtggatcccgcaccggggctgcaggtggagctgcctgccagtcctgcgccgtgcgcctgcattcctcagcccttgggtggtcgatgggactgggcgccgtggagcagggggtggcgctcgtcggggaggctcaggctgcacaggaggccacggagggggtgggaggctctggcatggcgggctgcaggtcccgagccctgccccgtgggaaggcagccaaggcccagcgagaaatcgagcgcagcgccggtgggccggcactgctggggggacccagtacaccctctgcagccactggcccgggtgctaagtcccccattgcccggggccagcagggctggctggctgctccgagtgtggggcccaccaagcccacgcccacccggaactccagctggcccgcaagtgccgcacacagccccggttcctgctcgtgtctctccctccacacctccctgcaagctgagggagtgggctccggccttggccagcccagaaaggggctcccacagtgcagtgggggactgaagggctcctcaaatgccaccaaagtgggagcccaggcaggggaggtgccgagagcaagcaagggctctgaggactgccagcacgctgtcacctctcaatatgttaacccaattaatcctacaacagtttgatgagggaggcgttattataccccttttacagatgcagaaacgaaggcactgaggctaaacaacttgtccaaggtcacagtggcaaagccaggattcaaaacagagcaggtgactccagaaacagactctcaataaaagagaatcagctgcatcatgaaagtcctccctgtagcatcacaccctccccaaaccccaccgtgtgcaagagcacgagcacctgtgcactcaacagctgcacaatgggagctgctcagccttcactcccttctcaccaacagctgaaagtggagagccagcctcctggcccccaggcctgcctctgcagctgctccacctcaggggcctccacacctccatctctttctcttctgtgtttttaacctcatctctctctcagtcccttcacctgcacctccctagaaacactgctctaattatatccacaaacccctctctcagcttcagtgatctccagcttctctccagcagcactttccactagctgcccaacagcctcagtgcttaagacgaaaccaatctttcctctatttgtatttcctcctctattgccaattcctcttcaacagagtttcaaatgaaaatctcaggcacctttcgaacccacctcccatagcgaacctatcgctcactcccagggaggctccctcgtgcagcctcctgccctcactcggacccggcagtgtctctggtgcagatgcctgccgcttgcctcttccggaacaatgctcaaagttttctggtgctcagaaacctccaacccacccttcccactgcctgtgcgacaagcttcagacacctcactctggctctgcccactctcctttctacagtattccaaacctatcactctaactgcctacccttccttccttctctcccacatgaagtaggacctgcctgcctctgccttggtcatgccctaggatcaagcaaaatttatgagaattgcaaagttgtgatgttgggagaagttgccagagtattttctcacttttgtctcaactcccttgtaagacggtaaaatcctagagggcagagcctaggtgtgtaatccttcctttgaaattccctattgtattacatctggtgttcatggatgcagaacttgtcaaaactcacaatgagctgagggagtacaactggattatctaagttcagaaatgagaagtgctgattgttttggcttctacccagaatttagtagttacacagctaaagagtttctatttttaaaggttagatcatatggatatttcacaacatgctctagagtttaattactaagaaaatgactggatagggaagcttctttcaacgataggaacagttcaggaaaggttaaaaaaaagccccttctaggccaggtgcagtggctcatgcctgtaatcccagcactttgggaggccgaggtgggcagatcacgaggtcaggagatcgagaccatcctgcctaacacagtgaaaccccgtctctactaaaaatacaaaaaattagccgggcatggtggcaggtgcctgtagtcccagctacaggctgagacaggagaatggcgtgaacccgggaggcggaggttgcagtaagctgagatcgcaccgctgcactccagcctgggtaacagagagagactccatctaaaaaaaaaaaaaatgccccttgtgctatatctcagcaactatagcaactgctaaattggaccccattcaggagctccataagcacacattattatcagaaaagctctgaactcagtgagaattctattccactgcctttaggaaatcctaaagcattaactaacatattcaaatacttactgaacatctattgttctcgaggcatggcagtaaaataaataaatgaaacaaaaataccaaacatcgactgcatgcctcattttctcagatactctatgcagtagcacagcagaattttacaggtaagtgaactcaggctcaaagatactctgaggtcacatggctcataaataacatgattttgaacaccaagttaagcattctccacccatcccccttgtcctcctgcctcccctacccccagcttctgtaccatttaaactctagtccagtttgtgcagtgatgtatcctcagaattggagaatgcactggagatgaactgtcccatccatgatgatcctatacaagtgttccttcaatataaacttgttcacttgtagaaataatgcctcccattcctatcttttaaagtatctctctaggcagttgtcaagcaatgactcccttactcagtatcactgacagtcctcaaccccagggtaggacttggccatccaccagagctgggagtgcagggcttggcaccaacacttgtgcccctgtcctggatgggtaaagctaatggcaaaacatggagagatacccagctcaagctccagtgaggcgatggaggagaggggcttgctggttaacttccctacctcattgcttctccagagagcagaggctggcctggccagtcaggacaacacaggctggagtggagggagtggcatgaagaatcctgtccagagattaagctgcctgctgcttctttggagtcagggaggcagaccaaacaaatatggcagggcatttagggtggaggctgccgggctggtctgacttctattgacggaaatctctggaagtgttttatagccaacctggcatgaacgtatctacataacaaaggataatttgtgtgtgcaccaggcctgcctgcatgtgggtgtttaagtcatatattttgagtgctaggtgtgctcagctagtccaactcttcgttttacagataacccctttagcttctggttttttatgtgactcacccaaggtcatattactagttagtcttagacatttaggagccacaaaactaaaacaaaactatgaaagtgggtgccagtatacactgtctgcagttttttccctatggaatgttcacagtgtggtgactgaatcaggggtcaggccagcaggctaaacccattcctgatctattacggactactggaagagccacactggggacggaaccaggccttgaatgagactgctctactaaccaagtggaatatctgctgaacacccattcaattaagcttgctaaacaccaataatctagccttgaatttcaaaaaactagggcacagaagtcagaagatggcagttgaagcacccaatgtgccatctactagctatgtgaccttgggacaaatttgacccttgatgtctgcatctataaaataggaaaaacagcattacacctaccttaaaggggctctgtgaggataaaacaagatcggatgtgatagcaatggagtactatgcaaaatttgggtagcttttgtctctagtcttatgtaatctagtatatagcaccctgcaaatttttttaagagctttactcatgtaatttacataccataaaattcacccttttcaagtgaacagttcaatagtttagggcaacaattaggcaactctcccgactattttctctagttttcctcttgtccacctgatacattaattcatcctccatagctcagctcaaaaatggactctccataacattttatctttattcttatctgagcacttcttactgtattaccatttttttatgtatccagccttccccccatcaactatgaagaagacagtgatagtaattatgaacatttacacagcactttacagtgtatagacggactttttttcttttttttactacttacttattgttttggactagtcaagtgcagtagtgagcaggaggaaagagtagatcaaggagttcgatctgtaactgactttgatcaattgataacacactaccttaggaccagcctagactgatttttttaaatgggttaattcttttgatcttatcctttgttgtgtctagggaagccaattcatgtttatgaaattattttgagctcctcttgtgacctaagcaagggacagtaataagataaaattttaaagcttctctcaaatcctccaacagaacacctgcaccagagagagttggttttttaaaagttttgctgccaaagcaaatgttccaaaaatttgaaagtgagaggcacagtccagatgaagaaaaacctggctggccgcagctgatcactgccatcacctagaaaccaactgcaaatccaattttgattgccactagtttctaagtctctccccaaaatccatttcaaggcccaaatatcttatgatcaaagaatcccagtgggccaggcatggtggctcacacctgtaatcccagcactttgggaggcggaggtggatggtatcacttgagctcaggagttcgagaccagcctgggcaagctggcaaaaccccttctctactaaaaatacaaaaaattagcagggcatgatggtgcacacctatagtcccagctactcgggaggcttgatgtgggagaatcacctgagcccgggaggtcgaggctgtagtgagccaagatcgtgccactgcgctccagcctgggcaaccaaagtaagacctggtcttgaaaaaaaaaaaaaaagattccagggccagcacggtggctcatgcttgtaatcccagcactttgggaggccaaggtgggaggatctccagcccaggaattcaagaccaccttgggcaacacagcaagaccttgtgtctacaaaaaatttaaaaattagttgggcatggtggcatgcacctgcagtcccagctacgtgggaggctgaggtggaaggatagcttgagcccagggtcaacacttcagtgagccacaatcaaaccactacacttcagcctgggggacagtgcaagaccctgtttcaaaaaaaaaaaaaaaaaaaagagtcccaagtcaagtgtcctggccacatttgtagatgatattggagagcaacagttattgctcttaaggagcctgcaattcggtagttcaattaggaaatatttgtctttcacaagcatagttggcacagttaatccaattttacagaggaggaaactgaggctccagaggataactggcttacccaagatcactcttgggaacagagaagagtcaagacccacaccaaggtcttttaatgaggcagcaaatgctgttgcagcagtttaaataaagattcagaacttcagagggaaggcattctagttaggggaacaggacaagaatgtcgtagataatgtagcatgtgaaatggggccctggaagatgggcaggattttgctagcaagcagttcaatttgactggagagctgatgcccttcacagagctggaggtcaaagggcagaaaggggcacccgagatcagagatgactgatccaggcttccgctgtaggtaatctgccatgcttagaatactgcatcccttttaggagtggagggttacccaggaaagagagagcacactgtcttcatgaccagagtgattctttgttctgggtaatataacaaacactggaggaatacaaaggcctattcagcgagtccttttccctctgcccactggctcaaatttaaaaaaatctcattttccccttgattacttatgttagtaaaatttctgatcacagcatcagtcaaggagtgggaaagatggggaaagatttcccacagtcattccaatttcagatggttgttcttaatcactcacaggtcaaaagattaaccattcccagtcttctgaggaaaagccattttaatgcttaatttctacccaggcttctctatgttccaagtccctcaagataaagcttaccaaaattacagccgggaaaaataaaggctatgtctcaaaactgcatatagtttttagatgactacagggttttaaaaacaaggcagtctagtaatgttattacatcatctgtacatattgaacattaagaaaaagcaaaaatccccccaacatgtatttcagatcttacacaggacaactagtccataattccatgatagaactctactagcgctcagactgaagctaatgagctgctatcatcggtacgaattctaaaagcagacacactctctctcccaatctgtttggcttcatggctccaccccaatctgttcaggtgcactgaaagctttcagacatgaggaatttttaaaataataataggattatttccagttaaggtttacagaccttgaaaaggcctccaggcatttttgcaagagacttacaacaaacctctgacctatcccaaatgtcataaaagaagcactcattggccatcagccttgggtacttgagatttaaaaaatacttaagagatggctacttaataatgtgaagcctggctgggcgaggtggctcacacctgtaatccccaaaagaggagggcggatcgctagaggtcaggatttcgagaccagcctgaccaacacggtgaaaccccatctccacggaaaatacaaaaattagctgggcgtggtggtgggcacctgtaatcctagctacctgggaggctgaggcaccagaattgcttgaatccaggaggcagaggttgcagtgagccgagattgcgccactacactccagactgggcaacagagactctgtctccaaaaaaaagggaagcctatttaaggtcctgatctaaaactctaggaggggccaggagtggtgctcacaataatcccagtgctttgggaggccaaggtggaaggactgcttgaggccaggagttccaggctgcagtgagctatgatggcgacactgcccccacgcctgggcaacagagcaagaacctgtctctaaaataaataaattttaaaaataaattttaaaaaactctagggaaacagaatagccacattttctctacggcacataattgctattatttatttctctctcttttttgttttgacacagggtcttgctctgttgcccaggctggagtacaccggcgtgatcacagctcacagcagcctcaacctcaacaatgaaaagaaaaacaaaatgtttttaagacggtgtttcaccatgttgccccggctggtcttgaactgctgagctcaagagatcctcccgcggagcccttctcctggctcttagtccattattggatcaacatcacctatccccttctgagaactaaatagaagtcgaaggagagttttttctagtccacggaaccccctctcccctgattcaccacttcctattgacgccacacctatgtgaggggcgttaatgtgcacaaggacacaattccccggaggcactctcatcctgatttggtttaacgagtcacagcgtgacactgccccactccagttttaaaagaggaaactacagacacacaaatactgaggtgctctttcccaaagctattaaaccaagcaaaagcccccagaaggagtcagcaggacaccgagttccaggccccatcctgtcgctggctaatagtgacaaggggaaattcaataccgccctgtgagtctcagtgtcctgaggtgtaaaaaggagttgatgaaaagtaacctgccctctttagaagaccaagctgacttatgtcaagtactcaaggcagtttcaccgggtgcttgaggaagtttgtgtctctttacctctgcttccacctccatcctcaggtgatgagaagaggaaataaagtggttagagctcctaaattttggagttcgtgcgcatgtagcagaattttttaaaaagcaagtagtgtccctatcccactctacccactttcctcccttcttctggtgccacatcctacacagagaaattaggtgaccacagatggaacaagctcagaacaggtcacccaagcccccactgccaccctcttccagaccacaggaaagagagcgtggccggagacagaaacaggacaagtgaggaacctccgagctctccatcgccagaccaacttccccaggacccgggcctgagccgtcgctgggcccgtcgccttccccggctctcggccccgccacgtccccacagggcgtcccggtggccggcgaccgctcacctgcgctggacacagtagcagcaggaggaggccaagggccaggccgcgagcggtcatgctgtggccgcgcaaggctgctgacgccggcggcgttcggctggttgggctccccggaggcggctctacttccccgggctgtttcagcaccccgcgcaggaggagcggaggagcaggagcaggcgctgaccgcggcagcaggctgcgcgcgccggtcaggaaggaagaaggcgtcgtcggctccgccctttctgggaggtgccgctgccgggactccctggcccgggctggggcgccgccgcgaccccgcttcaaggtccccgtgttgcccttctcctcagcccctgcaatccccgggggccaggcgcgggacttatggagtctggctcggcccgggagagtatctgtggagttgtgccaacggtttctggccgtgatgctttcccttttcgtctctgggttggagggggcgggcgaggtttcagcgaagggtagtgctgttctgggggacttccgggtaaggtcccgcccggccgcggagtctctgtttatttcggctccgacaattacgctgagcgacttctcctcccaacccagtcacctgaaaggaatctggaccccggcactttctagcagagcccggggcggtgacgcgcggtggcctgaccgtgtgacgatccgcgagtgcggcggggcggggcggggcggagcgcggggtgggcggtggcggtgcggccaggcccgggaaaaaaagtgcgggagcctcgccacctgctggcccagctgcgcagcgcagcccgtgggcgcgaggaaaccccgaggtggggaccagggtctgttttaagttctacgtgaaggcagataaagaagacgcgttgtcatttttgagccatgcgtttgatatatgtatttatctttaactctagttgtatgtgtttctggtaacgttttccctcaaatttcaagtattcagaccactcaaaagcatctgtcatttccattttgaagttaagaaaatggaggtgaagatctctttcccaacagtgaaagcaaatttacgatgaaaagactaaaccttcatctggagcaatgaccgaacccctccccaaggagtcccatgatgcagatgaccttcccatccctatcctataaagtgctgtttcactttctgtcttgccttctcacctcctcagccctgagatgtccacctggctggcctggcagtgaaactatggggatttcttcaggaccttcagcctaggtcctccacgacgacctcgtggtcctcagtcagctctgtgctctcgcttcccactccccaggctccagctcctggtgcccccactgaggatcaagtcctgtgtatgccttcatgcagggatcctcaaacggccatccccagaccagcagcaggagcatctccttggaacttgttagaaatgtaaattctcagccagggcaatgtagcaagactccctctatacaaaaaaaaaattttttttaagttagctgggcatagtggcacacacctgtagtctcagctactaaggaggctgaggcaggaggattgcttgagcccaggaggctacagttgtctatgatcatgctgctgcactccagcctgggtgatagagcaagaccctgtctcaaagacagagagaggtagaagaaaatgttacagtaagatttccaagtttataaattactttgaaggttctaagtttccataaccctccttggggaagaagaattctggttcctgtgacttacttcaggggtgcaagaccgctggagacaggagggcaggagaaagtcatgggtagactttgtttctgaggctgctactgagacctaatctcctttagttcaaagtacttagcatgccaaagcctcctactttggggtatcgttttctgagctccagtagttgagatccggagacttttttgttgaaagaatattcaataccatcttcataaggactattcagtgttgacctcagagcaataagtagaaaatggggggaaatgaaattattagatgtgcatctttataaatgtgcagaaataccttccagaaaacttctatgtagtggaaagcatacatatgtgaatataatatacaaacgttttaaacaagtggggatgtacagtacacagttctcatctggcttctttgcttttagcagtatgctttcctacctcactccttttaatagctgtaaaggattttattatgcgtatgtaacacttctgaagccatactcagagcagtgtctaaatcaatgaaatataaatcaccagccaacaagtatttcaaaataactcaattcctctacttgcattcctggtacatatgaagggtttgtgtggtcctggcaatacattataaatttatctttccttttccttttttcttttttgagacagagtcttgctctgtctcccaggctggagtgcagtgacatgatctcagctcactgcaacctccacatccccggctccaaagattctcatgcctcagcttcccgagtagctgggattacaggtgtgcgctaccacgcccagctaatttttttttggatttcattagagatggggtttcaccatgttggcctggctggtctttaactcttggcctccagcaatccaccagcctcagactcctgaagcgctgggattacaggcgtgagccactgctcccagcccgcttttcttttcggtatgctttgtcacattcctgagcttgcctggagaccacaaagcctggcatctttctgtgccctctgctttcccaatcatgctgcatcaccaaagtctaaacacttttgaacatttcccttgtagagggagaggagaaagttgacccaagactaaattatctgtagctggcagatggtaggggaaggctagaaatacttacgttaataatttttgatccactatgtaacttatttaatcagtctcttcttgggcatttagcttgtcacttgttactggaaatgatgcaatgaacatccttgtatcttttaaaaatgtttttttctgggacagagtctcactctgttgccaagtctggcgtgcagtggcatgatcatggctcgctgcagcctctacctcctgggctcaagcgatcctcccacctgtgcaccaccactcctggctaatttttgtattttttgtagagacggggtttcaccatgttgcccagattggtcttgaactgctgggctcaagcaatctgcctgcctcagcctcctaaagtgctgggattacaggcgtgagccaccactcctggcccattcttggatgtaaatctttgcaatcatgcgcaaatagaactgttggaaatacttttatattgttggatcaaaggaaatgggtatttaagttttgattgttgtcaaattgccctccaaagaaattgcagccagcaatgtatggaagtacctaaatgcaatctgtgattttatttattttgtttcttattttaaaaaatattggggctgggcacggtggctcacgcctattatttcagcagtttgggaagccggggcaggtggatcacctgaggtcaggagttcgagaccagcctggccaacatgctgaaactccgtctcaattaaaaatacaaaaattggccaggcgcggtggttcatgcctgcaattccagcactctgggagccgaggcaagtggatcacctgaggtcaggagttcaagaccagcctggccaacatggtgaaactccatctctactaaaaatacaaaaaattagccaggcatggtggtggatgcctgtaattccagctactcaggaggctgaggcaggagaatctcttgaacctgggaggcggaggttgcagggagctgagattgcgccattgcactgcagtctgggcaacaagaaattaggctgggcgtgatggctcacacctgtaatctcagcactttgggaggctgaggtgggtggatcatgaggtcaggagatcgagaccatcctagccaacatagtgaaaccccgtctctactaaaaatacaaaaattagccgggggtggtggtgcatgcctgtaatcccagctagtcgggaggctgaggtgagataatcacttgaaccagggagttggaggttgcagtgagccgaggtcgccccaccgcactgcagcctggctacagagcgagactccgtctcaaaaaaaaaaaaaaaaattagctgggcgtggtggcacacacctgtaatcctagctactcaagaggctgaggcaggagaattgtttgaacccaggaggtggaggtttcagtggccgagatcacgccattgcactccagcctgggcgacagagcaagactccgtctcaaaaaaaaaaataaataaaataaaattaggatgctttgatttgtatttctttaattataagtgagattaaaaatcttttcacacatttataagtaattttatttatttttctgtgcttttttcttttttcttttgagacagagtctcactgtgtcacccaggttgtagtctagtggcatgatcacagctcactgcagccttgacctccctggctaaagtgatcctcctgcctcagcctccaaagtgctggataataggtatgaaccaccatgccaagccaataaaattttattaccaaaaaaacctttgatttcttctaaaatttttttaaaaagctttttaaaaaatttttttctgctgctgatctgcaaccttcaaagtaggtagtccttcaaataggcagagaaaaaaagaatgcctacttacctaacaaattgcaagcttgcctagttcctaacctgaagcctaaagttcaataacagaaaatgaagatagaactagggttttggggtaatagaatgtaatcaatgtcatttagtgacgtctgaggccattgcacaaaataccaaagactggtgtgacttaaacaataggaatttatctgttacagttctagaggttagagagttcaagatcagcatggggagcttatttggttcctggtgagggctctcttcctggcttgtagacagcaccttctccctgtgtccccagatggtgtttccttaagtgtgtgctttcagggagaaagatttctctctctcttcctcttcttcaacaatcctattgaattaaggcccctcccttatgactttatttaaccttaattacctcctaaaagccttatcttcaaatacagtcaccttggggggttagggcttcaacacaagacatttgggggagcacaattcagtccctagcacctttccttttactcagggctgcattatgacttgtgtgggccccaggcacctttgcctttaaggacccctttttccttcaaaaaaaaaaatttaaaatgagagtttccaattgcattataaagacacatataacgctggctgaattcattattatatgctcattattacagtattcttatttttgttctgatttcaaaagaaattaaaattaaaacattttcatgggacagtaaaattatcactgtgtctactgtgcctaataagttgatctggttttcgcagccagcatcgtagaactattccctatagtagtcatggacattgtaaattttttgatcgccttccccaaaaaacctccaggaccagcagtggagctggctctaaaagaagcgcctatagagagtgggaggctgtccagctgaacacagggaacagctcacacctcccttcctccagcaggctacgaattgccaacacattttggtgaaatataggagagctttagttaatgcttctgccaaccccctaaggaggttcaggttgagcatttttgagaactctttttgttaatagacttttccttttaattaagatataatattcatatatgaggtatacagaacttagctgtacagcttgatgagttttctactttttttttttgagactgagtctcactgtgtcacccaggctagagtgcagtggtgtgatcttggctcactgtaaactctgcctcctgggttcaagtgattcttgtgcttcagcatcccaagtagctgggatcataggcacactccaccatgcctggctaatttgtgtatttttagtaaagacggggtttcgccatgttgcccagggtggtctcaaactcctggactcaagtgatccacctgccttggcctcccaaagatctgggattacaggcatgagccactgcgcccagccaagtttcttttatgtgttaaacacttttattagttgtctattactgaataacaaattactccaaaacttagtatattaaatgaacaaacatttattttatcccagtttctgccagtcagggatttgggtggttctaggtggttctggctcagggtctctcctgaggttatggccaagaagttggcccaggctaccatcatctgaaggcttgactggggctggaggatctgctgttgaagatgctgtgggaagctgggctcggtggctcacacctgtaatcccagcactttgggaggccaaggtgggcggatcacttgaggtcaggagttcgagaccagcctggccaacatggtgaaaccctgtctccactaaaaatacaaaaattagccgggcatggttgcacatgtctgtaatctcaactactcgggaggctgaggcaggtgaattgcttgaacccaggaggccgaggttccagtgagctgagatcatgccactgcactcctgcctgggtgactgagcaagactctgtctcaaaaaaaaaaaaaaaaaagatgctgtgggaaggaggcctcagttcctcctctccataggctgctgagtgtcctcaggacttggcagctggcttcctccagaaggagtgatccaaaagggattgagagcaaggcagagccataatgtctgttatgagttagcctcaaatgttatatgccatcacttctgccatgtaatactgggcacacagaccagtcctgatgcagtgtaggaaggggaccagacaaggacaagaggaggggagcactggggccatcttggaggctggcaaccacaacatccatgtagccaacacccagaggaaggatatggaaactttagcacttcagaagcctcctttatgcccctttcccagtcgatatcatcacccctcctttaaccgggaggcaaccactcttctgatttctctcactgtaagttggttttgcctgtccttgaacttcatgtaaagggaatcatactcctctgcgtctggtttctttcactgaacattatgtgtgtggctcatccacattacttgtggtggtagcatcttttaaaagaattgctgtgtagtattccatggctcaaacatatcatggcagacatctgggttgtttcttcttccagtttgggctgttacaaataaaggtgctgtgagcactgttgtacaggtcatgtgttcagtatacacactcaattactttgggttctgtgatagactttttaaactctttacttacgcaagccaaattttatagacatcttcatttaaaatagcttacagctacaactcatgactttagtaccaatggttatgacctactcggaaatgggcattgttgctcagaattctggtaaaatgttactcatcctagtaaggaaggatgtttgagttggtgattaatccagtcatgggttgtggtgtaacttccactcagttaggatgctaccagagttggaatgacttgtggtttagcagtcagggtttcaaactggcattgccttccctgcaggatttgctcacaggacatagtttcctttgccaggggtggtttttgatcaaatgtttcctaaaatggagagtccaactcctgtaaactgaagactttctaagactattcttaaaacttgaaatgtaggaataacaacagcatttcactcattaaagctcggaggattcaatcctagtgagggagggaagaagaaccaaagatagcggaaggaattttttctgttgacagagataaggctgacatgtcacctaagaactgaagatctttaattaacttcctttatgttatttttattttactttattttatttttactttttgagatggagtcacactctgtcgcccaggctggagttcagtggtgcgatcttggctcactgcaacctccgcctcctgggttcaagtgattttcctgcctcagcctcctgagtagctgggattatgggcgcccaccaccacacctggctaatttattaagttttagtagggacagggtttcggcatgttggccaggctggtctcgacctcctggcctcaagtgatctgcccgccttggcctcccaaagtgctgggattatagatgtgagccactgtgcctagctgaattcctttgttgaaacataacctcattcatattaataaattaattttttttttgagagagagggaattgctctattacccaggctggagtgcagtagtgagatcacagctcgacctcccaaggctcaagtgatcctcctaccttagcctcctgagtagctgggacttctggcacacaccaccatgccaggctaattttttgtattttttgtacagacggagtctcactttgttgcccaggctagtctcaaactcttgggctcaagtgcttttcccaccccagcctcccaaagtgctgggattagaagcatgagccaccatgcctagcctcactcatattttaaaattacctgaaagtattgctaaaaataaggattaggtcaccaggaaaagaatcgaagactttccagacccagtgatacataggttatttaactgagggctaagtatagtcagagggcccagagaaaacacctctgtgtgactagtttaccctccatgtgttcattacattaagcagaagaataattattttcacatttctcgactagaatgtctaatgctagttttgcctgtcattttttgtttttgtttttctccatgctttgaagtacaaatactagggtctgagctgctatggctcaatggcatgaaatatcataacatggtgtggctttgttcacagccaggcatgttctaagcactttagcatcttttcacagtgagatgaagttcaccaatttggctgggcaaggtggctcatgcctgtaatcctagcactttgagaggccaaggcaggcagatcgcttgagtccaagatttggaggccagcctgggcaacatggcgaaactccagctttaccaaaatacgaaagttagccaggcatggtggtgcgtgcctgtagtcccagctacttggtaggctgaggaaggaggatcgttcgaacccaggatgcagaggttgcagtgagttgagatcgtgccattacactccatcttgggtgacagaccaggaccctgtctcaaaaaaaaaaaaaatcaccaattaaaaccaatcaaccagcataggtatagatccgcaaccataaattatctcatttgaccaggcctgtttgcattgcaccacgcctatttgcatctctatagggtggtaccaagtctgtttttttcatgttgccttagtcttagtacagagcagaggcaatgcacactgatagttggccggtgattcctagaaagcatcaggagtatcttcacaaatacaattctatccagtgaggagtagaatcatttcaagggaataattttatttaatttaacgttagctccaggtccactcaccaatccttatccataatctccattacaaggccagaattcttttttttttctttttttttttagatggagtctcactctgtagcccaggctggagtgcagtggcacgatctcggcccactgcaacctctgcctcccgggttcaagcgattctcctgcctcagcctcccgagtagctgggattacaggtacctgcccctgtgcccggctaatttttgtagttttagtagagatggggtttcaacatcttgaccaggctggtcttggaactcctgacctcgtgatccaccctcctcggcctcccaaactgctgggattacaggcaagagccaccacgcccagccacaaggccagaattctttgatgactgaacaagctcatcaaagacagagtggtggagcaaaagcagcctcgagtttcccagcctttgtgtcatatggccacacttcttcacgtggttcgctgcctgc

SEQ ID NO: 1153 - DNA, 25990 bp, Homo sapiens
cataagaaaatattttccaggatattgaaaagtaggcatgacagagatattttaataataaattattaataaagattaaattaattcaagtcttatacatacataggatacaagagaagaaaaatacttttatacaaacgtaggtccacatccaccatgctagagcaccatttgaccaagtaaattttttttaaagtgacactttttttcaatgtaaacatgaaggttatgaagtaggtcttttaaaattatgtgtttcagcataatatgattgtcaagtagaagatttcagagttaaacacatctcagttccgatcttgatcctggaactcattaaccacgtaactttggggagagtttctgatcttaatgagccatatgttcctcacctgtaaaatgaaaatatcagtatcatatctaaacctcaagactgtggtgaggattaatacagttgagttgatttatgtaaataaagcacttagaagaatacctgatacaatctacatgttagataaacaatacgttatttctattctaattaacatcctcattcagaaaaaggtgctgaatatgtttctttatatatatctatacatggaaaatgagagaatgtgagagcaagaatatgctctgcaatagtacctacatttaaaaatttgatgaggcctccaatgtactcatgaacttaatttcaaaaaaagtagaatcctttccaagtaatattaccatttatcagaaatcacagaaaattctaacttgataaaaacataaattgactggtaattttaaaatgaattctaattacttattctaaaatatccaatgaaacagatacttgattaaaatacaatatggtattttcacagttttcctacatttctgaaagcagtcatgatgaggaaagttgtctgtggcgttggtttgtaagttcttggcttttgtagtttaaaatgattgtttttgtaagtagaaaagtttctcggaaaaggaatagagaaaacaaaacttctttcattgaaatgtgacctgaacaataagcactattcttaggtgaacttcatggttgataatctcagcttagagcacttaacctgcagattggaacaatactggatatatttcctcatatcagaatgagtttcttaaggcttttggaggaacagaaatagtgtagctcagtacttctgtctttaaaaagtcctaacaatccaagacaaacctcagaaaatccagaaattgggaggtcctgattattacagaatgtatgtcagggattatagtaggttggtacaaaagtaattgcagttattgcaattgaaagtaatattcaagaaacctggggaatcttcaacaaatgatgagaaagaatgtttaatcaagagagtcataaagtttatttaatatatcctaaaagtgcatggaaaaaaattatccaatgtcttggttatgtgaaaacctacagagtatggtgttgaaacagatattttctttggaaacagacctgtgttcaaatctgagttctattactagagaactgtgctacctcaggaaaataacctctctgagtctcagtttcctcaatgtatgctgacaatgatattttgcatatgcttaggatcaattcagaaaatgtatatagaaaagatagccaagaatctgatgtatggcactaaacatgtgctagattcacatatctctaaatatttacaccccccaccccaccagataaattacggttttagtaccattacattacataagaaagatcatgtggccctggtgggagtattcacgctataaaaactgggagatggtataaatcgaggccccctttttcggcagagatctgttttatcacactccactgcctaaaggatagaatttgagaatagaggcattggtgaaagcaaggggattctcctgaacaacattttgaagttaatagtttagattttttcaagaatattttataattaaaatttcaaaaagaaaacgaatatatcagtatgaaatggtgacacatgctttgcagagaacttaaacagggtagtatgatagaagcagctgccctagattgagtaatctgggaacattcttctgtggagtgatacctaaaatgagatataaattataagaatccaccagcccctcactaattggaggcagcgcattccaggcatagggaacagcaggtgaaaaggccttaaagagcaatgcatttaacatattcaaaactcagaatgaaagctagtgaggttgcagcttagtgaataaggagaagaatgagaagtcatgaagtggaagaataaagcaaaggccagatcactgaggactttgtaaaccaggtttaaaaaaaaaaaaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttccccatgcctatgtcctgaatggtaatgcctaggttttcttctagggtaagaggaaaataattgaaataggagataaggggagaaggaggagaaaaaggaagagaagcaaatggaaaaagggaaggagaaaggagtggagaataagaaagaaagacaagatagcaatttttttgttttttgtttgtttgttttttgtttgtatttttagtagagaaggggtttcaccagacaagatagcaatttttttgttttttgtttgtttgtttttggtttttttatagcaaattttttgaagagtagaataaaatacattgctatcagaaagcataacatcttatcaaggagataaacttttaatgcaacaaaatggaaaaagattatcaccagaagtctgagggagaactaaggcagactgggcaatgtattactccccttgactaggacattcataagagagtcccctcaccacaccacaggctttgctaaatgtttgggaaggaggagaaagcctgatattggccaaacattgtggacttcctccctcatgacatcaatcataggcaagttaccagaaccataaaattttgtttaaaattgagttgtttaatgacgtgttttgtttctccaaaaagttgtagtacaaaaactgggttaaggccaaactgattgcaggccccaaacaaagaaacagatgcaggagtcattaaaatggtaaggatggaattcacaaagcaaaaggcaaaataaatactatagaggtttagtacagaaagaaactctttcaggtcaagggacaaaagaaattactttcagagaaagtggatgttgatttacacccaggctagaacaagctgtatttgagagacatgtctcccattgcatacttgacttgccacacttcagggaatcgctgaaagttgaccatttctagcccaaacttagctgtgtgctggcctctctcaactactctgaaacttatgaattccttcttatgaaaggaagaggtatattcttttatttttcttaacacctttatatctaagccaacactcctggaaattatagccataattcacatacacatacctacaaatcttaaatataataaaatagactcacctcatcaagctagagttactaagctaggacatactgtcatagtggacatgggatgattagtatccaataatgtacaatatcaaatagaagggattactttagtaaagtctcatggtagttaacagaaaacacccaatgtaatagaagagatttagttgacagcttgctgattctctgtatttactgctcgagttataatttttttgttaattgtctttattatggtactatgtctttctcctctctagttaggcatctgggtgctttgagatagaactacataattgagaatcaaaagacctgaattctagccacaagtctggtaccttctgaaagtgtgaaaaaaactgtaatgtccatgaaggtaaaaactatttgtattaacattagcactaagttctgaatgcctagcaaggatatggactatagaagttgtgcaacaactatttcttgtataaataaactaattcattaatgaatgaagtcactgaaccttctgtacttcagttttctcgttgaagcatgagggtgatatatacatatcttgcctaccttgatatatcattagaagtccctgggaaattacagctcaggtggaagaaaattattttaagaagcgataaaatttaaattcagttgtcatgatccacagaacattgctctgctttacaatggcactctgttaagccttgattgatttttcaggatagttgaaggaaaagagagcagggataacattttgaaagcactaatttacaaaccactgttgtttacttttcatcatctatgttactggaacagaacaaagatatagatggtacataattcaacagtcatgtgtacttggcattagaatatgtttttgtacttttatttgaatggagggttgtctggtgttctggtaattgaactaaaccaaaataatgaagttataatgatgacatcaggttccggatttcctcatcttaggtccctgcaacttaatccatacagactcacattgctctggaattagaccacctttttttcttccctgaatgaagaaaccatttatttaacaaaacttaggggaatacctattttgtgactgacacaggaatagataatgagtatattcaacctagttgaatggaagaaacagacatatacaatatccacactacaacgtgatgaaaactagagtcccttgctacttcccctcctagctagagataactttgcctccaatgacacaggttcttgaaagctatcagataataaagcatagcctgttctttttcacttcaactgctgaataactggagagtttcaattgcttttctttaaatactcaggtaatgaaaaataaaaacaaaaagaacgcaatgacggaagtcttccaattgtctccagagttgaggaatatagttagataaacaattcaccatcagaataatttttaaattgactgtgtttttcactctataatccagttgctgacctttccagtgcttggtcttgacaattttctggctcagtagtggggttagctggctaagaccctgcagcctgcaatagaaaatagtctctcaagagaatgagagcttatggcgtatttaatttgacaatattcagaatagaccaaagtcattaattgtaaatatatatcatcatgcaatacagaaccttcctcctagttcactcattcaacaaatctactgcattttccaggcaacaattggttacattaacgacctttatgtttaagctttagttaaatctgccattaacatctagggttgtctaattttttagttaatctaagaagaccactatcacaaatctcaggaaagttacttttgctaaaagaaaaactttcagcaaattaaatttaacagaatttaattgagtaaagaatgatttgcaaatcaggcagcctggaataaaaatacattcagagtgactccggagctgccacgtggtcaaataacatttatggacagaaaaggaaaacggtgtacagaaaatggaaatgaattacagaaacagtgagttggtacccgttgcagctctgcaattgccttatttgaacacatttgaacagttggctgcttgtgattggctgtcactcagcttcttgttaaaacagtaggttacagtttgtttaacatcattaggttacagttcactattataagaaatctttaggtcaaacttaaaatatgtatggaggcagctttaggctaaacgtaattcaatttaatactttctaatagatataaagtcctactggtgggttttcttctttagtaaagaaaaatgtctttttattctaactaatgatttatgtacttggattttttgaccagataaataacaaatagtataattattttagtattaatgagccatgcaagctctgtctcattctaccaaaaaagacaaatgtattaaaaggcaataattttgttttcctgcataagactatcatgagttgctcaagattaagttagctaaaaagaactcttccataataaaaattaattgataatacattgtcaaaacacttgtgatcctgaactattagaggggagtcgatattaacaacaaaaaaactacaaataaacacaaaactcccattatgaaggaaatttaaataataacaatgtgcagagagtaatagttgtattttgaatattaaaatatataacaaaaacatttttcaataaaaacatgtattcacggctattttttaaaatgtaggatatcatgctttatacttattaaattatttatttcaagcaacatgatcatatacaaatacatttcatagacacatggaaatttagcaattttttaaggactgcattcagtaagtagagggagaataactgatgttttcaaggtcaaatctaaaggaaactagcccacatttacttagcccagcattgaggaagcaaagaattctgctaagtaggctttgaagttttgcttttcagacctatgattcctaacaattctgtatttcgcccttgaagtaaaaataatcacccatttatccttgactttattaaagatattaacttttattcagttacagtatccagttttattcaattagagtatccagtttaagaattataaaagagtagaatagaattattctaggagaattattctaggagaattactcataaccaaaccagaagccagaaatgatcacaggaaaacatttctcaggggataatttaataacattactaaaagtgtgggaatccatataccacctaaatgattaggaaagaggttattagctaagccattgtctgaaacccactgaatcactggtcctttttgaacaatgattggtcctttttttctaaagatgagttttaaaatttaagagaagtgccaagcagtagagctgagagaggaaaagaacacagatctcgcatggttcagatttttctttttaggtccaggagtaaggtaagatatcaaatctttgcttttatagtttgaagaaccaaaatcagtgaaatctgcaggatagactatcaagttcaccctaaatgcttgattaggtcaatgatttgaagcagggaaaaaagtttcacatctagaagacaagagaaatatacttaaacaggttacaccataaatcaatatcacagttcagttttataatctattgccataaattacaaaaacattgactcagttgcttagttctagtatattattctgttattagactactaagtggaaattatctggtattggactggtattgtcaaatctctattgaagtacttttcaacatagacattaaaattgctgcagtaataagtccctagttggttagccttagtcatgacctcccatggtctgatgggcctgctcctctccttgtagggcagcactaggaggagatcatcttgttctttaatgcattcaaccacatcatatgtctccaaatgagtattttgttcaagctaaaaggacaagcaaacaatcttggtttttataaacagcttgtctgagagaaaataaagagttatatcagaaatttacaaacataactttttaaattttaaattgcaaaatgtaagtaaatactatagaattcacccagctattcctttgattgaacaatactaattattttgtcatgaattttaagtaatgtctttataaagctaaagatcacaacttattttctagatatatcatacgaaaatgaaaattataattcttcttggattcctgggagccacattgtcagccccagtaagtgattttatggcactactagtcccactgtgttaaaccttcaacaatcccttctttttactatttctgatttttttttcatttttacttttagcttatcccacagcgtctcatgtctgccagcaatagcaatgaggttagtttaaataattaaaacaatctcctcctttttttaatggaaatcaagtgggaagagatagaagtcgtcatttaatttatactgtgttcctcaccactagcttttatgtatatccaagcacatttctaatgtccatgtttgattatataacaggttacctctaaaatattattctgcttcccttgattgattgttaattcttcaaaggcggatacaatattgtttatatctttttgttctaataacacctcacacaggtgtatataggtgtttaaaaacataaaatgactaaaccactggaatgtgctaacgttgtgcaatctcatacccaacagaggagaggttgttaaatcccaaccttgttttaaatctaacttctaatcactgtaatttaatgtaagcctagtgagaaaatgtcccacttctaacaagaaattgagcaaccagctatgacttgtgctatatttgcagtaaacattgttcctactcattttagtgtgtagtaatcttgatttcatattatttttctttttctagttacttcttaatcttaataatggtcaacttttgccactacaacttcaggtacctccatttcaataattactttatggggaatatttacctattgctcatttatgttattttgtaagaaaacaaaatgtttcctgatcctattttggaaatctcagtttttaacattatgaatttgtctcatatgttctagtggccatttgcttgaagattaaagtaaaaactgtaatttgaacaacacttatttattgagaacttggtatatgccaggcactaattctcacaactatgagatagttaaaagtaattattttacaaaaagtcatgcccagttaaccagtaacagcaggttggcaggtttagggttaaggtaggggaaaatacagacggtttaaaaccagtgtggcatatgcagatgttgggctcttttatcaaccttatcctgccccatatttctcatggccatcgggaatttagcatttgcttcgtattatttgcttggttcaaaatgaatcaagatgctgtccttttttatgttgcaacattggaactatagaaattgtttgtattttgcctctttcttgctcaggactaatttttaaattctttttggcatgaagggaacatgctttctttcctttgtgtctttttagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtaagtcaggcctctttcattttgttctgaggagagagaactgcatgtttaatctgacaatgaatatgaatcagctttgaaataggcaggggtttttgaacaatattttttctcattatatgtttctaccatcgctgtaagttctttcttttattttctgatttctaagacaaaaaatatttaaatcagctactctaggatacagcaacaagccaaaaaagttaaaaacaagtctaggataagataggaaaacttcaataataggcagtttatgtcagcacatgtaacggatgactttttgttgtggaaacttgttaacacaaaggataaatttatatggctagctctaggaaaagcagctcagggatttttaaataacaaagtcaagcatacatttttatataattcttttttttggcaggtgatgccctatgtattctccttcaaaatgcctcaagagcaaggacaggtaaatggatataacaacactgcccatagagatggctacatacactctccacaatgctttctatttctagctctgactcctatagcagggctataaaaacctatataatgatatcactgtctagataacatcattgctgggctagtatcagtttgttgatgttgggctcacttaacaactccttaaggacaggcagctaagtagagtctccaggacccctgaatttccagggcattgctatgttgagagtaaaagagctcagtaagccccaggtcatgtcctctctgcatccaaagtgctggaagttgggaaaaactcaagagaaataccatgggctgactttatccaaatttaaattttgcttcagaaggagatgcactaagctgataatatatgatatgatgtagagataagaaacacttgcccatgttatttggctgttatgaaattctgctcaaaacattttaagcttcttatacatttccaatttgaatccatattacaatcaaatggtaattttttccattaaataggataatcttttaaaaatgaatgcaaactagtataatcatcatattaatatggaaaaccctataaatatcaggattattaattttacaatattctgggttcaaagaaacagtattataaataaattatattactcatcacagaatattggccttttcataaaaagttacagcatttgactctactgtaattataactaaataactttgtcccacatccactcccattataaaacaaaagttacttctagacattatctcattctatgacataagcatttaaagaattagatgtataactagaattacttcatcttaagaatcaagaaacctagtcttaatgagatcaaattcctcatcccattgaaagtaaatagctgagttggaatataattctccaccccttctgtctcctttaaccatgaaaccagtagctctccatcctggctttacattagaatctctggtgtttgaaaattacagacgtctgaaccctaccccagtgaatcaataccccatgaatagatgttaagtttggtcatcttctaaaatgctcaaatgtgagtttgattcttagccaggattaagaatgcttgcacaaaatataatcctcctgaaaccctagttgttttttttaacttcatgtctaatacaatctcttactttatgcaaataaaaacagcatacaaaaattaacatatgtactaagattctcattttctatgaacacatacacaaataaacagacacagacatataagtagaaggcaatgataatataaatggaagccacatggtaatgtaggtggggaagtttcagatgatttcatttgttacttgtctatgtcttgatttaccaaatatcctaaaatatatatggattattttaataaagtagcaattcttaaaggcaatacattcatagcatttcatttattatggcagaacatctaataccacattctgcagaatgatgattctcaaaaatatagggtaagtgctacataggctatctttcacttaggtatttgcaaagtaatttgtatataaagtttctaagatgtcctttgaaaaaaaaaaaaagctcttctgcttagttcaacccactatttcctaaatgtgtttgcccaagcaaccttaaaaaccaagtccagtattacctgggatacaagttgtttccaaagtttgggaagggattcttcatctatttgctttgtatttaatcatataaagctgctagacataaaacagcttttaaataaaattgacattagaagataaaaagtatgtcctatgctgatttaatggaatctcttgtatccttctctttttacaagtagatgtttcaatactatccagtttacatggtcctaccctgggaacaacctcagcaaacagttccaaggtcacctcaacaaacaagacagcaacagtatgaggagcaggtactgcaaatgttttattttaatcctactagttccacttgaaaatagagaaaataaggtatattaccatagaaaaaaagtttctgagtatatttaatgcaaacactcaacagcatgaaacaggtaggcataagagggtaggtatagtgttctcggctataaatcatttgtgtaaacttatttggtaatattccagggctggatttttagccaatgaaatcagtaagtggacttcaatagaatcaaggccaaaaagctgaataacctcgaaaagtgaagttttctcacatttaaaatttactagcatccacctttccacatatgtgtgtgtggttactatttaaaaataataaatggcaaaaatattagctaccttgatgaaagatatatctgatcactggattttgagatacaattagataccattatattaaattttgtgaaactgcaataaatttttagaattctaacataaattcaggtggctcatatattattaacatccttcctgttagaatgaaaatgtcttttttttagtttaatcataactctaaaacctggcattacaaattagagaaaactcagaattatgctttaaaaaactggtagtattaattctaattgtcatgttgctttaaagggaaagagagagttttatcctagaaatgatatggtattaaaaagattcttgttaatttaacaataattaatttttagttactggaacatataaactttaaaaatgcttttaacttatataaaaagatatataagtttaagtaatcatttactgcaaacttacgacaagaataatcacagaaaatataatacattttttaaaaaatctgacagataccattctatgctcaatttggatacattccacaactagcagaacctgtaagtaaatgcatatttttcattaaaaatattttgaaactacttccttcattgtctactaaatctatcaatgcccttcagccaaagatgaccaggagcgcacctctaattgaacaaaattgtatgtatccactcagtacaaggaggagaacacacacgtggggattcttgggtgtcttaataggaaagtattagaatgacttctcacatgatttgggcttcttttaggtaatttggggaagattgcaaagaagtggttgttcactctgcagtggctattctcaaaagtagggtagctctatgattattttaaaagctcatttctctaaggcaaggatagtggagcaaggtgaaagctttaatgggtaaagaagcatcagtcgctcatattagccaagatgtgagaacacctggtattttcgtaacttgtatggtgaccttacttcagacaaaattttgaaattgtcttgttttttccaccccttctgatgttggtgttctgtagaattctttatgctcaacaggtaagtacctggtcctagtagagaatgttagaaagtagcactttcagaacagaagcagaggcgagatgtcaagccagttctctaatagcaaaaattaaactattatttctgtttttagcaaaataatttaagaagtttgggagtgttttactactctggtactctgggtggccaaagagcatattttcaacgatcactgatttagactttttaaaactttttgtgtttttaggctatatcaggaggacagcagcaactagcttttgatccccaactaggcacagctcctgaaattgctgtgatggtaagattccttacaacactttgccagctactggaaatcaacaattgacaacttactgcactaatgttcattttaatatcaactctgttgtaattccatcaataatttttgcttcttcttcttcttacaatattttgccagtaaagattcagttcactcttactcagttcatcagtatttttaagtatgctatgccaggtactctttgatgcacctttatttaaaagcagatattaagagacaatgtttgctggtatatattcatggtcttttatgtagcttataatctaaaaatactaataatagcaactctttttttaatataatgcttttgttacatctcaatcctgttgctttacattcttcccaattttggccttcttgttgaacttacgacaactttgttttcattctcattctctgtagtcaacaggagaagagataccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggtagagtcatgaaaacttcactttatgcaaaaaaattgtctaatgaaaaaatacagtgataaaattagtgctttaatttataggacttagtcatgaaattaagaagataactaatgaaaaatatgtggtcttaactctgaataaggtggccaaaacttgtttttgataatcaattaatcagaatataatttaatttcaatttaataacagtttcttatgaatgtccttttctcactaggacaagactgacagcctaagggaaccataagaagttgccctgatcattcagacattttggtaggtatttgccaaagtcaagaattaggtgccacgacaattcctacataagaagacaaaagaaaaaagttggcagaggagctaatggagttcttaccaaagtagttataaaaacaagttagctatatatacctataaaattaataataattatggacttcaacaatttttaaaaacaaaattaaattttgagaatcatgtctgcctataagtttggtatactctctgaaaacacaaatactagatattctaggtccattgtaaaagacattctatagacactccatacagaatcaattctcccaaatcatcatttcattttgcaagtaaacattgtaataattccaatatatctgtattagtttgaaattaagtaaaaatctcaaaatgataaagaaattgtacaatgaaaagaaaatttcaaattccatgacttttatatcagacataatcttgaactaattacctgttttaatcagcttggttggctatgaggccacaataggagtttgatagaagggcagtctgggaacagcaccaaaaagtaaaaacacacactgaaaagcaaacaatttaacttgaagggcaaactaaaagacaaagtttttgaaatctcctccctgctgcctgtgagcctcttttgatctctccttccataaaaatgagcacgcagcattcttcagatgaaaaaagtttataaaaacacaaccaagtgaacagtaataatacctctttaggaaagcctccttactaatgtactatattgtacaaggcaaatcaagttattcagtaagaaatactaaagagatttcagtatttttatgaccttttttctgtatgtatgaatgccagtgaaagaaaagctttctatttctttaataagcaatttgtaagatatctaggatgttttatgcaaagcagtccaatgatattaaaatgcttttctattatatttttcagggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatcaattggataattgcattagtaaatgatgcctctgcaaaatggtagtacccatgaagatatgtatattgtcattggatgtatgatgagtgttgtgattggaactgatgaagtaaaataagtatctagatttgacatgtcatctcttcatttccctaaggtccatttagtcagtttcctcctgagacattctcatgacaatcaaaattatttggtggcagatatcataaagtgcttattcctaatatgacacagtcacatagagaggtgtctgtccttactcaaaaggataggaaagtgtatgcttgtttgggggaggcagcatcctgtagagaataaggtggagattttgggtttcatcagatctggctttcaatctagaataatttctctaaaatcagctttgcttacatttggtaattctcaaaactttccctaccaactattctccactggatgtttcctatctaaataaaacagcattagttcaagaataaaatatagactaacacaggaacagaaaaccaaacaccacgtgttctcactcataagtgggagttgaataatgagaacacatggacacagggaggggaacatcacacacaggggcctgttgggggtgggaagcaaggagaggggagagcattaggacaaatgcctaatgcatgtggggcttaaaacttagatgacaggttgataggtgcagcaaaccaccatggcacatgtatacttatgcaaaaaacctgcatgctctgcacatgtatcagaacttaaagtaaaatttttaaaaaagaatgaagtatagaatccatacatgacttcaactcctccatacatctatattcaatctgtcatcatagcctaatagagtaatactttcaaatgaagacattttaagtgtgtagtgtgaaaaatgtatatatcttgtaaccatcaccccattaagatacagaacatctccaacaccccataaacttctttcatactcttctccaatcaatttagtctccccactctcatgccaagcaactattttcatatttcaatcaacacatattaatttagcctattctgggtttttatataaattaaatcatacatgatgtattctttcatgtctggtttcttttattcaacataatgcttttgtgattcattcatgttattgcttaagtggtataccacattgcattaatatatgtcattttctttatccattctcctattgttgaacatttgagttgtttccaattattgaatatcagaaataaagctgcagtgaacattcttgtacactttttgtaaacacatgttttcatatctcttaagtaaataccaagacacagctctaactcaaaggatatgtatatgttatgagagactgctaaatagtttctaatgtggctgttccattttatacccttattaggagtgaataagaattccagttcctctcacttctggcccacaattattatagaattgtcctttcttaaaattgtttttataaattcctcttttgtcacacatcccttaaatgttaaccttcatacaggttgacctcagtcctcttttctcctctctctcaaaaaatcgctgcatcgattttttttaaattgctacatgaacatttccattttgactttaataggatttataaaaaggtactggctcctaaatctgtatctcagcatatttatagtctcatctattaaatagttctggattccgtgttttattttaaaatgttcaaagaggcatctcatggtttaaatttgcattatcctgatgactaattgtgttatatttgtttctacacttatcagtcattagtataacatgttttttgaagtgtactactgctacgtataacttttaaataatttttaaaagaaaaaatatatttacttacatatttaccaatttcagtgttcttccttcctatacgtctgagatttcatccactataatttcccttttatataaagaaatgtctccaaaatttatttagtttgcatctgattgctataaattcccccatttttatttatcaaaaaatgcctttattatgcccacattttatagatattttttaatataaaattctaagttgactgactttttttctttccacacttgaaaattgttctaacattatcttctggcctctaatggtttcaataaaaagtcacctgccattcctattgacattcccctgtatgcagtgtatctttttctagagctgtttttatgactttctctgtccctttcatgtccagcagtttgactcgaggagagttaagtgtggctggctaattttgtaggaatcatattaggtgtgcactttgctttctgaatctgcatattggttttgataaaaataggaaaagtttcatcagtacttctttgactatttttctgtttcgtttttttctcttctctcattcttacaactccaattccatgtatattggattaattgacactatttcttaggtcattgagcctttgttgatttatattttctgagcacttcagtttgaaaatttccatttaccttcaacttcacagatcctttcttctattagagccaatctgcttctgctactaatatcatctaataaatacatccagtttttttaaattttaagtttaggatttttatttaatttttaacagttttcttatagttccagaaattttctaactcatcactcgatatactcagcatattcctatcaatcttctagcatgtttattctagttgaagtgtatttttttactattattacactttaagttctagggtacatgtgcacaacgtgcaggtttgatatataggtatacatgtgccacgttggtttgctgtacccatcaactcatcatttacattaggtattcctcctaatgttatccctccctcagccccctaccccacgacaggccccagtgtgtgatgttccccactctgtgtccaagtgatcacattgttcaattcccacctatgagggagaacatgtggtgtttggttttctgttcttgcaatagtttgctgaaaaagatggtttccagcttcatccatgtccctacaaaggacatgaactcatcctttttatggctgtatagtattccatggtgtatatgtgccacattttcttaatccagtctatcattgatggatgtttgggttggttccaagtctttgctatcgtgaatagtgccaaataaacatacatgtgcatgtgtctttatagtagcatgatttaaaattcttcgggtatatacccagtaatgggattgctgggtcaaatggtaattctagttctagatccttgaggaatcgccacactgtcttacacaatggttgaaccaatttacactctcaccaacagtgtaaaagcattcctatttctccacatcctccccagcatctgttgttttctgacttgttaatgattgccattctaactggcatgagatgataccgcattgaggttttgatttgcatttctctgatgatcagtgatgatgagcattttttcatgtgtctgttggctgcatagatgtcttcttttgggaagtgtctattcacacactttgcccactttttgatggggttgtttgtgtttttcttgtaatttgtttgagttctttgtagattctggatattagcactttgtaggatgggtagactgcaaaaattttctcccattctgtaagttgcttgttcactctgatggtagtttcttttgccgtgcagaagctctttagtttaattagatcccatttgtctattttagcttttgttgccattgcttttggtgttttagtcatgaagtccttgcccatgcctatgtcctgaatggtattgcctaggttttcttctagggttcttatggttttaggtctaacatgtaagtctttaatccatcttgaattaattttgtataaggtgtaagggagggatccagtttcagttttctacttatggctagctagttttcccagcacaatttattaaatagggaatcctttccccatttctcgtttttgacaggtttgtcaaagatcagatggttgtagatgtgtggcattatttctgaggcctctgttctgttccattggtctatatctctgttttggtaccagtaccatgctgttttggttactgtagccttatagtataaagtcaggtagtgatgcctccagctttgttcttttgcttaggattgtcttggcaacgcaggctcttttttcattccataggaactttaaagcagttttttccaattctgtgaagaaagtcattggtagcttggtgaggatggcattgaatctataaatgaccttgggcagtatggccattttcacgatattgattcttcttacccataagcatggaatatgcttccatttgtttgtgtcttcttttattttgttgagcagtggtttgtagttctccttgaagaggtccttcacatcccttgtaagttggattcctaggtattttattctatttgtagcaattatgaatgggcgttcactcatgatttggctctctgtttgtctgttaatggtgtataagaatgcttgtgatttttgtacattgattctatatcctgagactttgctgaaattgcttatcagcttaaggagatttggggctgagatgatggagttttctaaatatacaatcatgtcatctgcaaacaggaacaatttgacttcctcatttcctaattcaataccctttatgtctttctcttgcctgattgccctggccaaaacttccaacactatgttgaataggagtggtgagagacggcatccttttcttttgccgattttcaaagggaatgcttccagtttttacccattcagtatgatattctctgtgagcttgtcataaatagctcttgttattttgagatacgttccatcaatacctagtttattgagtttttagcatgaagggctgttgaattttgttgaaggccttttctgcatctattgagataatcatttggtttttgtcattggttctgtttatgtgatggattacatttattgattttcatatgttgaaccagccttgcatcccaggaatgaagcccacttgatcgtggtggataagctttttcatgtgctgctagatttggtttgccactattttactgaggttttttgcatcgatgttcatcagggatattggtctaaaattctctttttttgttgtgtctttgccagactttggtatcagaatgatgctggcttcataaaatgagttagggagggttcccactttttctattgattggaaggaatggtaccagctcctctttgtacctctggtagaattcggttgtgaatccatctgctcctggactttttttggttagtaggctgttaattattgcctcaatttcagagcctgttgttggtctattcagagattcaacttcttcctggtttagtcttgggagagtgtatgtgtcgaggaatttatccttttcttctagattttctagtttatttgcgtagaggtgtttatagcattctgtgatggtagattgtatttctgtgagatcggtggtgatatccctttatcattttttattgcgtctatttgattcttctcttttttcttctttattagtcttgctggaagtctatcaattttgttgatcttttcaaaaaccagctcctggattcattacttttttgaagagtttttttaagtgtctatctctttcagttctgctctgatcttagttatttcttgccttctgctagcttttgaatttgtttgctcttgcttctctacttcctttaattttgatgttagggtcctgattttagatctttcctgctttctcttgtggggatttagtgctataaatttccctctacacactgctttaaatgtgtcccagagattctggtacgttgtgtcttttttctcattggtttcaaagaacatccttatttctgccttcatttcgttatttacccagtagtcattcaggagcaagttgttcagtttccacatagttgtgtggttttgagtgagtttcttaatcctgagttctaatttgattgtactgtggtctgagagacagtttgttataatttctgttcttttacatttgctgaggagtgctttacttccaattatgtggtcaattttagaataagtgtgatgtggtgctgagaagaatgtatattctgttgatttggggtggagagttctgtagatgtctattaggtctgtttggtgcagagctgagttgaggtcccgtatatccttgttaattttatgtctcattgatctgtctaatattgacagtggggtgttaaagtctcccattattattgtgtgggagtctaagtctctttgtaggtctctaaggacttgctttatgaatcaggatgctcctgtattgggtgcatatatatttaggatagttagttcttcttattgaattgatccctttatcattatataatggccttctttgtctcttttgatctttgttggtttaaagtctgttttatcagagactagaattgcaactcctgcttttctttgctttccatttgcttggtagatcttcctccatccctttattttgagcctatgtgtgtctctgcatgtgagatgggtctcctgaatacagcacactgacaggtcttgactctttatccaatttgccagtctgtgtcttttaattggggtatttagcccatttacatttaaggttaatattgttatgtgttaatttgatcctgtcattatgatgttcactggttattctgcccattaattgatgcagtttcttcatagcatcaatggtctttacaattgggcatgtttttacactggctggtactgcttctttctttccatgtttagtgcatccttcaggagctctttaaagcaggcctggtggtgacaaaaatctctcagcatttgcttgcctgtaaaggattttatttctccttcacttatgaagcttagtttggctggatatgaaattctgggttgaaaattcttttctttaagagtgctgaatattggcccccactctcttctgacttgtagtgtttctgctgagagacctgttgttagtctgatgggcttccctttgtgggtaacttgacctttctctctggctgcccttaacactttttccttcatttcaactttggtgaatctgacaattatgtgtcttggggttgctcttctctaggagtatctttgaggtgttctctgtatttcctgaatttgaatgttggcctacgtctctaggttgaggaagttctcctcaataataccctgaaaagtgttttccaacttggttccattctccccatcactttcaggtacaccaatcagatatagatttggtcttttcacatagtcccatatttcttggaggctttattcatttatttttactcttttttctctaaccttgtctcctcacttttttcattcatttgatcttcaatcactgataccctttcttccacttgatcaaatcggctattgaagcttgtgcgtgcatcacaaagttctcgtgccatggttttcagctccatcaggtcatttaaggtcttgtctacactgtttattccagttagccattcatctaatcttttctctaggtttttagcttctttgtgatgggttcaaacatcctcctttagctcggagaagtttgttattacctgaagttgttatcttctgaagcctactctgtcaacttgtcaaagccattctccatccagctttgttccattgctggaaaggagctgcaatcctttggaggagaagaggcactctgatttttagaattttcaccttttctgctctggtttctccccatctttgtggttttatctacctttggtctttgatgatggtgacctacagatggggttttggtgtggatttcctttttgttgatgttgatgctattcctttatgtttgttagttttccttctaacagtcaggtccctcagttgcaggtctgttggagttggctgtaggtccactccagaccctgtttgcctgggtatcatcagtggaggctgcagaacagcaaatgttgcagatcagcaaatattactgcctgatcgttcctctggaagctttgtcccagaggggcagccacctatatgaggtgtctgtcagcccctactaggaggtgtctcccagttaggttacacaggggtcagggacccacttgaggaggcagtctgtctggtctcagagctcatatgccgtgctgggagaaccactgctctcttcagagctgtcagacagggatctttaagtctgcagaagttgtctgctgccttttgttcagctatgccctgcccacacaggtagattctagaggcagtaggccttgttgagctgcagtgggctccacccagttcaagcttcccggtgctttgtttacctactcaagcctcagcaatggcggacacccctcccccagccagactgcctcgcagagcaatctcagactgctgtgctagcagttagctaggctcagtgggcatgggacccactgaaccaggcacaggagataatcatcttgtctgccggttgctaagaccttgagaaaagcacagtatttgggcagggaatgtcctgtttttccagctagtctgttacagcttcccttcactaggaaagggaaatccccagaccccttgcacttccaggtgaggtgacgccccgccctgcttcagctcatgctccgtgggctgcacccactgtccaaccagtcccaatgagaagaatcaggtacctcagttggaaatgcagaaatcacctgtcttctgcattgatcacactggatgctgcaaaccggagctcttcctattcagccatcttggaactgaaacctagttgaagtttttatctgctgatttcaatatgtaggttgtctgtgaatctatagtgactgattttgctctcaagtataggtcacattcacttgcttctgtcatatgtgtacggtttttgttttgttttagttttgctttgcactgtatgcttgactttgtaaatgataagatagaaagcctgcattctgtcatcttcatctgaagagtgttgcattgctcatattgatcttgtaaaggtttgttttttgttttgttttgtattatcttttaaaaaaaattcgtatatttttaagtggcataagaccagttttgctacatcgatatatttgtagtgataagtctggatgtttagtgtaactatcacccaaataaggtacagtatgccccttcaatcagttctcacccttcgccccctcccacaatcccactttcctgagtattattccgtattctatgtccacgtgtacacactatttagcttccactaataagtgaggacatgtggtatttcattttctgtttctgtatccaactgaataacccatttagaagtttgatggtacatcaaacccaacctattcaaaacctaacttactatttctccctcttaatatgctcctcacttttatttaatccctcacctgatgattatcaatcactcagttatccaagcaatcgatctaagactcatcctatttttttcttatgccttctcttccacatcaaatggtcatttactttttccttcttgtaatgccctggaataaatctcttccacttctttgtcttttccttagtttagtttctcattctctcctaaagtgttacagtagcctcctatttagagtccctgtccccagtatttttccactgcaagctatcttcctcagtcaccctatattggtctttaaagtggctttcaaagatttaaaaacaaaagccacagtaaaaaaaaaatgcattatataccataaatcagtctgcacacacacacacacacacacacaaacacacacacaaaactgagacaagggtttaataaaataagttttaccttgtttacatgaggaacatactgaaatttgcaattttacttcagatatgttctattttaatctagttttttacatgtctttcattctattctaatttatatctcttaaattctattagtgacccacaaaattcatttctcaatggaaaga

SEQ ID NO: 1154 - DNA, 20924 bp, Homo sapiens
tgaggcctctgtttatagaatccatttgaaagtgttctttcttcttcaatattttggaatcatttaagaagaactggtgtaagatcttttttaactttttttataatatgaaaaattataatatgaaaaaactataaatcgatcaggtcctgggctctttttattttttgatagggaacttattactgattcaatttcttcacttattggtctattcagattttctattttttaataatgcaatttttgtaggttttatgtgtctaagaatttatccatttcttctaggatattcagtttgttgtcatataattgcttataatagtctcttatgatcctttgtgtttctgtggtatcatttgtaatgtctcctttttcatattttatctatttgaatattgtctcttttttcttagtttgtctacctaaagatttgtgtgtttatctttaaaaaaaacccaactctttgtttcattgaccttttacattattttttttctctattacatttacttgtgtttttttttcttattacttccttccttctacgaatgttttttttctggttccttgaggtgtagtgttaggctgtttattttagctctttctccttttctgatggaggcatttattgctgtaaacttctctcctagaactgtttttgatgtgtcccataggttttggtataatgtgtttccatttttgtttgtttcaaaaatttttaaacttttagttaatttcttcactggccctttgtctattcaagagcatgttgtttgtttaattctcatgtctctgtaaattctgcaaattttcttctggaattgactatctagttttataacattgtggtcccaaaagatattcgatagaatttcagtcttcttaaatttgcctagattatttctggggcctaatgtatagtctgtcctgaaatatgtttcatttgctgttgagaagaaagtatattttgcagcttttggatgaaatgttattttaatgtctgttaagtcatttggtctagaatggactttagatcctttgttgcttttttatccagatgatctattaattgatgaaagtggggtattcaaactccttactattattgttttgcaatcatttctccccttagatttattaatatttgctttatatatttagatgctccaatgttgagtgcatatatttttataattattataacctcttggtgaattcaccccttaatcattatataaagatcttctttgtctctttctatagtttttgacatcaagcctgtgtttttctcatataagtatagctactcctactgtcttttgagttccattttcacaaaatattttgttttttttcctttaattttatccctttccttataggtgaagtgagtaacctatggtcagcattttgttgggtcttgttttaaaaactcactcagtcccggcgcggtggctcacgcttctaatcccagcactttgagaggctgaggcgggcggaccacgaggtcaggagatcgagaccatcctgcttaacacggtgaaaccccatctctactaagaaaaacacaaaaaaattagccgggcgtggtggcgggtgcctgtagtcccagctactggagaggctgaggcaggagaatggcgtgaacctgggaggtggagcttgcagtgagctgagatggcgccactgcactccagcctgggcaacagagcgagactctgtctcaaaaaaaaaaaaaaaaaaaaaaaagattattcctaatagatacggtcttactttttgttttcctttgtgtttgtgcgttttctctagtagcatatttttattccttgctttttattttagtgtgtctattttaagattttgccttgtggtcaccatgaagcttacagaaaatatcttgtagctagattatttatcctagtaacaacttaactttgatcactaaaaaaaccttctaaactttaactcctttcttactttccacattttgaattgttgacctcatttatgtttatcatattacatacctttcaacaaattattttagttgttatttttaatagctttttatttaaccttcatagtaaagatataagtaattttcacactgccatttcttttttagagtattctgaattcgactgttttcaaatgtttttttattactcagtgatttttttctttcagctcgaagaactccctttagcatatcttataagccaggtctggtggtgataaacttgttcagcctttttaacattttttattttttgctttggaaagtctttctcccttatttctgaaggatagatttgctggatacattattcttggttggcagatttttttctttctctagcactttgaatgtatcatcccactatctcctgccctgaataatttctgctgagaaattttctgcatgctgtattggagctcccttgaatgtgatatgttttttatctcttatttctttgagtatttttctttgtttttcatttttgataatctgattatgatgtgctttataaactcctcttttgttgttccattggcagcctctgagcttccagtacctatttgttgtctttccccagatgaaaaaatttccagccattatttcctaaatatgttttttagacattttcctctctcttttccttcagaaacttctattaggcaagtgttagtttgcttgatggtatcctataattcccataggccttttccatttttgtttattcttttctttttacttctctgaattgataatttcgtatgtcatattttccagctaactggtttttctgcttgatcaaattagttgttgaagcattgtatttaattgttcaattaaattattttattctttattttgaggatttctatttggttcttatttatggtttccactgctttgtcaaacttttaatttgttcatgaattgttttccatatttcatttaactttttatatgcatttgcttgtaatttcttgaacttaagaggatacttctgaggtcttttttggtcatttcatagatctcctagtttgtacttgtaagcataaaggaaaatgagtatttaatatagaacatgtagaattaagtatttatcatcttgagaaaaatattctattattatttgtaattgtaattggcataataaatataataaaaagtaccttatttaatttcccaaatatcttattatatttttaagatattaccttataaatatgtagacagactaaaattgaatagcagtgtagaatcttgaacatttgagaacttgaaaaatgacatggttgtttttggattaacctttttcattcactcattaatcttttgttgactgaataaagatatccaagtgtcgttattatagtaattttctttcctaaatttcatgatttggagagcttggtggtaagattttttgctcattacaagtattgatctgggacagatctggtgctgcttaaggaaagactaataacatgtcccaagttctcctggttatttttatttaaatactgctggggaaaaggtggtggaaaattattttattccatttgtgtatataaatcactatgcatttttttactttttatattttacatgttatcttagcaaaaagaatattaatagtttcaaccaagcaaaataaatatgaaggctggattattaaaagtgacttttgcatttttaaccacattttatctttgaatttagtatcatatacaggagatatgaaaataaaagacatttatttttataacagtattaaaaatctattgaagtattgattgaagaaattcagttgaagtatttttgtaaacattgtgattatgtgggttattaagatacatacaaatgtggttttaaaattcaacaagagtaaggccaatatattttagcatgtgtaatttgtaaaaatacatgtttgtatttgtagtaaaacttatacacaagatcaaatatgtaaatattaaaggagaaggagttgtatatgtatgtaaattgtttcttatttgaatgacatttagatactgtcatctaggtttagctatattttacagtacaaatttaattaaaatatatgctatggaagtattttaatgattttaggttgaagttataaaaacattcccatatttatttctttccaataaggaaaatttgtcagagcatataacacaccatttattcttcacttcattattttatctaccttttcctatgtgtcttttaattcttaatatttactaaaatttctatatcaaggaataatacacagagcttttaccttcaagttatttagtattggaatagtgcacaaaattataaacattgagataatgcaggcagaataaagtacccaagtaggtttgagaaatgcaccatcagctttcactgaattatgaaatcccaaatactgctgaagggtcaacaatgaaagacagttgtactgagaaggtaaagttttgaacgtctcttcatttatatagagggtttccccttgatagggaactgaggataaatatttgaagaaatatgatggaggtttccagcaatactcataataattgaaacatctaattaaaatagggctaacatcattcatcagcctcacaatatcagctgttttccaagaacttcttatcactgggcctcttgtttttttatactaatgtatgtttgtttgtttcattcccctcccccaacctccacagaaaaacccttgtgaagagagaggatgggtgttcacaatttgttcacggtgactcagtttatccttatagggctctcttacttctccaatgagcactaccttctttttgtggcccttgccattatctgtcaggtgttcttggtgcgaagtggagacattctcttggccattgggactgtgattaagttgcacactactcatgtattattttttggcaaatgtgtccatcttagacatattgtgttcatcagctactatacctaagatgcctaagattctctagactgaggatcacagcatttcttttgttaggtgagctttgcagccctatttcctagtggcctgggctgggaagaaagctttctcactgttacggcttatgactggtgtgtggtcacatgtttctccctttgttacatcctgatcatgaacaaattggctctgtccagctggtttatgggacctgagcagctgggtttctaaatttcctcctcctccacgtagtgtctaccctctgcctgtctttctgcaagcctgatcgagttaaccagtattactgtgatatctcaccgatgggggccctgttgtgccagtccatgcacctggcaaacatgcttgttttagtggaatcagttatcttggggatcagtgcttttctggctgcctttaacttttacatatacatcatctccactatcctaaagatccagtgtgtagagtggagtgcaaagtgcttctctacatgcacttcccacctccttacggtctgtttgttctatggcatattgacatttacctacatttactccttctccagtcaacactcacatgtctaaggcaagcccagatctagccacagacaggctcatctctatgctatacagagttattaccctgatgtttaacttcatcactgacaacctgagaaacacagaggtaaaaggagcctcagaaaggttttatgtcattgaacatgtttatagaaaccataatttaaaatataatagaatgactcaatgttccacttttaattcatagaaaaagtaattttctattgatatatagaatgtatacctacataggcgtataaatttatagaaaatacatatacatataacttcagttatatctatttatatgtatatgtatatttctatttgtgtacattgggaacttaacatttatcagccaaagtagactttttttttttttttaagttctggggtacatgtacaggatgtgcaggtttgttatgtaggtaaacatgtgccatggtggtttgctgcacctatcaacccatcacctaggtattaagaccagcatgccttagctttttttcctgatactctccctctctacgccaccctccacccaacaggtcctagtgtgtgttattccctgtagactttttcagaataaatcaggaactgttagtagtaattacactggtataagatgtttaaaataggcctgtcttaggctgggcgcggtgcctcacacctgtaatctcagcactttgggaggcagaggcaggtggattacctgaggacaggagtttgagaccagcctggctaacatagcgaaaccctgcctctactaaaaatacaagaaattagccagatgtggtggttggtgcatgtagtcccagctacttgggaggctgaggcaggagaatcacttgaaccccagaggctgggttgcagtgagctgagatcgtgccactgcactcaagcctgggtgacagagtgagactctgtctcaataaataaataaaatggtcctatcttaagtaaacttggatctataacacttaactatattcatactcatgcttgtacccatagccatatttatgtctaccaatatctatattgtgtgtgtctatatggtttatatctggctttcaacctgtatttaatctagctgtaggtgttttctttaatttttttcttttaattgttcatttacacttggaaattgctaagagagtgaatcttaaatgtaatcacaataaaagataattatgtgaggtgatggatatgtaaattcattttgtttgataacttcacagtttatacctatataaaagcatcacattgcatactataaatatatgtatatgtgtgtgtgtgtgtgtgtgtgtgggtgtaaactataccttaaggctgggggaataagctaaagtggtcaacataacctattatatgataaagatatatctatgttggaaatttttctgatattgttatcaaatatgtaagatttaaatgacagtattttcattatattatttgtaacctgtgtaaatggaataaaatacccatttatggctatctggtgaaactgttgagaagtaaagcctgtgcattgatcacccttctatgtttgttgttattgatacttctcctttttgttgacataacatgctatgacttcttctgtagttttactttcaacctacttgttttgttactttatgtgagtttctcatagacagtttatagttcaattatgtatttttatccagtgtccaatctctgtctttcaatttgcatatattattgcatcatttacttttaaggtaatcattaatatgctacaatttgtcgactttttaatttgttttgtgtttgtttcttctgtcttttatttctctgcttttcatttattgattttctgatgttttctttaagatttttaaggattctaacttatgtatagcatttttattacatcacaatgtatagtttttttataccaactaatgttgttataatttttctttcaaccataaaatataatttaaggaactcatgagagaaatatagtatattgtaattatttctctttgtacaaaatttgttttttcctgtatgacattgtggctttcctatctctgtagaaaaccatatatactgtactcttaaaaatactaagagagtgggtatacagtgtttccaccatgaaaatgataattatgtgaggtaatgcatatcatatgttaattaactaaatgtagtcactccacaatgcatctatacttcaaaatgttaggctgtaaacaataatacataaattttatgtcaattatttttgaattacaaaaaaatgaatgcaagttgatctcaaaaagatgtcataaagaataaataaaatgagaacacaatatcaacaaattatatgaacctaacaaaatagtctaaaaaataaaccaatagtattctattttcagaaatatcaaatatgtaaataccttaataaacttgaaaatgcatgcattaaactaatactgtatactatactctcccaaaaaaagagtggagattatttaccagcacatataaaacaacttaaaaatggataatttatttcaccctaaaaatgagtctcaataaattccaaaggttcaaagaattacaaatattgtggaatgtgtaatacatgtatgcacatgtggatatatgtatatctgtacatataggtatatatatgtgtgagtgcacatttgtatgtaagaccattatgaagctatctctagattatattgttaagtaaaaaaaaagtataatgcagaaagggatttttaatatttgcttatattacagttatgttacatataacatataatgaaacattgcatatatacatatatataacagtttatgatatatataacatatatgtataacagtttatatccaaggttatataacatatatctaaggttatatatataacagtttatgatatatataacaacatgacattacatatacatatacagtaaagttatatataatatgttatatataacataagtgttatatatgttatataacatgttactaatatatgtcacatatataaaacaaaatgttataattataaaacaaaatgttatacgtgtaaaacatgaaatgttttatcattttctttatcaatttatctgatgatggacacaactgctccagatgtatttgtaagacaaaattccaacatgttttcataattgtggaaatatattgtaaaaatatgctttactaatcacagcaaatgatatatttcttccaacttgttataagatgtgttgtatattgtatatttttattatgtagcctcagttttggcattctcactctctcaacctaactttatttcatgatttagtttgtgacttcaaatctgcatttatgatacatttgctagtagatactcatagcaactgccatagtatagacacccatttctcatcccatctatgttacatccaaattttttcaggggtgccaagtgcctaattttagaatatactcttccaattggtacttacaacttgaaatggtgtaataatatagctatagccaatgagatgtagcttatacttactgggttatccttataaaaataataggcagtgcttcatttgcctcatgaaatctctgtccttagccttcattctacttgggttatggatgagacgcctagtaatacaaaagccattcatgatcctagggaaaacaatattgaagggcagaacaagatgactgaaggtgcctgtttcattgatggacccattgaaccgccatacacactattgactgcctgcctaatgtcagactaatgttgcatgaggcataagtgtactcactggtttaaaaggactggagtaatattctgtcactttttcctgaacacatggagactttagagtttgcccaataattttattcagtagagcacgatttttctccaatgaaatctaaataacgtaatgaggttcaaccccagagtagatacctcattatcacaatgctgtaagtgaatgaacccagcctattaagcaagggaaaatttatcacacacactacttctctccagctcacattcacataccaacaaataaatggcacaaaatacacaaaatgttttgtgatatttgcatgtatgatgtgcacatgcacatataggtaaatatttgtgtatatgcatatataagtattcgaagttatgtacatatttttggaaaatgttggaatatatattatgacatatatttatgtgagggtattgtgcatattgctttatgaatattcttcacataaagagtacagaattttggagacaatgagactgctaggaagaaggcaggaataagagggaagggaaaattggagtggaggtaagtatgaaaaaccagtaaaatctgagatgctctagaagatggttctggagtacagaagtgatgttgcatgttgaaactactagtgtttcagaaatgcaaacaccttcctaattcctgcctgcatctccctattctggaagctgtacaccatcgggtttaatgtgggagtcacaagagtatagagtgcagctaccaccttgtctctttcaaatgtatagctggaagcagggcggatataggtgtagattacaggagaatagtaaagggtcaccactgtgagatgagatgagcatgttgagaaggccttcctcttgccttctactgtgcggatacggagaatagcaacaatgataaaaccataggagatgcaggtaagaataaagtcccctatggccagggtaatatcagcaacatacaccatcacctcattgattcttacagggctacaggacaaagccagcaatgggggtatctcacagaagaagtggtcaatggtgtttggcccacagaaagtcaacctcatgataagagctgtgtgcacccaggaattggtgactgcaatagccatgaccatgctgagcaaggctacacacatatggtggttcataatagtactgtaatgaagagggaaacaaatggccacatagcggtcataggccatggtggtgaagagaaccatctcagctcccagagaccatgtgaacaagaagagctgggacatgcagcctgcatatgaaatggtattttctgatgttagcatggtccccagcatcttcggtatgatgcttgttgtgcagatgatgtccacaacagccagtgtcagaaggaaaacatacatgggcgtatgcaaggtgttgttatagattttggcaatgatgatgagcatgttgccgagaaaagccacaagatagacaatgagaaaaaagaggaagataattccctggagttcaggctttttggtgaggcccagaataatgaactcagttacaacgctgtgattcatcctgcttgggtgattgaatggcagtaattgcacagaataaacaactgaaaatggaaagaatccctgtgttgttaggagataacatgaggagtgtgtgtacttagggacttaattcttgattggacacaactttgcagcaggaattcccatttgatggagttctgtattccaggcaatatactctgttttccagactaatcccattctctgatgtatgttcctccattgatgactcaaactgaagccagtggttgagaagaaaaatattttcaaaatgccttcaaatattttgatatcattttcacttaaaacttgtctaaatacacacacacatatatatatatatacacacacatatgtatatattctggatatgcatatatatccaatggagctgtaatacaaattattacatacctcaataatttagttaattgcatggtacatttaggtgtccttgagatatacacgagcaaagatacttgaaataatacaagctgacagggctaattatagtgaggatatttcagatgaaaaatgcccaacctagtattttgaggctgtatattcatgggaacattgactaatgtatcacagtccaaatactaaacaatttaatcaaatgtctgtattagtagtttttcatcggtttgagaagcacattgccaaaattcactggaccagctatttgttttgctgttatataatggcaagataattggatttaaaaatataaaatgtagggttgtgtcttcatttcatcatagctatagactggccatttaagctctgtaagatttggatttattatttctaaacattgaataaattgaaataaatatcagatgttagagagacagagccatgatttctaaaggatacccaagcataaatggcaactggagttttctggaaaataatttctaggacacaagaaaaatctgtgtcctatgttattttcccccaaaacttccatagcattctgttttctgttttcttttactttcttttctaaaaaagatgggggtctcattcttacccaggctggtctcaaactcctgacctcaagagatcctcctgccttgacctcccaaactgcagggattacaggcatgagccactgcacttggttgctgtccgttttcttttatgcttatttattttggtacatttgtatgcacagacagttacacgaattcatggcttttggaactattatgattagatgaatctagtgaaagtattcaaaatagttgtgaatttagtcataaatttatgtttatcaatgttctttaagttttcagagatcatattgtacctctggtatctaaacagagacataaataaaaagtgtttttgagtgtgcgtccacaaatctagtctgttttgctctctcatgccttgtagcctcaataatttgttaaccaaattttagctactgataaattcatctttaactctttaaactggaagaaaaaaatagagcttttgtctaatccataatccatttcagaatctctagctttagtattaatttactcatactgaaggaatgttacagccaccattatttgggtctttgacatgtgacaggctctatgttaggtcctctgcagagatgatacaattttgtcctcacaagcacattgagtctttaatatttttatctttatgtagttgataagcaaacaatgcatgggagtaaaaataatagtaggtagattgtgtgtctcataagtgccaggattaacacctagatcatctgactccaaaaaatttgctattcacctttctactatatactttcaagcaaaacacaaaataatatggcaagtgtacacaaaaactaagaaatataagacagatctgaaagaatatggatttttattttgaatacgagatgatttggaagaggaaaatatagacaagatagttgattcttaaaatttaattcaaatattagaatctttgaaagatctgaactgaagtgatattaactaatttaaaaaatactatgtgttgaatatgttttcaaatagtaagcggttctggtctggtcatttcatcttaatcataaatctgacgtcaaagcttcttgagataaatttataagataacagacccctttcagctttttggtgatcttaatcaccaaaaacaggcactcaaatataaactgagctttcattgttgaagaaaaaagctttgtttttttttttcttggagaactgtcacttattaatgtaagtactgttatttatcaatgttatttatccacgtaactgttactgatcaattttcctaaagcagggtatgaagaaggagatcccagtcccaagtacacaagggcaagtttcaaaaaattcttaaagttcacaggagatggaaaagtgcacccctgttccaccatctctaagttaagagcaaaggcaagggaacctgaggattctgtttctcttttcttcttgtaatgtcctcacccccttctctggagttatgacattggtttgcttgactttgttctcactgcgggttccttggtttgggtggttattgtgtgtgaaggaggctgaacctggaatgacactgtgacacagttcactgtgaggagagggtatctactgactatgaaaaccttgttcaggatgtccatcattggcttaaggtggagatatgtactattttctatccataggtgtccaaacagtggtcagtagtttctcttgaaattctgcaattgatgttagtctgacttgcatgctactgtaggctccaaaaaagccacagtatccagaagaagagggcctgcctgcatcagcaggaaagtgtctttctccagaaatagaaagtctatttctatttgctgcaaatcaaaagccatttactcctggccgtgtccatccctggtcatctcctctgaaattatcaattcagctctagtaattatgtttaatctagcttagattttctattgatcaaaatctggaggcaagaaaaatcagtgaaatttagtttgaatcattataatacatatggcctaatcttgaccctgtctgtgaccttccatttttaagacattcttcaagcctcagtccatccccattggttaaatggagataacagtagtaaactcaccgagattctttgaggattaaataatgaatatgaatctttagccctattctggggacttattgagctaccaatcaaaggtaaaaataattattatttagagttccaaatatataattttgaaaaatcatgttttagtatgtgagtattcagtcgttaataatgagggagttttttactatttaatggaagaaatttccagaaatgtatttgaaaagattgaataaatattataataatttaagaataaccagattgggttagggcaataaaagataattcaattaattctataataattataataaaggtgactttattcattaaatatttaaaggccacagtttatgctaatcattatgctattagattatgacgatgtagaaaatgtaatatacattctcagttatttcagcatcagtgataaaacaatgaacaataaactaatattctttgggaccatgagaaaatcattggagttataaaacaattttatatagtaacatagcacacttaatttggtcttggataaaataatgaaaatactaaccaaaaacatgagtgtgatatctgaaaccctagcacccgtgatttttattgcttagtcaatattcctttatatttaccatttatactgttcttctttctcctgcatatcttcccttatatgggacaatttttattctcatgaataactctgcttttagtccacaggaatgtggtattgtctccaaaagtaagcaggttttgaggagtgcgattggaaagggaagaggaaagagaagataaattccaataaaactggcctggtgtgtggttcacacctgtagtcccagcactttggcaggctggggtgggcagatggcttgagcccaggagtttgaaaccagccttggtaacatagtgagacctcgtttctacaaaaaatacaaaaattagccggcctgtaatcccagctacttgggacgctgaggcaggagaatcgctggagcctgggaggcggaggttgcagtgagccgagattgtgccactgcactgcagcctgggtgacagagccagaccctgtcataatgaaataaaaataaaaataagaaaagataggactacttgagattattatattctaaggtaaggaattattttgttgttaagtagtcgataagggagaaattttagatttctgagagaggaagtagtatgtgacataccccagttttagaaagccagccctgaaggcatcatagaggatgaattcagagggagacagtatttgtccatcttaaatggagactgtgtttacaggcaccacctggtttgtagaacattatcaatttaagtttaacaataggatttatttataataatgaattgccagaataaaatgaaagtgatatagaattgccagaataaaatgaaagtgatataaaactacatacagaaaaaacttagaccattttgtctggcaggatgcagtgcactgccaaataaacactggcaaccttttcctggaaggagtgaattgaggtcacattctgtttacttactttagaacaccaaacatttactaataatacacaatgatgcttgatttatgtgccattcaccatgctattttgctgaatcatgaggataagtttaagaattaatagggccgggtgcggtggctcacgcctgtaatcccagcactttgggaggccaagacgggcgcatcacctgaggttgggagtttgagaccagcctgactaacatggagaaaccccatctctaataaaaatacaaaattagctgggcatggtggcacatgcctgtaatccagctactcaagaggctgaggcaggagaattgcttgaacctgggaggcggaggtttcagtgagccgagatcgcgccattgcactccgacctgggcaacaagagcgaaactctgtctcaaaaaaaattaataatatttatgtcactattttacatatgaagtagttggtgaaatttggtagttatcaaatgtgcttattgtcacacagtcagacactggcgacatggaaatctgaatccagggagtctaatgacaaaattcactcatgttgcattttataagccaatgttatacctatgtcaactccaacagcacagtttattcttatgtatccattacatcattatcatcatctccgtcttcaagtattttcatcttcattgtcataataaacaatatcggcacacgtttaaagggcctatgttgtctaaggcaaggtactaagaactccccacagcagccactgtgttttatggggacagagtgatacaaatttcctcgtactctcatattcctgaatgacttctgtcagacagtttcattctaggccactttctattaggtagggctacgtcagaggtgattctagttcaagcatcgtttaaggagaatgttacattctcttcagcttagcttcactgttgaagtactagaaaagaagtgaaagtagctacttcttaattttctaggtttcgaagtgatcagagaggtaggaaaggaagatcagtgtgaaggcagtataataaattgtaaaaagagaaaaggtggcggagattaaggagagtcaatacctgcatacaaatcatggccctaccctacaaaggataatcaaccacttggttagccagggattgtccaagttttgccactgaaagacccacatcctaggagacctgtcagtctcaggcaacctgggaaagttggtcaccctaggacatctgaagccaatgcaattcctgtctgaaagcattttattctctatgtttgggaagacattatttttcacatttacattgttttctaagttttggaagaaatctttttttttttaaattcaactctgaacatgccactcaccattttatagagtctgtcacagattcttatatatgtaggtagaatatgaacactaaatgagtaaatgaaacccttgtaaggttctatttttgagaggcgttttaagcagcttggagcatcctgatacaatgagaagttttgcaagctaattcttaaactatttagctaagtctttatgataattaaagaaaggacatattctaaaacaatttctcatacatgtcaagcattcccataacttggtaaagtatgttaacctaaatttagttgactgtcttttaaactccaacttttgcatatttgatatgaaaggaaaaattttgaaaggctggcaggcaatataaatacttgcatcatcagtattttgatacattgatagcataaaatcccctgttttgaattaaagtacaatccgcggatggattgtgtgtgtgtgtgtgtgtgtgtgtgtgtgtgtgtgtgtgcgcgctatggctaaaaaggaattaaatatgttacctggctcaaaaatatccctactcaggccatgattttatggtaaacttaagaattagacagtctgcccacaaatactcactgtagttttttgcagagtattgtcatgttcaaatggtgacctgtattaaatcactgtaaaaaactaaaagtacagtagctcttgccagtttgctatcaaatgagctctttcatgcttgctttagtattggtttatttatacttaagatcaatgaaaagcatggttcctgactcaaggacaagggaccccaaggaagagcatcttgaagtgatttgctattagttacattaaaatgtatcccagaggaacagtttttaaaaccctgaactaattaccaattatgatgttcaatcacttggtctttgtgtgtcaacctttttctgtgaagaccaaaaggtatcccgagataatgtcttcatggagtaggaaacctgaataatgagacacagtggaaatgctggtgggagatttaaagaataaatggatggacattgttataaaagcaattacatctgcttcggagatcttctcccaatataaacttagacagtgttaaaagaaaaatcttagacaagttaaatttaacagagttcatttgagcagagaaaataaaaaatatttatgaaccagataacattcaggaccaaaagcagtgcagagagcttcatcctacaaggcgttgcaggcaatatttatagctggagaaatggaaatgacatgcggaaataacttgattgactagagttctgtgtttgctttatttggatgttttggcaggtttcggcctacagttggctgaaggttaggctgctatgattcgctgagattttgctacttgttataatgtatgctctgaagttaggttgcaggttgtttacacattaagttaggttacagtttaccatgtacacaggcagatttaggacaaacagttcaatttaataagaggaagagtggtaggaaatgaattccaagatgaaggttaaagcaaagtttgtcatttagtcctctactctgtgcaggcctggaggatcttacaaataaaatatgaaatgcaatttggttttcatttgtttaatgtaacacgcaaacccttcagctaaatttctttctgaattgtttgaaaaactgttctgtacatccttttgctgtttatgcatacccaaacacaaatgcaactcatctgtgtgatgtacgcataatgaaataacattgtctctatccctcttgctgaatagcctcatagtttgaaatgttcattagaattcaaacacacatttacatgtttaccatgtatttctttctcctatttgtttatcttaaagaaaagttacatgggtaaatatcagatcactttaacagctttttaaagcttccagacagtgatctaaatgcttatttcacatttattgtaagcatagtattactaaatattagttaagtatatcaaactatcaatatgagagcaagtaaggggcaggaattatatgtagttgtcatcacacggccaaatagaaattaatcatttgcctttaaagagtgtttgctgttgagccagttgacataatttatcttgctttagtaatattctttacaggtaaaataacctactcatttccacaatgataaaacattgttgttttatcgctttgaacaagtacattaaaataatacagaacagttgaagatgtgatgactgcacaatgaaccagaataacattgaattaaatgtattcgtaaatgggtggagaggaggtatttggtggaaaaaaaaaaagctgaaatacttgagccaattaagtcccttgactccaaacccatccctacgcactcagatcttggatgctggattgggtgaaccctacaaccacatcgctgttagcgtgttggcacctcatgaactctgccagtagggggcaatagaggtaaactgtaagactagaggagaaaaaacaggtcccttccctgtttgcttctcctggtctttttggtgaagttctagaacttctagtattttgacttttgattttaaataccccaggatgattggaatttgccttattcttattttcagtctgtcaaattaagtcatgtatcattagaagcaatactgttgtatgcgccagagaactggttttatgatctatttgtagtagaagggctgccttgtcattatcaaaggttactcttcagaaaagttgcttgccttattagctatgtattctaatagcataacgactataccaactttgttttgtttaatttttcatggtatatatttttccatcttcattttgggtgttttcttcgtgttcatttgagaatgtgttaagtgtaatacagttttgttttttaacaaaatcagtcagtctttatgctttaatttcagcactttagttgcctttaatttaatttcagacacatttgtgtttgctttatgaatatattattgttatttggctcatctatgttctttctccctgttttatcttactttatcttattttattccacatttccatctatgaggtgagtagtcatgcatttctacaccgatttgagtgtttatgcatttttgacttattatggtcaagtagaaattacttattttaccactttctagagacactgtgcttttagaacactaactactttagtcccttctttgtattgtttttataatggattataattaaacgcatatctcaaaccccaccacccataacttttattgtttaatcagtctgtattcctttgcatgtgctcttatattgcttttttcattgttcttccactctcctgcccatttttcccatttgggccattttcttctgcctgcataactcttcttttaatgcaaacctacaggtttgctgacaagaaattctctcattcttttatgtattaaaattttttgttggtattagttttggaaattatgttttctgggtatatgattttacgttgactattgttttatttagcacattaaagatatacctaaattgtcttatagcattcacagtttatgttgaaaagtcaactgtcagtagtattgttgcttatttgaacaaaatgtcttcttttcctcttattgcggcatttaagcttatctttagttttagcaattttagtgtgatgtctctaggatatgattgaacttttatcttgcttgaagcttgccaataatatttatctgtgggtatcattatttatgctgcttctgcccccctttttaaatctgtgttcctcccagggtgaaaataacatgcatgctagaacttttcactatggtttttatcttacgtgttgtaccttccaattatgtttcttctctttaaatattttttattaactcatattcaagcaagtaatcagatcgtctactggatctaacattccgtcaatcccaaactattagctgttaacttcaggtagagtatttcatgcttttataattct

SEQ ID NO: 1155 - DNA, 25870 bp, Homo sapiens
gttgccacatttggatgccccataagggtcacttgagaaaatcatgaaatctgggaaaggaagggcaagtcatagaatcctgccactatagaataatgtctgacaaccaagtgatacattctgtttaagtaggcaccaaactgtcggcaaaagccccattttcgagttggccagttctggcaattttctgtgtccattctgcatgccactcaactcctctaatgaattcttattccttttcaagccttctgtattccttcttatcatactggacactttgacctctggtgtcctagaactcctgcttcccatgacttccatctccaattccaataaacaccttctttttaaaaatttcctgatattacccagtagctctcatccctatttccctttgaagtactcatgttttttatgatcccttctcccaacacttttcttgccttcaatgtatttttaatgactggtgacctcttacctctccttcttttactttaacctctaacttctcctaatcaatatgccttaaaactctttcagtgaaggcaaaatgatgaagaaagtagaaatatcagtggtttccagaggttacagcaggagtatggggtcagagaaggaatgatgaatagaaagcacagagaaccttggggcagtcacactattctgtatgtactaggattcacttgtccaaacacatagaatatatagtaccaagagtgagtcctgaagtaaacaatggacgttgggtgataatgatatgtcagtgtaagtttatcagttataacaaattaccactctaatatgggatgttgttagtaggagagtccacctagggaggaagggcaggaggtatacagaaaacctctctactctctgttcagttttactatttaaagaaaaggaaagaagaagaaaacttcaaatacctccctataatcctatactaaatgatactctagctatcttgccccctcttaattaccagaagtttctaatctctacatatgttaagtactcaaaaaatatttcaaaaaatcaaatatcaaaaataaattactcaagctacgtctcacaaaaaagtatctttctttcccagttatgatttttcttccttcttctgatatcctcacaactgaacatttccttcgaatacacccacccacccataaatgaccaatctttctcttttttttgttgttttggagatggagtctcgctctgactcccaggctggagttcagtggcatgatctcggctcaatgcaacctccacctcccaggtttaagcaattctcctgcctcagcctccagagtagctgggactacaggcatgcaccaccacgtccagccaatttttgtatctttagtagagatggggtttttccatgttggccaggctggtcttgaactcctgacctcaggtgatctgcctgcctcagcctcccaaagtgctagtattacaagcctgagtcaccgtgcccggcccaaatgaccatctttcttaccactcatccacaaagctcacaaaacgagaagctgctcaaaacactgagatgcccctctaggctggtaacagcgtgacttagaataagtcctccaacttttctagctttctcaccgaaaaatgggcctgtggcagcacagttttatgagtaactaagatatgggatgtagaaagaccctagaagaggaaaaaaaacacaacaatggtcattgttaaaacaggggactacatttgtccttggttccaccactgtcccacagccccagctggtagtttggcttctcccatgcagcctccctcttaggcccaaccatagtatcaaaactctcaacagctatcccagacctgctgggtcatccctcacaacagaaactcagtgtttgggtagagtggagaggcttgtagtgatcttaactttcctgagaatgctcagcctaattatgtcccgggtatagaatccaacctcatccttgaaaaactgaaagctgtccacagctataatcctaaaatattttattggaatcttaaaagcagacatatgttcattacaacatccactgctctgttaagtactccatctggcatggcacagaatatggcaacaatgtccaagctgagagacaaatcaacagtgcaattacattcacaatagccacacacacacacacaatacctaggaaagcagctagacagagagatgaaagacctctacaacaagcaagcattacaaaacactgctgaaggaaatcagagacaacacacacaaaaaatggaaaaaacattccatgttcatgaataggaagaatccgtattatccaaatggttatatgacccaaagtaacttacagattcaatgctattcctattaaactacccatgacatttttcacagaactagaaacaactattctaaaattcatatgtaaccaaaaaagagcacaaatagccaaagcaatcctaagcaaaaagaacaaagctgaggacatcacattatccaacttcaagctatactacaaggttacagtaaccaaaatagcatggtactgttacaaacacagatacatagaccaatggaacagaccagagaacccagaaataatgccgcacacctacaaccatcttatcttcaacaaagtcaacaaaaataagcactcactattcaataaatggtgctgggctaactggctagccgtattaggaagattgaaactggaccctttcctttcaccatatgcaaaagtcaactcgaagtaaattaaagatttaaaagtaaaacctaaaactataaaaaccttgggagaaaatccagcaaataccattctgtacatacaaatgggtgaagatttcatgataaagttgtcaaaagtaatggaaacaaaaacagaaatagacaagtggaacttaattaaactaaagagcttctgcacagccaaagaaaccatcaagacagtaaataaacagcctacagtatgggagaaaatgtttgcaaactatgcatctgacaaaagtctaatatccagagcttataaggaacttaaagagaaaaaaaattttttttaaatgggcaaaggacatgaacagacacgtctcaaaagaagacatacatgtagccaagaagcacatgaaaaaaatgcccaatatcactattcattagagaaatgcaagtgaaaaccacagtgagataccatctcatatcagtcagaatgactcaaaaaataacagatgctggaagcatcgtggagaaaaaaggaatgcttacacactgctgctgagaatgtatgttagctcatacatgctgctgagaatgtatgttgaaagtggtttggagatttctcaaagaacttaaaactgaactgccatttgacccagcaatctcattactggaaatatacacgaaggaatataaattattctaccataaagagtcatgtatgtgtatgtgttcacaatagcaaagacatggaatcaacctaaatacctatcaacagtggactggagaagaaaaatgcatggtacttatataccatggaatactatacacccatgaaaaatgaaatcatggcctttgcagcaacatggatcctgatggagaccattatcctaaacaaattaaagcaggattggaaaaccaaatgctgcatgttctcacttgtaagtgggagcaaaacattgaatacacatgaccacaaagaaagtaacaatagacaccagggcctacttgagttggaagaatggcaggatggtgagggtcaaaaaactacctattggttactgtgctcactacctaggtgacaaaatcatttgtacaccaaaccccaatgacacgcaatttacccgtgtaacaaacctgcacctgtgccccttgaaactaaaataaaaattaggggaaaaaaaggagaagagagataaaagggcaaacaaaaaaattgttcaaaaaatgttggcaaaattttttcaaattcgataaaaatagcaatccacattatcaataccacatctacatacatcataaactgagaaaaacaaagatttaaaaagaaaaatctgaaaacccgctgaagtggtagagacatattgcataataaggaataacaataaaaatgactgccaacatctcaacagaaacaaagggagtcagaaggctatgaattatctttcaaatgtgaagagaaaaaaaatctgccaacttagaattacccagtgggggaaaataatctttcttaaatgaaggcaaaataaagccatctgaaattaaaaagaagctgagaaaatttgttgccagaagatactcactaaaagaataaaaaaggataaaggaagtttttcaggctatagagaaattataatatttggagtttcaaatctatgagaaggaacgaaaaactttcaagattggaaacataaaagtgtatataaaagttatcttcttccttttcttaaattcattaaaagtctaaaaataatgataatatattacaagggttgtaacatatgtaaagtaaaacacggcaatagctgcacaaagaatgggaggaattataactaattttattattatcagatttttatattctatgttaaaggtattgtattaagtcagagtagactcttataagttcaggatccatatggtatccccaagaaaaaaacttgcactttaaatataaagacagcttaatcataaatacacttatagattaaaaataaaattataatataaattatgaaataaataataaatataaattaatatatatacattaaaaataaaattcaccagatatggtgaattaaagaggacagcaaatccttccttcctccacctcacaaataaattataaaaccagaaaaattgtcaaaaacaatcatttcaggtgtctggaaataaaccaaggcaaataataaattgagaaccactttttcataaagcagtgctagaagcttaggtaagaatcataggtaactgtgcctgtcctgtgaaaagtgctccagtactactccaacttagttgatggtagttttgccagtcaggaatggccatgaaaatcaacaattacactattaaagagggttgagatgatttggaacaaagataaaaactcatgcctagggtttatgtcagtaaaagtaacaaactcaatcgtgtttaaggctcaggtatccagaggttacagttttaatgaggcgaacagtgaacctatcagaaatgtaatgggaagatgctgggaattagatagctatagaagaattagataagatctctacacattcctggctgactgggaaactacaggtatgtacagaagaaacatgagagaaaccagcatgaagtaaaatccaagacaaacttaaaagctctctgaatttgaatatggtcccagcacaaaggcagatgcattagcagagaatggaagccttttgaaatcaaaagtatttgaccaaaaccttcacccaatcattgactgaacactaagctgtgcaagaacaagggaaacttctgggatccaagattttaaaatatgaatttttaagagctaggttgagaccatggaagccataaatggtggaagatacacagtccacagattatgtccaataatgttaacaaaataattcttagaaaaaaataagaatataaacttgtcaatatagtatctaaaatgagacatgcaaagaaacaggaaagtataatcaagtcttagagaaaagactgcagttaatggaaactgactgtaagtgggactgctgttgaatttagcaaacagagattcaaaacatctaatataaatagttaaattaaaaccatttttaaagaattcatggacaatatagtctttcattgggtagggaagatccactatcaatatagatgggtatcatccaatcagctggggcccagatggaaaaaaaaggcatgaaaggatgctctttatcattggttattaagaacatgaaattaaacacaatacttacaagtctactagaatgactataataagaaactgatggtataagatgttgacaaagatgtgaaatactgattaagtgttggcaagaatatgtcaaaattgacagagccactttggaaaacaatttggcaggttttttataaaaaaaatttactatacaacccaataattccactgtcaggtaatatccaagacaatttaaatcatatgccttcaatgactcttcataagaacattattagtaacacccaaaaagtagaaacaatccaaatgtcatcaactggtgagatcagtggaactgaatagaaagtgcagaaatagagccaaacacataagatctattgattttacacaaagacaccaagataattcaatacaggaaacgatattctttgcaacaaatggtactggaggaaccagatataggtataaaaactgtaccattatgatttgtttaaaaaagcagccattttttttatcgcttctcggccttttggctaagatcaagtgtaaaaaagcagccattttcataatattttattatatgtatgaaaatgaattatgactcctatatcacaacatacaaaaaaattaacatgggtcatataaataaacatataagctagaaattaaaagcttctaaagaagaacataaaagaaaatatttatgaccttagaataggtaaagatttcttaggattcaaaaagcacttaactgcaaaaagataattgatgaattttgagttaatcaaacttaaaagcttcttctcctttgaagacgccattcaaattgaaacatcaaaccacagactgaaaaaatagcacagtgcatttatttgacaaaggacttttatgcagaatatatgaagaactcatatacttttatcataaaaggaaacactataaaatatggacaaatgacttgaacagacacctcacaaaagaatatataaatgaccaatgaaaagatgctcaatgacttagttgttggataattgtaaatttagaaactactgtgagattaataagtctagagatctaatgtatagcctgaggactacagttgacaacattgtattatatactggaaatttctaagagaatagattttaagtactcttaccacaagaaaagtaactgtgagttgatagatatgttaattggcttgaccatagtaatcatttaactatgtatatcaaaacatcatttgggaggccgaggcgggtggattgcctgagctcaggagttcgagaccagcctgggcaacatggtgaaaccccctctctactaaaacacaaaaaagtggccgggtgtggcagcatgcgcctgtaatcccagctacttgggaggctggggcaggagtatcgcttgaacccaggaggcggaggttttagtgagccgagatcgtgccattgcactccagcctaggagacagaatgagacttgtctcaaaaaaaaaaaaaaaaaaaaggaaatcctgtatatcctaagcatatacatatacaacaaaaaattttcaaaattagcctggcttggtggcttacacatgtaactcagcactttgggaggcctaagcaggtggatcacctgaaatcaggagttcgagatcagcctggtcaatgtggtgaaacaccgtctctactaaatatacaataattagctgggcatggtggtacatgtctataatcccagctactcaggaggctgaggcaggagaatcacttgaacctgggaggcggaggttccagtgagccgagatcacaccactgtactccagcctgggcgacagagtgaaactcagtctaaaaaaaaaaaaagccgggcacggtggctcacgcctgtaatcccagcactttgggaggccgaggtgggcggatcacgaggtcaggagatcgagaccatggtgaaaccccgtctctactaaaaatacaaaaaattagctgggcgtggtggcgggcgcctgtagtcccagctattcgggaggttgaggcaggagaatggcgtgaacccggaaggcagagttttcagtgagccgagatcgcgccactgcactccagcctgggcaacagagcaagactccgtctcaaaaaaaaaaaaattaaattaaaaagctataaaagctataatgagatatcacctgatatccactagaatgtctatcacatgaccctgaaattccacaaataggttttgaccaaagagaaatgaaaatacacatacacaaaagacttgtacatgaaagtttatagcagattgattcacaacagcaaaaactggaaaccaccccacactgtttctctattacagcataaaaagttatcccaaaacttaatggcttcaaacaacaaatatttattatctcacagtttctatgggccagcaattcagaagcagctaaatagtagctggtgattctagcttaggatctttcttttaactttttaaaaactttttgtgaatacatagtagatgtatctattttaggatctttcttgacattgtagtcaagaagtcagctgattgtatttctaagatttggatgaagctgaaggattcacttacaagatgtcccagtcacatgttgcacgtttttagtagggagccttagtttctccccatatgtgtgtttccattcactgctaggatggcttcctccaaagtaaacaatccacaaagaagaagtcacaatgttactgtgacatagtctttgatgtcacatcccatcgtttctaccagattctatttgttaaaactgagtcactcagtacagctcccatgcaaaggtaagggaagtaggctctactttgtgaaggggatataagaaaattgggggccatattttaaaacaaccacaaacctgaatgttcatcaacaagtgaatggatgaaaaaattgtgatatatttaggcaagagaatactactcactgatatttttaaaaaagaattggactattgatacacaaaacaacagggatgattctccaaactgtggtacagagcataacacaccaaacacaaagagtatgtgctgaatgaatcttttatgtgaagttctggaaaaagcaaaacaaaatgatagaaatcagagcagtggttgcctagagcatggggagaattattgtaaatgggcatgatgaaatttctggagtgatggaaatgttctatatcttcagtagggtaatggttgtctggatgtatacatttgttcacattcagtgaattgtccattaaaatatgtgcacttcattatgtaaattataccttaattttaaaaagagaaaggaaataaaccaaagtcaggggggattgaatgagcacattcgaggcttgagaggaaggctggaaatatgggacactcagaaggtgtggatcaggagagaatagtgcccttttactccccagtgacacggagaagcagtggtgacctttttatatgccaaagggaactcagttgctggcacacttcctttgaatcttcacattccttcttaaccattagtagctgtggccaattagctgtctataggttatggggcacctagtcttggcagaattaatgagctacttctctctatgggatgggagtcttgggattcctccccccatcatctcactatgcctttttttctgcctttaatgtcactaaaagagaggttaacttactggattgaggaaaagaagtcgttagcaagagttccatagtaaagcgctaactctagctcatgtgtctggcagagcaatggtggaatgtggttagcgcatagcttcttcagccagcccacctgggttaaaatttggtctttggtgcttactagctatactttccagaacaagatattcaacctctacatgtcttcaattattgatctgtaagggaaggtaataatagtacccaccttttgaagttataaggagccgtaaatatgaagcgcttttttgagtgcccatggaagtaagcactagcaatcaatactcttaactgaaatccaagttccaataatcatcaagagtataacattcctctttagtttgcttttagttctcattgtgagatcacaagtggaggctccaaccagtccagaagttcctttctatggggaagctgtggcagcaaggccgtgaagagagtctgacttaattgcaagtaagtcacaagtttattcccctacagcccatcaatttccacatgttcttaagacagttctgaatcaaacagggtctacaatcctggcactgacactcattggcagggtaaccctgggcaagttacttaacctctttgagactgtttgttcttctgcagagatattaactgtctagcagggttcttttaagaagcagatattccaggaaattatttagcacagtgttagtatataggacatcaacagatagtaactgtcaaaactataagtggttattattattgaactgtagggcagaatttgtctcataactttgtagcagttagtacatgactggctctttgaggaccaaaaaagaataaattaatgtgcttctgtgtggagttaatgggatgtagggaaagtagtgcttgcctattattggtgtcagagaaaaggaccagaagaaacagggtaaggaaaaggcatgttattaaagatagaaaataggagagtgcagagggtcaaaggaagatataaactgaagagattaagaaaaaacatacagtgagacaagttgccaagagagtaagaatgtaagaaatgctgcagtttatggatgaataaaactctggacaattgctgagacacaaaagatatgaggctgcaaagtttaaaaaggaacgatacatttaaaataatcagaatagtgtttacttcttcagtgggagagaaggagatgtgatcagggaggagaacacagaagacttctaagataccagtaatatttgatctgttcttaaatcaggaggagattcaggtacaccatgtgtttattattccataaaatccatagatgtgttttatatactttttgtttatatgatttttaaaaaattaagggaacaaatcttatcctcaaggagagacgtaatgatggaggaaggaatatagaaggagacaaaaaggagggagtcttgatgaaaagggagatgggaggcagcttttaacaccagacagggtcctgtgatgcagaggtgattgtgccatcccataaagtcccagggcactgtctgccaatgagaccaccaacttgcttgccctaaatggccacatcccctaaacggccctcctgccattgtctgtgctcagaaaaccctcagtttctgcctcttacctgccagggtggtgccgcatcccacccccatcattgagcttgcctcatgtgtctcagcacagtcttttacagcaaaaatgcatgtcacctcctcctaaaggctttccgtggcccacccacccagattcctcctttattgtgcagactctttcctaacccacacctcatcttaatttatttgccttcaattctgggcggcggtgttggggagggtctcaattttcccatgtatttcccagtgtttattgaatacatgaggccatactcttctagtctctctgcttctcatgctaggaactgaaccgaccagcctatactttaaggcttgttatttcactgactaaggaaaggctacttaagagggcaagctcagacatacataatctggagtggatcttccatgggaaaacacgtatataacagaaattattggcaaaactataagtatggtctacagagtaagtaataatattttattatttatttagttagttttgagacagagtttctctctcgttgcccaggctggagtgtaatggcacgatctcagctcactgcaacttccacctcccaggttgaaacgattctcctgcttcagcctcctgagtagctgggattacagacacccaccaccacaccccgctaatttttttttttttttttttttttttttgtagagacgaggtttcaccatgttgaccaggctgatctcaaacatctgacctcaggtgatccgcccgcctcagcctcccaaagtgctgggattataggcgtgagccaccacacccggccaataatactttatcaatgttggctttcctgtatttagtaactgagctgtttttacactaaaaaaaaattctatcttagaaacatgaagaagtgaagaggcattatatatacaactcactgttcagtagctcagggtaaatataattgcatatgcaaagataaagatgtaatgataaaaatgtcaagtgttagcactttactaatatagataaagaacattcagaaattctttaaattactcttaaaatttgggggtatgaatttttataaaaataatgttttaaatcttaaatagtgaatagaattaagaaagtaacaaattctaattccttcctttttttctttaaattcttctagatcctgaataatttctacttaaacgtcccaatatcaactctctattttgctattgacataatcttatttgagaggcaaaaaattttaaaaattatatcatctttttaatttctaagccccagaacaagacaattggcagcatttttttcatgtcattttgctacattctacataatgttaagttgaggttagggattttcatttgtggaggaagctcttacatttagtttaatgaatcataatttttttaatggagaaggaacaaaatacctcattgatttttctatgagtggagttaatacacacagcggagaaatctctttgttaattctacactctgcctctgattgacacctctgcaaacaaagataaagtagataaaacatgaataattccaggaaacttatgccccagaatacagaataattttgcatacatatgaatagtagggcaattctatcaaatgattcttttctaattctttatggatgtacataatgaaatattcagaactaccacaacatttagaataagatagagcctaacaatttattgttgaattaatgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaagtttaatgttttatttgtagtatttttttccattttccactaaagagtccagaaaaaaaaagcaaacataatataacctttgagttataacagaatatttcaacaagaactttgttgctatcaagtaaccatatagtataggttacacagaactcctatcttctggattaagactccgtcttcaaagtatttgggcaccctggttactgaacatgagccagaagaaaatgaactgcttttccttaagcatctctctacccctgggtcacctccagtggagtggtatgtcaagaaatgtaatttgtcctttctgatgccataatctaccatatttttttaaattaagtcatgccaggaggagatttctctgctcctcatcacatgtttccaccagaaacatgggcagctccgcatcttgggcttcaccacctttaaggtgaggtggatggtcttcttcttggaaatttcataagacgatagcattttcttgggctttggggtcttaaagcccagcagaaaaaccaagtcctgcatgggaaccttggtcttagaccagagctgttcacctaccttcttcactccattttagcagccaatgtcattaattcccattcctcacaattgacactcatttaggcaattctatataaagttaaaatattcttcagaaacgaagatgaagtaaagatattctcagtgaaagtaggtatcaccaactcatctgatttaaaagaaatgcttttaagcatggattgcactgcttcaggcagagaggaaataaaaccagagggaaaatcagaatatcatgaatgaaaaaggaacaacagaaagagtaattatctgggtaaatgcaatcgtatattattctctttttgaattatttaaaatatgtatctctgttggaactaaaaagtacaacactgatggggattcatacaaatgtaatacatatgacaattactgaataaactaataataataaatggatctattcattctaagtagaccatgaaagggtaaatatttatatcataatccctaaagcaacaattccaataaaacaaaaaaccatactgttgttataggcgtttgaaccagagtgactccatcttgagtagtggctgggtaaagtaaggctgaaacctgctgggctgcattcccaaaaggttaggcattctcagtcagaggatgagataggaggttggcataagatataggtcacaaagatcctgctgataaaacaggatgctgtaaggaagccggccaaaaccaagatggcaatgaaagtgacctctggtcctcctcactgttcattatactctaattataatgcattagcatgctgaatgacactcccatcaatgccgtgacagtttacaaatgccatggtaatgtccagaagtaaccctatgtaatctaaagaggggacgaactttcagttctgagaattgcccaccgtcttcccagaaaacttatgaataatccactccgtgtttagtatataatcaagaaataactgtaagtatactcagttgagcagcccatgccactgctctgtctatggagtagtcatactttattcctttactttcctaataaacttgctttcattttatggactcgccccaaattctttcttacatgagatccaagaatcctctcttggggtctggattggggcccctttccagtaacacagtgacatcaacaaaaataacagagtaatgacttccaaaaatgacctacttcctaagagtaaaatgaactatggaagaattgtcagaattaatattgtttagaactctagaaattaaccaaaggcttgctgcaatctggggagtgtttgttcaagaataatagctgaatcttgataagaacagtgagctctgtgatgttttaactggttccactcctgttccttcctcctcagctcttaaaaaccaacggtccacaatcatggtgaaaaccagcagacatgaaatcactggaggggacacaatagggttacagatcctttaatcccttatttccagaggactgttattattttacctgtctggttgttccctagaactcacaatgctatccttatttgacttgactcagagctatcccagagagaacaatgtatttcctggggaaatgagtaaaaagaatcataggcagttgttgaacatcatggttgccgacggtcataaataacagttggaacaaacaatagcctaaccaagaacttaaaaacgaaatgtcagggaatgagatgcccataaaggggattgaaaagccttaatatactccagaaagttccgacggccacatgcatgcatagatgtgggcatgacaagtgctgcatatatgctttgaacagacctgagcaggctctaagctctaaccctgaataagtttgaggcactgcacagacaggaaatgaaggctaggacacagtgtaaactgcttggttgggctttgaagacctgtatctacctgcacacagagcctctctacatacactgggagacattacttccaggaacctaaggaaatctttgtccagtctttacctggccactaagctaaccaagcagagacttcagtggccacgttgaacaacaacaacaacaaaaacaaaacaaaacaaaaaaacaaaaaagaacagacttgacagatagtttttaaaaacctgatcaaaaaacatccactagcaatagtaaaatctgggaacagaaaaaatatgacttccagagttgccacattatactgtttaaaatgctaagttaaaaaagaaagaacgaaataatacaacatgcaaagaaacaataaagtaaggcccatacacagaaaaacaagcagttagtagaaactgtctctgggaccaggctctgaaggaggtgtctgcctcagtgcatccaaaacagccaggtaacctttgctttgggactgaagtaatggctctgattctgagatgagagctcacactagcccttaatttaatctttacttgaggtgaaattcaatggattattagaatgggccctaatccagtaggactagtgtccttataagaagacgagattaggatacaaacaccacaagggacaacgatgtgaggacacagggagaagatatccatctaggagccagggaaagagtcctcagaagaaacctatcctgcccactccttgatctcagacttcctgcctcctagaaccgagagagaataaacttctgtagtttaagctactcggtttgtggtctcagtcacgggagtccaagctgatgatcacagttgtgatgagaactttacaaattgaatcatgggaagtcttgcaatagtgagatctacgacctggtagatcctataatcctataatctgagatgctgattctacaactctgagctgctaacgctttgcttctgggtcacagaagcttctggaaataaacttgtcccacaaactgataaatgcctgtgatttttctagaaatatgccacaggcaaccctggcatctgcagtcacatgtcagtatatcagtggggtttcaggagaagtttagggatcagctccaagtgaacctagtgtttcaatcttccctccttgctgggatgatggagtccccttcagtcaaggctctgttgaaatgaaagggtctgttcccagttccactcttcccacccagggttctggactgttaatggttgtcctttttttgttttcttcccgttgattcttttaccatcttcctcctcttactgattttgcgtgaaggggggttttgatggaggtaaggtagctgataagaaatgaggtagtgagaaaactagtgaggggtcttctggctgtccccagacagtcctcgtgtggtccccagcccagcctgcaggttctgggctggctacctcttggcctctgtgctgtgtgtctagagctggcctctaagggaagggccctgtgagacctggcagaacagggtaactggtccaacaaacatccctcctttcctctggctccacagctcaggattagatctagatagcatgtccagtaggtgccagactacctcattatatcctgtgagatgggcccagagggccttgaggtgggtaagcttgaagctgggcacccagagcctgagactgacagttcctccctccctgtatcctgcaggaggggccctgtcccaacaagagccccagggcctggcctgagggtgtggatgtggggagaggagggtctgtgggcccaggagggggcatttgtaggggacattgagtactgcagctcagaagacatgaatgacagggtgggaggtgtcttccatgtctgtccatggcacagcacccctgtgattcccaagggctgccaggggcccattcatctgagctctttatagatcctacatatgagtccttcatcagatgtgagattgaaaccacttcctccagcctggaacttgccttttcattctccccacagggtctttcaaagtgcacacatcttatattttgatgaaatccaattgatcaattttttcttttatgcatcatactttttgtattcatccaagaaatattttcctaaccataagttacactgatattctcttttcttttcttacatacagcttacagctttaggtcttacattatggtttatgataaattctgaattaatttttatgtatgatgccacgtatggattgaagttctgttcatatgtgcatatgtatatccaataattctaaggaccgtttgttgctaagattgtcctttctccactgaatttactttacaccttcttcaaaatcaattgaagatatatgttagggtctattctggaccctcttctgttctgttgacctatttgtccatcctgttaccaatatcacaccatctggatttctgaacctttataataagccttgaagtcgggtattataaactgtctcacttgcttcttcttttttcaaagtttttttttttttttttaactattctaggtctactgcatcgccacacacagaatcactttctcatgaacatacatacatgtgcaccagaaatataaatatatgcacatcaagaccaagtgaaatttatcccagggatactaggcaggtttaacatgaaaaatgagccaatataattcaccacattaacagattaaaaggcaaaaacattatttcagcagattcagaaaaagcattagacaaaatccaataggctcataaaaaatttcagtcaactaggaatagaaacgaagtttctcaaaatgataaaaggcagctaccaaaaaaaaaatcctatggttgatatttagtgggtattacccttaataatgaaagactggatgctttcaccccagatgaggaacaagccaagaatgttggctctcaccacttatttcagcgtcttaagaagataccatcagggcaaaggactccttccttaaatagacacagatttccatgtggagtcattattctcttgctggatgtatgtcttttaccacttctcagtctgcatatctcctggtgatgatttgtttcatcttttttgtgtctccaaaaacctctttattttgccatctctttgggaaatattttgactgtgtaaaaaattttaggctgacaaatttatttcttttaatattttaaagaattttctccactgtcatacaacttgcaactttccaacaagaaatctgcttcattcttatctttgattttctgtacatatatgtcttgttcttctctggctgtttgtaggaggactcagtttcctgggcatagatatgcacgggaaagatgcagtaactacatcaagtgtggtgttgtccaagggtggataaataggccaacagaacagagcagaaggcccagagacagacccacataagtctaaacatgattgataaccaaaaatcagaacaatagtgaaggactatatttgttataaatgtgctgggaccattggataacaatcagctaagtgggccaagcagccttttggcttaggctgaagcaggataataatgttacctattaatagagtgtgaaaactggcttcatgttttcacagtgattagagcaatattgagatacagtaaatcatcagtgaacatatttgctctagttgctattgctactattcatcttcctgtcccgtgcagcgtcttatggttaccatgattcaagtgcctcctggtgaggccgaaactccacaagacactctggtcagtcctggggtacagtttcttccaggtggcagaggctcagtcctggtcacccgctgatcccttctcaggatgtgccacacagttctgccctactgcggggtgaatgctgggatgcctctctctttaaaaattccaaacaagggaactggtgtgagagggtgggtgcctccactccctcagcccttatttccaggtggggatcaccccagaggagtaattcttgagatgtggtccccaacacctttttaggggaagggaggccaacataatcttcaggtaatacttgaagtattgaagtgagtctgtgtttctcacactcatgcactcctgagtgaaagtggagttttccagagactgtatgaggtgagatgaagccgccaactggaaaactacaccaatgcagaagcagctgtgaatgtccagcttgctgctgggcctctaagaggtctgcaaaatacaaaaccatcttgctcttctcaataacataactttttaaagaaaacatagttattttttctaaaatttattcatgtttacatggaataggcatacaatttatgttctaaaggagttaataagtaaacatttgtaaagttctgagttataattactaatactgtaaatattgaaagatacaaccctgatccacaaaagttctttgagctgctcaatactatttaagactgagaatctcaggtctattttaagctctgggctctctctctttccccgcactttttccctcccggggagaaggaaagaaactgatgagtgagtttggaagaataacctggagtgagtgctcccttcaccagtgggtggtgagttccccagaaggactgctttcctccaaagagagatgggcaggaagagggaggagggatgggatcctctggagtaggtaccatttaaggggcacttttgaaagtcagttttttagacatccaagcccctttctccagttcaattttaggagcaatagaagtaatgcattgttctccatctgacactgtcctcattccttcattcactttcatcagtagttctcaattccagagggaaggaaggggattacttactaaactgtaatagtccatacctagccttgacatttttgtttttctgagtgagtgagagaattcaggaaactgaggactgtctgtgttgccaggagctcatcagctgcaaggataatagagacgtttccacaaaaaactaaagaaccataagccagatgctcacctccaagggaactgttggcccagggtaaaggcacataaaatgcccaaattgtatcccctgcctgaacatagcagcagcccaactctgtgagatcaacctgcctcttacttccaggcatccaaacttcacgggctaaagtcctaaccctgaatgtgacaatattttgagatagggcctttaaagagataattaaggctaaggagctcataagactgaggtcctaatcctaaagaattaaaatcctcataagaatagaaagtgtccccagggatgtgggtacacagaaaaaggccatgtcatgacacagggagaaggcggccatctcaagtcaaagagggaggcctcaggggaagcccaccctgctgatacattgatcttgaacttccaagctccaggactctgagaaaataaatatctgctgtttgtagcctaatctatggcattttgttagaacaaaacacgctgactaaagacaggcagcccggatcagcccttctgtgctctagggccagggtttctgccattcacttatcaaaggacaacatcaaattatgtaaatcaaactctgtttcaaattctagtgtgatgtgaaacaaactaataggagatatgaacatgtccctatcaattttgtcatttacactaggcagaaatcaatatgatccaagtaacagcatttaaagaattgctgtaatctaaacatctcagaattgctttagaatgtatcacattgaatatctaaaataagagaatgtacattgcttaccagtatcactggcacatttacaaacctgagcaagttttcggcaacagagaaaacagtgtgaatttcacataacagtcatagtattatacaagtgacattttccaagtgagtaaaaaactgacaaatcaattacaagaacactgggaacaatctccaaagacgtgttcgtcgaattctagttagaatatggttgggaagcctcaagaaggcagagacaatgaaaacatgtggaaacatgcaaggtggaaaggtggactagtgagcgatggataacatcagatgatggggggttaatgtcagacttgcagggcattttgctacttgctgggaatttgctagggtaggaggaaggtgtggcctctgccctactggggcttcaagtgcaaatgaggcaggagtacaataaactgataacaacacacaacacagaatacatagaaaataattatagacaattatcttcacattaaaagaaacaaaccttttagagaagagtcaaaaaggggtggagatttaaatggggtggtctggacaaacatctttaaggagtgaagggtgaaaaagagtaaaatgtacagatagtgttgagggagtgctctaagcagggaagggagaaagggaccttgcaaggttgggcgcgagtctggtgcaaacaagggagagagtgaatcctgtgtgaggatgtcatgggacaaggtcaaatggtgcacctgaggacaactcagggggtggacaccatcctgaaatctaagagttacgctggctggggtgcaattgaacaaatgaagcagggtgatgtgctgctgtgatggctatagagcattgacgggatggagctggggctggtcaggggctctcattaaggttctgaccatggtgggtgccgggcaacaccctggtcagggtggggaagaatgcatgacattctgcagggtgggattcctgtgaagaagcacaggcgctagattgtgtgatgagtctgggaaaaacacagagagtagcctgtgcgtggaacctggaatgagcagagtgaaacagcttggagaaaccaggctgtaggccagactgccagcgttagatctctccacagtgagcaacgccagaaacaacttgttatggcactcttactgaatcgctttcctggcttttgtaggaagggatggatggaaacttgaggccataatggtggaggaacatcaggatcatgaatcagtctctgcccaggggtccccaggaaggatggactggggtgacagaggacagaactccgagcaaggtgactgaataaggatgaatgacacttgtcactctcagaaatatggagcttgcagaagccaggaaggttgaactagtttacagtcccaccaacagtgtaaagatgttcctatttctccacatcctctccagcacctgttgtttcctgactttttaatgatcaccattctaactggtgtgagatggtatctcatcgtggttttgatttgcatttctctgatggccagtgactataaactagttcaaccattgtagaagtcagtgtggcgattcctcagggatctagaactagaaataccatttgacccagccatcccattactgggtatataccgaaaggattgtaaatcatgctgctataaagacacatgcacacgtatgtttattatgacactattcacaatagcaaagacttgaaaccaacccaaatgtccaacaatgatagactggattaagaaaatgtggcacatatacg

SEQ ID NO: 1156 - DNA, 20915 bp, Homo sapiens
ttctctctcacacacaaacacattcaatttctctttttaaaacttagagactgttgacaagatcgtggaccctggaaaccattcctcagtgactgagtccattctggctgggctctcagaacagccagagctccagctgcgcctcttcctcctgttcttaggaatctgtgtggtcacagtggtgggcaacttgggcatgatcacactgattgggctcagttctcacctgcacacacctatgtactatttcctcagcagtctgtccttcattgacttctgccattccactgtcattacccctaagatgctggtgaactttgcgacagagaagaacatcatctcctaccctgaatgcatggctcagctctatttattcagtatttttgctattgcagagtgtcacatgttggctgcaatggcgtatgactgttatgttgccatctgcagccccttgctgtacaatgtcatcatgtcctatcaccactgcttctggctcacagtgggagtttacattttaggcatccttggatctacaattcataccagttttatgttgagactctttttgtgcaagactaatgtgattaaccattatttttgtgatcttttccctctcttggggctctcctgctccagcacctacatcaatgaattactggttctggtcttgagtgcatttaacatcctgatgcctgccttaaccatccttgcttcttacatctttatcattgccagcatcctccgcattcactccactgagggcaggtccaaagcctttagcacttgcagctcccacatcttggctgttgctgttttctttggatctgcagcattcatgtacctgcagccatcatctgtcagctccatggaccagaggaaagtgtcgtctgtgttttatactactattgtgcccatgctgaaccccctgatctacagcctgaggaataaagatgtcaaacttgccgtgaagaaaattctgcatcagacagcatgttaatgaatagaatcaatgttatgttgttacgtcaagataggtctttggtttgattagatatctaacttattggatttattgttgagatttatgaaaatttagtgatgctcttttatgtaacacctctccaaaatattcctccggtctgcttccatcgaacttatattccaatgagcatatgtaaagaaatacaaagaataaaatcaaaagacttttgaggtttaaagtatccctagttttatttattattattattgagatggagtctagctctgtcacctaggctggagtgcagtggttcgaccttggctcactgcagcctccgcctcccaagttcaagaaattcttttgcctcagcctcctgagtagctgagattacaggcgtgtgccaccatgcctggctaatttttaaatttttagtagagacagggtttcaccatattggctaggctggtctcgaactcctgacattcagtgatctgcctgcctcggcctcccaaagtgttgggattaccggtttgagccactactctcagcccctagttttatcttttaattataatatagacagcaacctcaacaacaacagcaatgatgatgatggtaatgagaatgatagtaataacatatattattgaaagtttatgaaatatcaagcacccagctaaatgggtcactctatttaacatttgcagtattacttcagggaaagtcttagtattattatgcttttaaatatgaaaaaaattaaacatttatttgagtgactgctcagggttccaaccataatatgacattgagactggaaaggttggctcaaggacttttgacattattcaaagtggtacttggtccaggtaattgtgagtaggtctaaggactctagagaatttctgtctgcaaatcaagcttcccccgttccctatgacatgttccctacatgattgtgtcactgtcctctggacagcttcatgacagtttcacttttatttcatttatcataatgaacataaccaaaatctttcaaatttgtaatgatctacgaaaaacaaagcaaaaccagaaaattattctagtcttattatagagatgcattgtagatacttatattattatacttcatatcaacaatttataaaaaacacacattgttttatcgtcataccaataacactatggctctttatgaggcagatcactggggcagctgaaaattctactaagttgcattgcttccatgtggttcacactctttggtatcataatttataaacaggtgccattttatgtcaaattttccttaaaaaaatctcttctctgccctcatgttattacttttctgcttctgggcatttaacatcctgtaactgtgaatatccacgatattctaattactcgattgcctgtgtctctccccaatttaaattacctactcgctattgtcagatcaatattttttgatgctgttccgtgttattcaactaatataacaagtttcggtgttcactataatttcctaatataggaacaactggtacaatatgtctttatcattcttatatttcattatccatccattcaatgcagtaagagatttgttctcaaggacccattgcatttattatttcacttaattttcatcatttatataaagtaagggaaaatggctacaactataactcttgtcttaggcatgattcccagtctagcactctgtccaacagactgtcatatataccaataggctaaaagaggacaaaccaaaaagcactgttgggtagacacttgaatcaatatggcttgagctcatacacaaaatataggctacttaaaaggcagtagctttatcaaggaagagggaaaaagcatgtcatattcagggtactataatcaaggcacaaagatagaagagtaagctgaagtagttcatgaaccaccctgggtcactgtaagacaccactccttattttttttaatttcaagtttcaatttttgtgggtacataataggtgtatatatttatgggttgcatgagatattttgaaacaagcttgcaatacataataatcacatcagagtaaatggtttatctatcacctcaagcatttatcctttgtgttataatccaattatacccttttagttatttttaaatatacaattaaattatttttgactatagtaaccctattgtgctagcaaataccaggtcttttccattctttctattatgtgtacccactaaccctccccattttcccaaccctgcccccccatctgaccccacctactacccttcacagcctctggtaaccattcttctactctctatctccatgagttcaattgttttaacttttagctcccatgtgtgagaacatgtgaaatttctctgtctgtgcctggcttatttcacttaacataatgacctccagtttcatccatgttgttgcaaatgacaaaatcttattcttttttatggttgaatagtacttcgttgtgtatatgtaccacattttctttatccatttgtctgctaatggacacgtaggttgcttccaaatcttggctattgtgaatcgtgctgcagtaaacatagaagtgcagatgtctcttcaacatactgatttcctttctttggggtgtatactacgagtgggattgctggattgtaaggtagctctactttcagtgttttgaggaacctccaaactattctgcctaaagattgtgctaatttacattcccaccaagagtgtacaagggtatccttttctctacatcttcatcagcatttgttaagcctgtcttttggataaaagccattttaactggggtgagatgatatctcattatagttttgattggtgtttctctgatgatcagtgatgttgagcatcttttcatatgcctgtttgccatttgtatatcttcttgtgagaaatgtctattcaaatcttttgcccatttttagttggattatgagttttttttcctatagagttgtttgagctccttatacactctagttattaatccactatcagatgagtagttcgcaaatattttctcccattctatggattttctcttcactttgttgattgtcttctgctgtgaagaagctttttaacttgatgtgattccatttgtccatttttgctttggcctgtgcttgtgggtattactcaagaaatcttttcccacttcaatgtcctggaaagtttctccaatgtattcttgtagtagcttcctagtttgaggtcttagatttaagcatttaatccattttaatttgatttttgcatatggtaaaacataggggtcaagtttcattcttctgcatgttgatatttagttttcccagcaccatttcctgaaaagaatgtcctttagttccaatgtatcttcttgtcacctttgtagaaaatgagttcactacagatgtacaaatttatttcaggtctatctgaatgttttattccaataccatgtttaaatcagtctctcagtgattctcattattgtataattacttatgaaaaggcctattgatagcattcccatttatcatctcaaccaagcttcaactatttctcactcctattatttatcatgttgatgtaatagttagtcatagtctgctctcctgtgaagtggtgatccaaatacatcataatttgttatagacatctcagaatcctgcaggcattgtaattctaaagcgaaatagaagctctctgatacatgatatgaaagaacttgctgcactctgaaaaaatttttgtgggaaggatttaatacgagatatcatggaacacctcaattcacagagtggtccatacaccagcagcattggcaaaacttgacagatgcttaaaagtgcaaatctgaagctatgtatcaaacttaccaaatcagaatctgcatttgaagaggatccccagtgtgataagcttttaagaaatgccggtatctgacttcagatcccaagattttgaagtgatatgcggaggacatctaatattgtattttaaaaatcccttggttttaaatatgcagtaataattgagaaagatgaatatagtccaatcatcgacttctttaagtagaattgaacctaatgtatttatctctactttgatatgagtgtccaaatttaccttgatttattctgtgaagactgcatccaattattcctatgttagagaaaaacaggaaaaatatataagaaataagaaggaacatggaacataggaagctaaaaataaaatatctaaatattcgaattaatgcaggaaaaatattattaagggatcttaaaaaagttaagtactatatcaatattatgaattcctaccccatatctcttaaaatccaagtatatatagattttacttttgaatcaagtatatacctgtttatacataaaataaattaaacatttttgcacaaggaaataggtggcttaattggttatttagtattatctagtcctattagcagtaagataacttgtcaggatatgcctggtgctctgaaacctgctcattatagtgtaggctgtgaaccaatagcactggctataagaagtgaagaatctcagaccccactcagacctgcaggatcagtgtctatatgttaacaaaatgctcaggtaatccctgcacacaaaactttatcactaattgataagtttaggattgacagataatctcacttgaggaaaaaaaaaaaaggccactagagagtcaactgtaattgcttcttttctcaagagctagcttccctgagaaatggaaatctctgtggaatatttgttccatgttatttggtacctgatgtgtttaaaccaaggacatagctttatagcacagccatcagaactgctccggcgactgtcaaaggcaaggatatttgcttctctggtgctgcagaaaaaaatgaaaggttacaattgtggatgctgatttgtgatgtagaccagcttctgaggccagactgagggatgtgccctgccctctttctcagcacaaaagatagtagaaacacccaacaccagcattagtgccattcttttccaagtcaaagagagtaagttgcaggtaaaatttggcattgcatttctcaagcagaggtaaggtgactgcggtcatctcacacttgtgatttaaaactattaggcctgaagtaattgttgtcaaaattcaaagatccctctaaaaacattcattcattctttcattcactcataaaatatttttaagcacctttgatgtgtcagatgctggttacttgggttaaagaagaggagaagtttaagttagtcttacatctgtcttatagtttagctcacagtgtacaattgcattgtgttagaaataataggttgctttctaagcttgtgttaggaaggtcaatctattccagtgagttgcagatgtcttcctgatggtgtaatttttaaatgagacttggaagaaatacaatttcaccaggcaattgagggataggatttagtaagactatttcatctgaaaggaagcacaaataaatgttcagatagctaagaaaataagacatattccagaaatggaaaggaaccaaatgtgaactaggtctggagaattgcaagaggtagcatagattgtcatactttattcttttttttttatttttgagactgagtctcgctctgtcacccaggctggagtgcagtggcgctatctcggctcactgcaatctccacctcccgggttcaagcgattctcttgcctcagccagttcagcaactgagattacaggcgtgcaccaccacactcagctactgttttgtatttttagtagtgaggggtttcactatgttggctaggctggtcttaaactcctggccttaagtgatccacctgcctcggcctcccaaagtgctgggattacaggcatgagccaccatgcctggcagctatatgtgctttttaggcagctccaagaacttactgcctatgcctagtttgctaagaggctttttatttattattacttttggatattttctatgtgctttttctgtattttagaagaaaatctgtaagattggtgttattacattcttaaatgtgaagaacagtgaaaatgtctgggaaaatattgtgccttgctttatgaaccagcatataaataattctgtaaaggttccatgtgaccttaaaaagaatttgtgtcattagttgttgcatgccgtaagatcgtgtgtgtgtgtatgtgtatacagctatacatacatatgattatcttcaaatttatgactctcattcagacctcctttatctttgccgattattagggtttttattttgaaaataattttattaatttattatatttaatactttataagagtatatcaaaatgtaattttatctagattacattaaggataaaagtacccattttaagtgtaaaactcctaaatgagttttgacagatgcatacactataaactggtgaaatcaacacttccttattgaaacatttttatcatccctgaagatttcccgtgctcctttctagtcattctacagtagctactgacctcatttctatcaccataaaattagttctgctgttctacaagttcgtatgaacggaattgtacaatatgtgctcttttttgtctggctttttgcttaacatgatgttttgaagattaatccatattgttgcatatatctgtgatttattccttgttattgatgagtagtgttctattctatgcaaatcccacaattcattcatttattcaatggttattgaataaatgaatgaatatttgggttgtttccagtttggagttgttagtaacaaggcttccaggtacatgtttgtacatgtcattgtgtagatacatgtttacatttctcttgagtaaaccctgaatagcagaattgttgggttataatctaagtatatgattaactttctaagatattgccaagcagttttccgaagtagttgtacggttttacacctctcctcaccagctatgtgtgagagcttgagttatcccatatccttggcaaactttggaactgtaagtttttgtttattttgttttttctttcttttataatttttagccatttccatgtggctgtgtagtggtatgtaattttcctgatgaataatgaatttggtatctttttacgtgcttatcaactatttacatatcttctgtcatatatcatctatacaaatacttttcttatattttaatttggtctattgtctttgtatcattgacatgttgatattatttgtatatatttacataaaaggccatagatatacgtattttttgtggcttactcttaattttctttttttaacttttattttaagtttagaggtatatgtgcaggtttgttacataggtaaactgtgtcaggggagtttgttgtacagattattttatcacccaggtattaaacccagtacccgtgagttacttttcctgatcttttccctcctcccaccttccactggctctgataggccccagtgtgtgttgtccccctctatgtgtccaagtggtcatgtgttccaatcatttagctcccacttagaagtgagaacatatggtatttggttttctgttcctgtgtcggtttgctaaggataatacattcatgtccctgcaatggacataatcttgtgcttttttaatggtacctttggagatgtgcttttaattaggataaaaaaggatttatcaatgttatatggctaattcatgtgtgcatatatgtcctaaggaatctaattggattactccactatattgaaattttcctctagtgttttttcctaaagtttaatagtttattgtttatgcttaaatttaagatttatttcaatattcttgtttgcatgggtgtgagatagaagattttagattttctgtttctactttatttaaaattcaagtatgacttatttggaattttacattaatgtatcgaatgacaaaatcttttgtttagtgcataacagaggctacatttatatatttcctaattttataactccatctttggcacactcctaattaaagaaagaggaaagagattaatgaaaatgtgtgaacatcatgtttactatttttgtattttgaagtatataaatatccctcattttccaattgatggatggtggaacaacaacgaaaacaattattgttgtcattttcagagtgctaaatatctgctaattagatgatgatgttaatttaattgtccacacttatcaactggtaaatgagaggatcagaatatgaacacaggcactttgatattaaggattttttatttagccgctactcccactgttttcctctaacaaaggcagaggtgtaatatttggtccaagaaccataacactgctgcagtgggacaattccactggtagatctgtatcatgaatcttgttggtgccatttcattttaataataatactgaaaatctgataatttttaatagaaacctaaattgcctgattatcattaaaatcctccaaagatgtagccataatgcacctctgttacccttggcagaacttctctgctcgttaataaaggacaccgtactgaatgcaggtctgctctctcccagtggcagctcagccagcttccatcattttcattagcccttgtaagtttttaagtgtgcgaaaaacagctcagaaaagttgacttgaaatctttggaatgttcaacccagagagtagcaattaaaattcttaaatgataataattatggctgaaatattttatataaaaaacaactatttgatattaagctataaaatatttaattaataaaaatattacttagctaatttacccagagttaaattattatatataaaccaaaggtcatctaaatcatgaatcctcagcatgggataccctcctccaaaagtagaatagcaactcaatccctacaaacaccatggtttttctttcctccgtagaaactgaccaaaggaaaatgtcagcaggaaaccattcctcagtgactgagttcattctggctgggctctcagaacagccagagctccagctgcgcctcttcctcctgttcttaggaatctatgtggtcacagtggtgggcaacttgagcatgatcacactgattgggctcagttctcacctgcatacccccatgtactatttcctcagtggtctgtccttcattgatatctgccattccactatcattacccccaaaatgctggtgaactttgtgacagagaagaacatcatctcctaccctgaatgcatgactcagctttacttcttcctcatttttgctattgcagagtgtcacatgttggctgtaacggcatatgaccgctatgttgccatctgcagccccttgctgtacaatgtcatcatgtcctatcaccactgcttctggctcacagtgggagtttacattttaggcatccttggatctacaattcacaccggctttatgttgagactctttttgtgcaagactaatgtgattaaccattatttttgtgatctcttccctctcttggggctctcctgctccagcacctacatcaatgaattactggttctggtcttgagtgcatttaacatcctgacgcctgccttaaccatccttgcttcttacatctttatcattgccagcatcctccgcattcgctccactgagggcaggtccaaagccttcagcacttgcagctcccacatcttggctgttgctgttttctttgggtctgcagcattcatgtacctgcagccatcatctgtcagctccatggaccaggggaaagtgtcctctgtgttttatactattgttgtgcccatgctgaacccccaatctatagcctaagaaataaggatgtcaaatttgccctgaagaaaaatctggacagcaaagcatgttcatgaatccaattattgccatgttgtcatatcaaaacaggctttcagtttgattagatatgtaatatgttagatttattgtgcaaatttatcaaaatatagtgatgctcttttatgtaacacacctccaaaatattccttcagtctacttccattgaacgtatattccaatgagtatgtgtggagaaatactaaaaataaaatcaaaactcttgaggtttaaagaagccatatttttatcatttcattaataataaaaataacaatgcgcacaacaatgataatcacaataagatgataatgaagatgctagtagtggcatatatcattcagatgtgatgaaatagcaagcactgtgtcctaacatttaagtggataattttatttaatatttacagtattccttcaggggaagctgtagtattatttcccaataagtaaataaggcttattttttgagtgaatgctcagagccccaaacctaagaagtcattgagagtagaaagtttggcttaaggacttgtgatactattcaaagtgatacttggtccagctacttgtggataggtgtaaggactcctgagaaatcccttccaaacatcaagcttccccagttcccaacatgactgcatcgctgtcctctggatagctccaggataatttacttttgtttcatttgctataataaacataatcaaagtcttccaaatttgtattgatcaatgaaaaatagatcaaaaccagaaaattattatagttttattatagacatacactatagatatttataatattattatacttgatagcaacaattttgtataaaaacaacccacacaacattgcctcatctttatgtcagtaatgctttggctgtttatgaggcaactcatgacagccgtaaattcttctaagttgcattgtttccatgtggttcatacttttttgccttataatttacaaaccattgtcattttatatcaattttctttaaaaaaatcttcttggcccccaggttattatctttctgcttctcagaatttaacatcttgtaagtgtgaatttccatgatattctaaataattgccttgtgtctctccccagttcaaactttcctactcattgttggcaggtcaatagtctttggatgctgttttgcattattcagctgatataagaagtttcaatgttgactatatagtttctaagtataggacaaacctatatatttttatctcccttgtattccgttattcattgcaatcagatattcattctcagagttcctctcacattatttccctcaattttcatcatttatataatgtaagggaagttggccacaattacaactcttgtgttaggcatgattctgagtccagtgctctgtccaacacattgtcatatatgcaaataagtgaaatggggaccaacaaaaagcgtgctgttgcatagacctttgaatcactggggcttgagctcatatagaaaatacagactaattaaaaggtggcagtctcattaaggaaatggcagaagcttgtgcagccccagaagggatgtcatattcagggtaatacaatcatgctacaaggatagagaggaggcagaaacagttcatgaaccaaccctgatcattataagacatcactcctcattttagtgtggggaactgctagaagtttttaagcaggaaagtgaacacaattagttttgcatgctaataatgtcacatatgtcaatatggaagacagatggacgtgaatgaaaaacttatgctactgaggaaatgccaaacgtaactgcgtcttttctcaaaaacttatttctctgagaaattgaaatcttgagggtatttgtctctatgttgtcatatctaaatctaagatatatctttatagcacatccatcagaccatcataactgtcaaaggtgaggatatttgctaccctgatgctggagaaacctaacttgaaaagttacaattgtggaggctgacctgtgatgcagaccagcttcaaatgtggttctgagactagacaaagggttgtgccctgccctctcagcattaaagatagcagaatactgagtacatacaactctcaacaccaacactagtgtaattgttctccaaattgaagagaataagttatgagtaaaatttggcattgcagttttcaagcagaggaaaggtgactgtggtgttctgctcacacttgtgatttgagactattaggtctggaggtaattgctgtaaaaatccagttaaacatcctgctttatacattcattcattcataaaatattttaaagtgcctttgatgttccagacactgtactcttactttggataaagaggaagataagtttgagttggtctgtcttctggcttatagtacagctcacagtctcaagttgtactgttagaaatgataggtggtgtagcctaggcgacatggcgaaactgcatctctacaaaaaaaaaaaaaaaagaaaaagaaaataacgggacatggtggtgcacatctgtagtcccagctactcaggaagttgaggtggaagggtagatttagccaggttcaaccagggcgaggctgcaatgaagcatgatcacaccactgccctgctctaacctgggcaactgagtgagaccaagtcggaaggaaggaaggaaggcaggcaggcaggcaggcaggcaggcgagcgggcgggcaagggcgagggcgaggaggaaagcttgtattcagaaggtctaatctatcccaacaaattggaaatgtttttccgatggtgtaatttttaaatgacacttagaagaaataaaatttcaccaggcaattgagggataggatttagtaagactatttaacctgaaagaaagcataaataaagattcagatttctaagataatatggtatattccagaaactggaaggaagcagatgtgaactaggtctggagaatagaaagaggtagtaggtatattcattctttatcttaaaaacagtgaagaagatccgttttttcagtgtccccaaaagtagattttcctctgttttatagttgagtgtattgtatgatttaggaaaagtacctagttccatttttaagaactcaaattgttagaacctttccctcatatctagtaaaagacacagccttcaatattccaaacaccgcatatgaaagaagttttcttcccttttgattcccttttgatataagacaacgcacgctaattatcctattacctttgaatatttccaagttattcacagcttctgtgtccctttcattttgtctatgtccctccttacaaaggacattaataataaaaacaaaactttaaatataatgtaagtgtagcagagtgcttcccagcttcattgcacacatagaaaatggtaatatttctgtggcacaagaacttagcacagttatgttccactcacggtattccagttccatagaactcatgtcaggaagacttgagtctccctgttatggacttcctgttacttacggactccctattatttacggagtcttcgtgttatggacttgttatggcttttatgtggattattgcccatcatattctagataatatattcatataattgcaatctaaaacaaaccaatttattaaccaaccatttactttattggcttaatgagttaacaaaaaactcagccctgtttttttcatgtgggttgcacccaaaacatatacagtatgcaaaaaaattgtttttttaaagtaaatttagaatttaaatctttgcactgctaaatttcaacttatttgttttagctgttttgggcctggatctatttgcccagtaggtatagtctttttgggcccagattacagtaacacgagaggttttgttggccacttggtgtgcaacatacttaccatgggggattagcaatctccaagtgcaagcttaaatgagcaaaggaaaatttcacaaagaattgaagtctcaactgcttatttctagttgtattcacaagtattatctttacaattaaggtaagaaaaaacagaagaaagaaagacagaggaagagatgaatcaagaaaagtaaggaaagaaggtagggaggaaggaaaggatagaaggaagaaaatgaagactagaagagaaaagatagaggttctcaagctcttcacttgaagcaggcaactactttgactttggtttcttaatccagtcattcccacagttagctattcatcacaattagttgatactttgttttcttgctttaaattattttgacttttgaacatttagatctttaaaatgatctaatcactagttctgttcttggattaagaagtctgtattgggaatttctctagatgagttgagaaaactttgaaaattgatgaataaatagttttgagaatatttttacatttccagaagcaagtgaaagaggaatgaaaatgaaatacaagataaatattggaagagagtgtaggtggtggtaatgatttaactaaagtaactccacatatattagaaagtcgagttaatgttcaaagttgataattctgaaaaaaagcaatatgaggaaattatatagaggtatgggggtagccttcagaagaactagaaacagaagctctttgttggagctgttctatagagataaagctgtctttggggaataggactaagagcatagggaaggtaacacaggaattttgggggtttgttataattatggtaagagttttacattcatttttgtacatactattatctccctagatgatgctgattatcagccatatctggaaatctttgagttaattaaccctctgtgttcaagtatgttcttttacatctgactgtaaagcaacgagcccacataactatagcttatccacaaacatgttatgagagcctgtgccacttgcctgtataatttgaagatgagctgtacctatgccatatccatcttaagtaacttaaacattggctttgacataaaattcctttgagttcagacaaactgaattcagaaaggaaggcatttactgattccatatgtggatgttaagttggttcagatataaggagtaaggaatatacagcataaaagctcatccttcacaggctatttagattgatagtctattacaagtttcatttattgaaacactggtctagtcacttcatgatggggtcaccattgtcataaatcagatatctggatatgtatataaatctggttttgaattctaaattttgctctactaatctatccttacaccaataagacaccatcttgtcttataatgtgccaataacatatgatagcgtgatttatacagctttgtttttcaaggttgttgtggatattttgggctatatgcatttccatgtgaaatttatggcaatccactaaaaattctacaaaatttcaatttggatcacattgaatgtatagatgaatatgggaagacttgatatcttcatagtattgagtcttctaattcacgaacatggtaaatatctcctattattaagattttcttacattttttaataatttatagttttcaatatacagacataatacaatttggtgtatttatttctaggtatttgattccaaattattgctattttaagtgacgtgatttttaaaaaatcttttatttgtatttgttgcatcttaaaaagatatattttaatataaagacatagaaatgttcaaaagcaaagaattgaaagtgatatgctatgcaagcactaaccaagtaaaaatggctttgatattctaataataggcatagaaacttaaagcatgatgcattactatatattagggaaacattccataatgatatatggttcagtccaagattacctaaaacaaagatctcagaaccctaaatttctatataacccaaagctatatagaaatatatatatacggccccaaagttttgtaaaaattatgaaatatatttagaaatagacaaatcaaatatttgtgggatactttaatatatattcctccgtcaataactctttttttttttttttttgagacggaatctcgccctgtcacccaggcacgatctcggctcactgtaagctccgcctcccaggttgacgccattctcctgcatcagcctcccgagtaactggaactacaggtgcccgccaccacgcccggctaattttttgtatttttagtagagacggggtttcactgtgttagccaggatggtctcgatctcctgacctcgtgatccacctgcctcggatttccaaagtgctgggattacaggcatgagccaccacactcggcctgtcaataactcttcaaacagaagaccaaaaataaaaccactatggatgtaaaatatgaaaaccacaataatgaattacatgtaactcacatatatagaccaaacaactctgaaagagcaaaaaacattttttcaaatgcatttgaaacattcacaaaaattgatcatatattgtaagatttataaaactacaactttcaaaaagtaaataatatgtgtttattgaccacaataaaattaaaatatttttgaagcctaattttctacaacttaataacatattttttcaaatatataacatttatatattaaaatataaaaataatacatttaaaatacattttaaatataggacaaaaataattgaaaagaaaaaatacttaaactaaattatagttacaatttaaaacattaaaacatgtaagatgcagctaaagaggtgcctttggggaaatctataccttatatgtatatgttcaaaaaagaaggatgattgggataatcatttaagctttatttaaagaatttaggaaaaaggaaagcaaaccaaaaaatctataaagaaaatgaaataataaaattgttaagaatagtttaaatataaaatatacacaaaattcataaaatcaacgtaatgtaaaattttttataaaatttattaataaaactactaacatgaataatcaagagaaaaaataaactataaatatctgatttctggaataaagaaatagaaaatattgcataccccacaaatattttaaaaagtgaaaaaaatagtatgaaaaccatttagtaattttcaaaatgggtaaaggtcttgaagtatcagtttaaaagagttgaaaagaaagacaaaatctgaataattgatagctatttaagaaatttaatctgttacttgaaatctaaacaaaaagaatgtcaaagatctacatcacttcactagtgaatacttccaaacatttaaggtaatttttatgccaactattccagatttagaaagagaatatcttctaatcttttataaattcagtttttaaaaaaattacaagaatggaaaattatgtattacctttttttgtgaatatagaaaataaatactctggcatataagtaattctgtaaaggtttcatatggtctcaaaaagtataatatctagttgttgactgatgtgagatgataagtatatataggtaggtagatattcacatttatgaatcttgctcaagtattctttatctttgctgatttgtattatatacattttaaaataaagattaattattaatttcatatttaatagggattatataaagatataagtttatcaagattacatcaagaatgaaagcatccatttaaagtgtaaaagtcatgtgtcaaactaaatgagtttgaccaatgcatatactatacactggtgaaactaacacttcattattgaaacattttcatcatcccaaaggttcccatgccccttcccaatctcctatattcttctagaatcagcctctgaccttctagcaccacagattaattgtgctgttctacaggtttatatgaatggtattgcacaatgtgtactcatgtcttgttctgtttgctcaacatgaccttttcaagagtaatccacgtcattgcatgtatctgtgattgattccttgttattgatgagtagtgttccattttatgcatataccataattcatttatctgttcattgattgaataattgggttgttttcagttggagatgctagtaataaagtttctatgtacataaatattgaggaatagaattgtttggttatcttctatgtatagaattaattttctctcaagttgccaaagagttttcaaaagtgtttggacaatgttatatcccttctcaccagctaggaatgagagctctagttgctccatgtcctggtcaaacattagtactgtaagtttttgtttgattgttagtttgtgtttttctctttattttttcttttttatattttagtcatttcagtgtatgtgtgtgtgtactggtagttattatgggtttaagtttcaattccctgataaataatgattttagtatcattttatgtgattattaactacttgtatgttttctatgatatatctgttcagatagttttcttattttttaatttattatattatcatctggtcaacattatttacaaattttagatgatagtacacagttggacaaatgtattgtctgtggcttactcttaattttttaatggtgccttttgaagagcattttttaatttggataaaatataatttatcaatattgtataggtagtttgcttgtatgagggtattctctcaagaaatcctagacactccagtaatgaagatcttcttcagtgttttttttttcctcacaagtttaataatttagtatttatgcttagttttaagatttatttcaagtttttttgattatttgtttaggtgtgagtagaacattttagattttttgatcctccttttttaaattcaggtataatatatttggaattttactttgacacatgaagtgatttttaaaatcatgtgtttactgcttgacataataagggactgcatttataattcattatcccttattttatgactgcctttcacaccctcctaggtagcgaatgaaaaaagatgaagggaagagtttaaacattatgattgttggttctgtatttgcaagtttgtaattgccccataatttctaactgatgattgttgtaagttacaacaattattactgttgttattttcagagtgctaaatattactaattagatgatattttacttgcccaagcttattagctagtaaatcatgggggcagaatatgaaaacaggcacttagactttgagtcttgcttagttaacactacgtaaacatcttttctcaagcaaagcaaaatcatctgacccaagagccacaaactctccaacggtgggacactccagctagtagctctgaaccgagtacttctggtgctgtttcattttaatagcagttgtgaaatctgaagatttctggaaaaattcaaattagctgattatcatttaaaaactccaaagatgttccagtaatgtgtctctgtgaacctcggttgatcttagctgctagttaataaaggatactgcattgaatctggggctgctctttctgagtggctgctcagccagcttccatcattttcactggcttctctaagtttaagcctgtaaatatcaccttagaaaaacagatgttttgcatttctctgatggccagtgatggtgagcattttttcatatgttttttggctgcataaatgtcttcttttgagaagtgtctgttcttgtccttcgtccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctagaagctctttagtttaattagatctcatttgtcaattttgtcttttgttgccattgcttttggtgtttt

SEQ ID NO: 1157 - DNA, 21762 bp, Homo sapiens
tcatttacttgtctctgctgtagtctccagatggtcagagttgaaggtttttggggaagtggagggggtgggagtgaggggcataggaatagttcctgacactgtgggagagtgaagttcactcccctcctacaagaaatgtgttcatagcctctgggtgcccacatcattatgattaattatgatgagctcagatgagatcgtgcctcctcccagccaactgtgttccctattccttagtatccgtcagaaaagttccatgagtctcttctcttgcctggtgtactgtagcacctctccagtgaccactaaacccgcctattcaaaacccagcttttaagatctttccgtccttcagtatcaattatatattttattggccctaattaaactttccctttgatccagtgttaaactacattgtgagccctttttttttttttcagacagggtcttgctctgtcgcctgggctggagtgccgtggtgcgaccacagctcactgcagccttggctttgtgagctcaagcagtcctcccccctcagcctcctgaagtagctgggactacaggcatgcaccaccacacctggctaactttttatttttattttggtagagacagagtgatgctatgtcgtccagactgtcttgaacttctggcctcaagccatccaccggccttggcctctcaaagtgctgggattatgggcatgagccaccacacctggcctagtcatgagattttctttgacctactgctgagcctcctttccctgaaggttgtgatgttgggaggggtgagtccatcctccctttcatcttgcctccaccatcgggacttgtttaaccttcacactgttacttcccttttctagaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggctatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaattttgcctggttttatgctgttctttactaggatgatggctcaggtgtaagactgtgcacgcacccctaggcccagcctcaggtggtccttgtttcagaaccttgagctccgagggccccggggaggtaataggccaggccagttggtctgctgtgccccagctgcactgagactctcagaggcctttccccagggtctgcatcttcttctgctgtctcataagccacatcctggggacatggaagtttcacgaggcgaggtcaccccagtaggaggcctttgaccctgtgcccccaggcctggaggtatgaggtgtaataggcagcctttttcccgtgaactaccctgcagtgtgacttgtgccctgctgtggccagtgctgggttgtggggatgggtgctggggtattcaggtggtgcactgaggaaggctgctgtgccccaacatggggtttgctgtttggctggctgtttgtgtggactctgtctcagctgctgtgccaaggtcattataggggaaagtgaagcttggctcccttgggacccctccagcctgtgtttgtgaagtacacatgtttgtgactcttgtttgctgggctttctgaaagattttcttaaaaggagtcactaagcttatttttttcttttcctttttctcagacatggtcttgctctgtcacccagactggagtgcaatggcgcgatctcgactcactgcaacctccaccttctgggtttaagcgattctcgtgtctcagcctcccaagtagctggggctataggcgcacgccaccatgcccggctaatttttgtatttttagtggagacggggtttcaccatgttggccaggctggtctcgaactcctgacctcaggtgatttgccctccttggcctcccaaagtgctgggattacaggcatgagccactgcacccagccttcttagtgtttttattgtttgtttttttgttttttgttttaaattaaggcttttaatgcgaactcaaatatcacctccctctttctggaagctcctctgtagcttagagtgttgcatgccatacctctcaagggggccgaccttaagctccataccaggactgggtttttatcatcggacttcctaggaggtttcttctgcccctccctgggtaggttttaccctctgtttattctgattctgctcctgggtgcagagattgctggaggaaccacaccacctactcacgaccccacagcttaactcatcagggtgcttaactcaccaggcccctttgagccacttgcttagtgacccttttctatgttcttctttgggagcttgattttcttatttccagaaccagctgttccaatcctttgccactttttaagtccttatcccctgagagctgcggcttctaagaatcccttcagctttattccccttgtcccaagacctactgaaatagtgccattgctccagctcaaagaggcatccttctatcttctggggacagaccctcctgccacccatgagctgcattcatccttccactcccttagggccttgcaatagtgtcttgactcaggccagactgccacttactagctggatgaccttgggcaaattattcaacctctgtgtgcctcagtgtttccatctgtaaaatgggataataatggaatctccctcatcaggactaaaaaaattaatatgtgtaaaatgcttagaataaggtctggtacattccagtccccatcatcattcccctcctccccagtatttttcttttctcccttctcctcctgtatttaaaaatctcttcatctaatccaccaaataacagaacagtcaaaccaccaaaacatctgtcctctgcttagtttcatctaaagctattatcttctctccttttactggcacatttgttgaaaggggaagagttgtctccattacttcaaatctcattaattcctcaacccattatagcactttatggcttccattctgcccccacccccatccactcactgaaattgctgtcaataaagtcacatttaatgaccttctaattgttaaatccaatgctattcttaagtcatcctctttgagctttcttgagcatttgaagatgttgtagccatatgaattttcttcattcgttacactaatccctttattctctacccaaagcaatgctaagtaacatgcagatgtcattcatagtcgttttttcagattttttttacaaagataatttcagatctagtagtaaatcacctgtgtgccacttcccatttttcctccatctcagcagtaagtactctctttaatttagtgtttatcatcccatacatgattttatacaattaatgcgtatgtatgaatccataaatgatagcatgttttgcatattattaaatttcatacaatgacaacctatcactttttgaaaagcttttaaaaaatagacccagacagtgcattgttaatccaggttgtccatccagggtgttcattgaccagacagtgtcagacatggacactggttttcagatcaactctcttcaatatgtaattaggaaacacttttgaaaatgctctgttcttgcaggaggcactttgcagactgtctgggtattttatgtttggcttttaccttcataaaagatggcttgattctgtcctttttaatgggcaatctcttacttgggtgaagattgccttgacttcttttcttctgcagtcctgcttttttcctaaagattttttttttttttctgagcatttcactgggttttcctacatgtgtcccttacttgcagggatttttttaaaggatgtttcttgattctcttcattctcaccagatgaccacattctttcccatagccctggtgagtggaagacccttgcttctatctccagtccgaagtgtgctactgtacatgtttgcctgggtgtcttccaagcccctacaacttgttttacctccaaacctgctccaccacctgcatcctcagtgtgtcccccacacagcctccccatttggaccctccgtggtctctgctgctgcctttcttcaggcctttgcttggaatacagacataggtcatctcccacgtcccctaccctcatgctcttgccagagtaactgatgaaaatgcaaaccaatcatcatcttccacttaacaacctcgtgcacacacccgtctcctgccatactgtctgcaggatcaacccagactcctgggcttggcaccagggcccttctggatctggtccttcctgcctttcctgcctgtcccctagctctgtggtaggcctcctcctctcttgcctcagtggtctcctccccacacccctgcacactgagtcttctcacagctgcatgcgctggccatgcccttccagtgccagggatgccattcttttctctccttcctcatcctctgagatccagcttatgtgcatgacttacctgacagcccaggcagagtcagctcttcaagcctctgctctcagggtgcatcaccacctaaaagaccctggcctgcactgggttgcattgcgctggttccatttgcaggtccgtctctccccggcttggccggggggagctcaaagtgagagtacagttgtctgcctttgtagctcagtgtctggcccacggcaggtgcccagtaagcactggcaagttaatgactgctggcctgtcacccagccctgcctgcttgccccctgctcaggagtccctggaggaaggtaatgcatgccatctgatcctctctcaggggggcagcagattatgttaggagaaagaagagaaaaaagggtggaagatgctgcccaaaattcacactggatagtgcagcctgtccccgggaccaaaatgccatttagaacccaaatgtaggaaatggggtctccgcctgcccccagctcccattataccaccacggggtactactccatctctaggaaaccctacacttaaacacagttttctttctcttcccactcctcttccttctcccttccctgctccacataataactgccttcctcaccaagtgctctgggcatatagttactcccatccccagcccctggagctgggcaagggccaggattactattcctattcacagatggagaactaagtccagagaagggtacagtgggctggggccatagttcggaccagggagtcagtcctacctccatgtggcggcagcctgaagcctgcttcgcgagggagcacccaaccccgtttagagaaggccttgcaaatgatggaaaggcggggaagggtggtgtgacccagactgtcagtgaggaagcagtcctcagggtcaagatggggagcaaggagaatccagggcaggttaggagtgcgggcctgaaccctgtgaccagcatctacccaggaactcctcaagggcagcctctgctctctcccttgatgggaaaagacaggactgcagacatgcctgcaaaccatgggagtatctgtccatttcccttccatcaggtcatgaaggagtgagggcaggtgctgggagaggtgcgaggacttgagggaggagttggtaggagaagggtccagggaagaggagattgaggaaatggcccgtggagctgccctgagcccaggtgggcgcattcaggggcagagatggtaccagaggaaaggtgcctggtgttgagctggcggtaagtgttggcgccccaggtggggatccacccgaaggagctgctcagtccccatcctccaggagtgtgcaggcctttcctaaaagacctgactcaggctgaggtggccccgcccagggttggactcccttccctgtggtgacagagggcgtggagaagcagggaccccctaggcgtggctccagggagtaaaagggagcagtaggagttgagggggcaagaggggcccatggggagccgagagacagaagagcaaccctggggggggcccaggtggcaccccagtaccttggtaggtttctgagtgcagcaggtagattttcagaacagggaagtgggctggagatacacggtggaggcggggtctggtactcacccgctcatccttcccgggcccacctccctctgcctgatactttttctctcgctccctccccagcatccacatggacccttgatgccaccctcctggtctgtgtgtgacacttctgggctttcacttctattcctgacgactttagtagctggggtgcgtcctgtccatgatatgagagggctgggctaagtggattgagggaactggggagggatgttaggtccccagcatcaaactctgtacccgagggcctggagccctggtggcctgcctgaggcctcacccaagaaagcagttctgcctttcaggacatgccggggcttcccagaagttctgggaaggacagtgccccctgggatggggctgtgggatggcttccccactctctcccaagtttcccttcaccttggggcgctcactttgacgcctactgacagtcccaggttagaattaaagacagatatttggtcttgcaaataaatatatttaaaagggaagtttattaatattggaagggacaaactggagagcacagaacatgcagctgtccaatttctaaggtgactctgctgtgacagtgattggcgtctgtcccctgcagctgcgcaggcccctgtctgagctggtgtgccaacggcaccttgcctgtctcctccacccggcatcctgctctcccctgcattctgggaatgccatcctggacacactgagaggcctaggtgggtttctctccctgccacccacctgagtcctgccagtgctttggcctggcccctggtctgccgccatcccttgtccagttggttgaggcaccgtgtgctggccttgtccctccaggccagagcgcggcagcccttacccccacagcgctgcagccctgcagctggccctcagccctgggaggagccttccttttccagagagacctcgccctgcactttcagcttccctatggcctccgccttcctagaggcctcccggtagcgccactgcctggagggttggtaggagctctcgtcgctcactgggccctgccggccccgcgtgaggcccagcaaggcccggctctggtggaggaagttggggctagagaagcagtagagcacggggtccaggacactgttgaggtaggtgaaggccagggagccatggaagagctgtgtgcagaggtccagggatcggcaggcggacagccagaaagccaccatggaagccatgccaaagatgatgctgggcaagaagcagatggtgtagacggccaccaccatggccagcacacgcatggccctctgcgggcctgcctgcccgcccagaccacggttccggatggtgagcccaatgctcacaatagcaaagaggatgagcgccagtggcaggaagaactccagcaggtacagtgcctggtgccagcggagcgaggccgagggcttcgtgcccaccctgtagctgaggcaggaggggccggagaaggtgctcaggagcaggtgcccgttgaggagcaggatgcccacccagagtcccccggccacccgggcagctgcccccacggaagcacggctcagcacgtggtggggctgcaccaccttcaggtagcggttgagtgcgatggctgtgaggaagacaacgctggccgtgcggttggtggacagcatgaagaggttgactttgcaggcagcagccccaaagcgccaggtctcatggaggaggtagtagtccacgcggaggggcaggttgctgatcaggaggaagtcagcggccaccaggctgaccaggaacaccgtgttggaggtccagggccgcgtgtggatgcagaagatgaagagggccaaactgttccccaccaggcccaggacaaactccagggccaggattggtgccaggaaggcagacaccagcgaggaagaggtggggtggcagggccctccagaggacccccccacagtggtaaaggcagagggagcagaggagggtgagggagagaaggagggagggagaacagaggaggagagagagggagatggagagctcaggttatgaagttccatgggctgcttgggccatgggcctgagagaaggttctggagtcttctacccctgcaggagtgctcagggcaaagtgggatgattggcactatcagctggccaccacggtgacacaacatcctggggttttcatcagcattctcgcagccactgagaaacaccctgtgttcctgtttgcaggccaaggggaaccctgcagccctccctccttccctccgcctcggggtactgagtgatcccaccacatgaggtctctgagcccagcctgggggttgtgctgctggtagaggaggaagcagggctcagcaggggcaagatggaagcccagagaaaccctgaagtgggaggatagtccagccgggtgaggtgggggctctcaggatcatgcagccctccctggacaccccctcctccactacatatagaggctggtggctgcctccctgcccccaccagctctggcttcagggactgtggagccaaaaggacattgtcctgagaggtaggcagggagtcagtgaagacctccaccgccctgctggtggcctggagggaaccagtcctatttgtgctccgccagcctgctgtgtgtctgaaagcccactgtagttcagctttcagttgctcccaggttcctgatggttccgaagtctgtgatggtcccaagtccgggtacacggtgaagtaggccccatggacggggacgcccctgccaaatttctactgccatggcacggggagctgggggcttctcccgcaaatagaacaatcctgatttttccctgtctgtgtctccccatggctccttgtccactccactccttgcccccattagcattcactgcggaatagggagtgggaggctggggctagctccagacaaggtacaagtccagctgtcccatggtgaggtattctcatgagcccatgggctggtcctgtgggtggagatgagggcttcaggctcctgataacccgggacagcagggccaagggaggtgctggttccaggctccagggcctgaccccatcactgccaactggctggggtcagcagtctgccatgtgtggcctggcctctgtgtcccaggcacagtggcccctggcctctcttggctgccctgggctcccatttggtcaaggctgagggcaaacatccctgggagaagcagggtggtgaggcccagcctaagctccatatgcagacaggcctgggttggaaacagagctgccctatttccaaacctctctgagcctgatctgtaaaatcaggcactaccaccttcttggagagttgtgaggataaaatgagataatttatgtaaaaacttataggccaggcacagtggcttaagcctgtaatcccagcactttgggaggccgaggcgggcagatcacgaggtcaggagatcgagaccatcctggctaacacggtgaaaccccgtctctactaaaaatacaaaaaaagtagccgggcgtggtggcaggtgcctgtagtcccagctactcgggaggctgaggcaggagaatggcgtgaacctgggaggcggagcttgcagtgagctgagatcgcgccactgcactccagcctgggcaacagagtgagactccgtctcaaaaaaaaaaaaaaaaaaaaaaacaaacttctaggggattccttgggacagagcgagtgttcacaaaaacagatctaattttcatgactttctctctggattaagcttgccctgcatatgagagtaaactcttctcttcacggccatcggtattctgacctgggtcctccctggaacattctatgtcttcttctcaggtcctgcacggagcagtgcattgctacaggccaggaacgagccgcgtggagcctctgcctgtgcctatcctggaccatttgtgtttgaaggagcctgatggtgttttttctttgcttgcaggagaggaaagcccttaggggtgacgaggaggttgaaggtcccgatgtctcttagggccagtagccttttcagcaaaggcaggtctttctctgctcccagtggagtgtaggaaggcagtgagccactgggctggggatgagggagacaggggtcaagtgttcttttctagaggaagctttgagtccacgcagggacctgttctgtccagatctgtcactctcatgtgcatgccctcattgacttctcacggaagtcccaggaaactgagctgcgcccgctgcaggttccacattcttgtctcttcccactggtgcctctgaggcctccagcatccctagacacccatagcaggctcaggggtccctctggagtctttgaacagggcacctgtgcatgacaggggagggaaggggacacaaggccagacacccccaccaacactgctgagctcctggtacaacttcatgcccctctccaggctgatcatagtctttaggtattaacagtggttagctctgggtgggggattttgtgtatttctgggttttctatagttagcacagatgacttctgttattggaaaaaaactcaacagatgctagtgttttaaagttatgtaaaaagacagactgggcaacatggtgaaatccccatctctacaaaaaagaaaaaaaaaattaacagggtgtggtggtgcatgcctgtagtcccagctactcagaaggctgaggtgggagaatcacttgagccaggagggtcaaggctgcagtgagctctgatcacaccactgcactccagccttggtgacagtgagatcctgtttcaaaaaaaaaaaaaaagtaaaaagaataaatgagaacagagaaggaagtggagagatgacattagccgtgctcccaggaccaggcatggagcatgcgtggatcaagtcacacacacagtgaagaatgcccatccacaaacagggatgcccaataacagaccctccaacacgtccatggtcacctggtgccctgatgccccagacacaccacatggtcctggggggcacatgggaaggccagtgatgactgcctgcggcagacccccaggtgtgcgttcctcaggaagcctttattgagggccttcttggtgtggaagtgctgcactgagtctgcagggacagaggaatgggcaggagcggggccgggggtagaccacctggcaagactggcaaggcagtgggctgagtctgccagagaagatggggagctgctgcccgcccaggggcatggcatctgggctgagaagggcaggagggtgggtgacaacaatgtgcaggtctgtgggggacacagcggcagtacacagagaggtagtgggggctgggagagttgtttggcagggatggcactcgagggtgcttggcacacctgtggctgcttcaggccatggcaagagggtcaccccaggggcttcttgcaggcagggtcctgggtcacagacagggccacagagccttgtgttcgctcccaggcatacctgtggacacacagatgagcagggatcacacagagttggaccctgaggatcccagggaaagccctccctgcgtactcacgaggtcccagctagcaccaggaggctgtcatcaggggccaggctcaggcgccgtccccccattgtcaccaccgaggagccctcctggagaagaggagcaggagaatcaaatggagactgttgggcctcatcacctgggtgaatgtctgagtctgcctgggccccaaggccccaagagtgggccccgtgtgggagcccagggccgaggagcgggctgatgccctctggcagggggttctgcaaccctgtccctgggccccacttgccagctgccacagccacacgtccacattctgtctcaggccttcgctgctgccttgcccataggcgatcacctggtgggaggtgaaacagaaacttctggtgcttcttgccccacatgggagatggtcttgaacctggcccccagacaccaggcctgcttggagcagggttggggcccatgaaacagccccatcaccatgtgctgagcagagaccaggacttggagaggagggctgcctgggctgcaggcctccctgtgcccgccgctgcaacaggtatttgggatcacacatgcctgcctttcacgtgcagtgcacccgtggtccctctgatgtgtgctcatgcgaaggcatgctcaccagggcacatgagggacgcatttccatcagcttcccagagggtgccacctccctttctctgagagaggttatgagtctggcctcaggaggaggaggggacaaggaaggtgaggctgagggctctctgacatgcaccagcctggaagcacacagctactgtgcagggccgtgctgctgatgccctggagagggtgcatattcattaatgtaaactgaagcaggtaagagcagggtattgcagaggtggggtgcagggctgagtggtactgctgtgacatgtgcgcatgttctcgcagccctgtgtaagctcaggacgtccctggtacccaagagcagcaggccaggcctctacgggaagcctgtggccatgagcatccctgcacagattgactcattcaaagcccatgggatgtgccagtggcaagccgtaaagcacaagtgaacacaggtctccctgcaccactcttgccctcccagccttgttcccacacgtggtacagaaacaccactctggcctgtcactcccctgcttcaatactttggtggagggctgttgtctttaggacaagtcctcccaccttgcctagcccagcagacctaccaggacctgggccctgcctgctgctccacagtccaccagtcacacttgtacccccacccccaagccccgcctctggccaacttcggctgctcccagtgccaggctgtttcaagcctgaaacagctcatgctcatgcttctccctcacctagaatgctctctccacctccctttctttcttttacaaactcctacactagctttaaaatgcaatgtgcatgtcacctcctccaggaagccttccttgacttccctttcagagtgggttcctcctttatccttctatagcttcctatagcttttctatctgatactttatcacatgattgtggcaattgttgattaacttgtccatctctttaacaaactatacattctttaaggtagcaactctatcctactctcccactaaagcctgaaacataacaggcatttaataaatgtggaatgaaagaaagtcagccttgtttgaatccctctctccacccaaccctcactcccaaacaactctctcccttttggcttccaagggtgtgactggctgaaggttcaggaattcctagcgaggggaaaactgcagaccctcaggaagctgccagtgagtgggggaacctccaactctgaaagtgaattcagatcataaaattgcttgggaccatgtagcctccacagacttcactcggagcagagccatcgccttctgcgtcagggagggagcacaaaggcctatgctcatgtctacaacctctgaaatgtgtgtgtgtgtgtgtgtgtgtgtgtgtgtgtgtgagtgtgtgtgtgaaagagagagagagagaggcagtgagagagagactggttcccattttccagggctgctgtgggaggatgccccggatgccccaggactacattacctgggtctcataggtgtccccaaacaggctgagtggtgtgcctgcctgcagctccctgtggtggctgtccagccaggcatccagggacatgggctccatgatggatcgtgtgctcagagggaatggtggctccttgagcagctggtctgcacccacagcatgactatagtcggtgtcctcaggacccagcccacccagccccagtgggcccagttcccaggggccccaggtctcaattgccagaacaggctctgtatccagctcaatgatcaagcagccatgtgggaggtaccattggctgccatcttcttagtaccttgaggactgggcagagtattcaaaaagagactccccggtcccctggaccaaaacccatcctattttggaaggggagggagggaaggagaagggcagttcccagcggcctcaccagggatgggctttcctgttctgtactgctcagagctgaagaacctgcaaggacgaacagggaggagcaggagtggcgagcactcccatcggagtggccagcgacacacacatacaccacactcacggtcaggtgcaggtgcccacacacactcatggggctctcacacagctgtgtgtctgccatcctttccctcccagcggggctgctgctcccccctccccccggcctggcagtgggctctctgggccaggatctccaccctgggaggggagactttctcccagggcatcaggtgctgatgcagagccccaggaaagcaagaggcaggggctgggctgggggctcactcctggatgatgggggccaactgcgtgccgaggtccttgcagtagaaccacttctcaaacagaacgtccatggtgtcgcccacatagtacctgccagagcagaggacaggcaaccctgctgtccccatctgggtggcttcagggcagccccactcaggcctggctctgcttgtagaagtccctgcagagccctgctgtctgctcacccctgttacacaccctagtggtcactggtcacttaacaccttgctcttcagaagcacacgtgcgccccctgagagggctactatcccgagaattcacacggctctctccggttcccaaaactagacccaaactggttcccaaaactagacaaagcagatagaactctgagactcacagaagctgagcaatttgccaaggattacacagcctgtaagtggcggaagcaggccagtctcaagacaatcttaaaaacttagagagcatctaatcgcagttcttttgtttttcgcaaagaggaagctgaggctgagcctgaaaccagggccagtggctggacgctctgctggcctgcagtgctctaggcctgagtgcacggacacttaagaaaccaacatggccgggcgcagtggctcacgcctgtaatcccagcactttgggaggctgagacgggtagattacttgaggtcaggagttcaagaccagcctggccaacatggtgaaaccctgtctctactaaaaataataataataataaataaatacaaaaaatagccaggcataacaaaagatagaaaaaaaatagccaggcatgctggcaggggactgtaatcccagctacttgggaggccgaggcaggagaattgcttgaaccgggaagcggaggttgcagtgagccaagattgcaccgccgcattccagcctgggtgacagaacaagactctgtctcaaaagtaaataaataagtaaaaaaaaaaaaaaaaagaagccaacacgcagaagatgtcccccagtttaggggttcttcttctttcagggtcatgattgcctttgagagttggagcaaagttttggacctcttttctggggtaaggcccatgtacatgtacatatagccttcagtagacccctaaagcccaccccagcccccagcctggctcagtgagctcctcccccggcctgaggagcacctggcaggctgggatgggccccaggcccctgtgggtgctgcacatggtgggtgccaggaacgcctgttaactgaatgcctaatgcccaagcccagctcctgggcccaggccagctctgtctgctcttaaaagagatgtggtcccgctggtgggagatgctttacagacacacagtgcatccacccacttggcagcctaaatcctatcctgggatggagctggccaccagaaagcttcataactggatggcagtgccctccgggaactgcctttggagtggcattttaatgttgagtccctggcttttattaaaggtcaaaagcagccagatgaaatgtgttattgaatttgctgtaaaatgatattgaggacaccatcctctccatcagactcactatattaaagtcccttgtgacaaattttttctagaagataagaccacgtgtctgtctctacaacagactgttacacagtaaatgattatgcagccattgtgttttttgaaaagatttaatagtgtaagaaatactcggccgaatgtggtggctcacaactgtaatcccagcactttgggaggccgaggtgggtggatcacctgaggttggcagttcgagaccagcctggccaacatggtgaaacctcgtctctactaaaaatacaaaaattagccagacatggtggtgcatgtctgtaatcccagctactcaggaggctgaggcaggaggattgcttgaacccgggaggcagaggttgcagtgagccgagattgtaccactgcactccagcctgggtgacagagcaagactccatctcaaaaaaaaaaaaaaagaatactcatgagtttcttttaagtaaaaaaagatataggtaagcatagaaataagacaagatggaagtttaggtttcattaggtttcattggtgacaggacaattttttttgttttcccttttttattattttgttttcttgagatataattcacataccatcaaatttatccttttagtaacaagtaattttaattttgttcactttgcattcctgtacttttccagattttgagaatgaatgtgtatgactttgataatcagaaaaacaacacgtattttaaaaatgcctattataacaaaagatgtaggccaaagtatcctgttcctggtgacctgatgggaaacttgaattttttttagttaaaaaatacaacaaataatgatcacgccactgcattccagcgtgggtgatagatagagtgagcccccatatcaaaaaaaaaaaaaaaaaaaaacccaaccaaacactgttgagcttttggaaaatctatttccctgagcaataggttgcttcctcctttcagaggaaaagaattgggtgactgatcagaaccaaatgagaaccccggccatggaatcagaatgctgacagcggggcctattttcttcccctctttggtgttgactcccactcctctctatactgtcctggccctaactccatatttctctataatgccagatctagcaagtaacactttagcaactttaacttctttgtaatgataacagcacctcccccataggatcgctgggaagattcaatgaataaatacatgcaaagaccttagccaggcatctggcacatagcaagtgccatccagatgtcagtgtgtgttgtggaatgagctggggtagagaaacaagccgagggaggcactggccgtgattctaaattctggggggaagcagcagttctggctgcactgggggaggtgggtgtgactttggaacccctctggcccgctttccacatctcacccctcccagaagaccttgtgaaaggaaaatatcttgggccccgaaatcactaaattaagggaaatgtcaagctgagaactgcttagggcaaacctaccccctatttttttttttttttttttttgagacggagtctcactctgtcacccaggctggagcgcactggcgcgatcttggctcactgcaagctctgtctcctgggttcatgccattctcctgccccagcctcccaagtagctgggaatacaggcgcccgccaccacgcccgactaattttttgtatttttagtagaaatggggtttcaccatgttagccaggatggtctctctcgatctcctgacctcgtgatccacccgcctcggcctcccgaagtgctgggattacaagcgtgtgccactgcgcccggctacctgccccccattgtattcaaagtgcccctctgctcactgagataaatgcatatctgattgcctcctctggagagactaatcggaaactcaaaagaatgcaaccatttgtctcttttctacctatgacctagaagccccctccctgctttgagtcatcctgcttttgctttgagttgtcctgcctttccagactgaaccaatgttcatcttacatatgttaattgatgtctcttgtccccctaaaatgtataaaaccaagctgtgctctgactctcttgggcacacgtcaacaggacctcctgaggctgtgtcacgagcgtgcatcctcaaccttggcaaaataaacttgctaaattaactgagacctgtc

SEQ ID NO: 1158 - DNA, 33671 bp, Homo sapiens
ggctcactgcaacatctgcctcccagtctcaggtgatcctcctacctcagcctcccaagtaactggaactataggtgtgtgccatcacacccggctaattttttgtattttgtgtagagatggggtttcaccatgttcccccaatggatcctgaactcctggactcaagcttttttttttttttttggtgagagagggtctcacttggtcacccagcctggagtgcagtggtgcaatcttggctcactgcaacctccacctcctaggctcaagtgatcctcccacctcagccttccaagtagctataagtgcgtggcatcatgcccggctaattttttgtatttttggtagagatgaggtttcaccatgttgcctaggctggtctcgaactcctaagctcaggtgatccaccgacctcagcctcccaaagtgttgggattacaggcatgagccactcggtccagcccccaaatgtttttaagcatggaaaagactcttcgaaaatagcatatccgaagctgggtgcagtgactcacgcctgtgattccagcacttcgggaggccaaggcggttggatcacttgagttcaggagctcgagaccagcttagccaacatggtgaaaccctgtgtctaccaaaaatacaaaaattagccaggcttggtggcgcatgcctgtaattccagctgcttgagaggctgagacaggagaattgcttgaacctgggaggcggaggttgcagtgtgttccattgtactccagcctgggtgacagggcgagactccatctcaaacaaacaaacaaaaaaaaagcaaatggttgttaaagaatgtatggttggctgggtgcggtggctcacacctgtaatcccagcattttgggaggccaaggcggatggatcaactgaggtcaggagttcaagaccagcctgcccaacacggtgaaacctcatctctactaaaaatacaaaaaattggtcaggcgtggtggctcatgcctgtaatcccagcactttgggaggccgaggcgggcggatcactaggtcaggagatcaagaccatcctggctaacacggtgaaaccccggctctactaaaaaataaaaaaaaaaaaaaaaaaaacgttagccaggcgcgatggcgggcacctgtagtcccagctactcgggaggctgaagcaggagaatggcatgaaccccggaggcggagcttgcagtgagctgagattgtgccactgcactccagcctgggcgacagagcaagactctgtctcaaaaaaaaaaaaaaaaaatagccaggcatggtggcgggcgcctgtaatcccagctactcaggaggctgagtcaggagaattgcttgaaccggggaggcagaggctgcagtgagccgagatcacatcactgcactccagcctgagtgacaagagtgaaactccgtctcaaaacaaacaaacaaacaagaatgtatggtaaatcacactaagactgacaaaaaggaacttaagagcaaagagaattaattcaacaaggtccatctaaggctggactatcttctggggggaggagaggctgtgactttatctccccacagactagcctccctactgtctcacaatacttagttacaataggaaacctctgcacagcatagcatctcccacagtgcctgccagctaaggatgtcttcaccttccaaatgtaacactaattgaaagaaaaattcctctactcaagttgagaggcttaataattagacacagaatggagggtttcacctcctacctgtaacatcttacatctaaggtctgtaatcctcctatgtaacatgtaatgaacattccaggttggtgtaactgttgtagattttacccttctttttcctcttttttttttttttttttttttttgagacagtcacgctctgttgcccaggttggagtacagtggtgatcttggctcactgcaatctctgcctccctgtctcaagcgatcctcccacctccacctccccattagctatgactgcaggcatgcacaaccatacctggataatttttatatcttttgtagagacagggtcgcactatgttgcccaggctggtcttgaactcctgggttcaagcaatcttctcacctgggcttctcaaagtgctgggattacaggcatgtgtcactgagcctggccgattttaccctgttctatgaatcactttaaatctgtcaacttaaagatggtttgcatcaacgtgagatgaaaaagagagatgatctgtgtcaaggtgttgtaaagtggctgagagagggccagacagattcaagaagttgtgtgcgttcagaggcaagttatggccattccacatgggaaaaagaagacacatacctgtgactttctcatatcatttcaatctggaatgatcctggaacttgcaactcctcaaacaccttcagaactcattgagacttataaatgtgggatctatagctttgcctaatgtgggaaaccactgtagacaggggctcttaactaaccatagggcacaaagttgaccaacacaggtgtggtgaggcatttagcctagtcatcacaacagatcttcgagcctgacattctgttatttggcttccaaatacatggtacttttcttttggtagacaactgactgtaagcatagctaaaggagcaccaaatcatcagtctgattgtgtgtgaggcagaggtctctgcttggtttggagaaagggcaaagacctgcctttggtcttcacagtaaacactgcacaatatatttaaaaatctttacagaaatattagtgttgcccaaaattcagtgacaacaggtgaccaagatgatgtaaagtgtaaaaaccactatttataacacaaaaaatgataacatagaacctgacaaattactaaagtgagcagtggagtaatgtggaggacagaccaggacctgcagtcagataatctctgatttctctctgcatcacttgctgcctgtgaggctccagacacctaaagctatctcagcctttgttttcttttcttttttctttttctttcttttttttttttttgagatgtagtctcgctctgttgcccaggctggagtgcagtggtgcaatctcgactcactgcaagctctgcctcccgggttcacgccatcctcctgcctcagcctcccgaatagctgggaccacaggtgtctgccaccacacccggctaattttttgtattttttagtagagccggggtttcaccgtgttagccaggatggtctcaatctcctgacctcgtgatctgcctgccttggcctcccaaagtgctgggattacaggcatgagccaccgtgcccagcctcagcctctgttttctaaagtgtaagatactggtaatattgccccatgaactttaaagggtagtggttaaggtatgagggaacataaagtatttggtaaagtataaggcggtaggaaataaattactaaaattattatccttgcaacctagctgacgtgaaaaggggttgtctccataaaggatgcgggccttcaggggcagcattattctgcaggtctcctgcttcctgatggcacaaggactccacatcacccagtcctaccttaaatccaatcggacaccagtccacaaactggttggtgtgcttgctcttgatggtggcgacagccgcactgacatctttcaggaccacatcccctctgtacaacatgcagcaggccatgtacttgccatggtgagggtcacacttgaccatctgattggctggctcgaagcgggcactggcgatcttggccacggacagctgctcatggtaggccttcttggctgagatgaccagggcgtaggtggccagggggaggtggatgtgggggtatggcaccaagttggtttggaattctgtcaagtacacattcagggccccatcgaatcacagggaggccgtgatggaggacacgatctgcccagacgactgaggttggtgtacatgggacactcgatgtccaggttgtgctgacatgtcataggtggctttgctgtcgactatgaaggcacagtcagaatgttccagggtcgtgtaggtggtcaggatggagttgtagggctccgtcatggccatggagacctggggggctgggcaaatggcaaactccagcttggacttcttcccgtagtccaccgagagccgcttcatgagcagagacacgaacccagagccagtgccgcccccaaagctgtggaagatgaggaagccctgcagtcccatgcacagatctgcctgagagaaaccagacaacgtaagccaatgcccgtgggagccacaccaccaacctccaccaagccggggccacttctctttgcctctgagagttgatacggattcagaccatccataatgaacacgcatcacactttgaagcagagaaaagcagacaatacagatctatgcacaaatcaccacgcacacttcacagtaagacgttgcagaggtctaggaaggctggtttgaagaaatacacagaagaaaaacggatggactaaccagagcgctcagccagcctgctggactggcacccgtggctacagacactcttgtttagcaccatggagagctccctgcacagaagcaaggactcagggcattgccccctctctacctgagaactagactcagcgcccagcactggatttgataatacaggtactcaaatacatgtgctttcctctttactcagacacttctagggctggcagggtcagacagtaatcccccactttgtggggaggccctgtttttgctgaacagctcaagggcaggaagattctttcttccacacacccctgcaactgccaatacttgttctgtgtgacccttgcagccatcctatgcggtaggtgctaccattgccatggatcaagtggggacgcacagatccaagctccttcacctctcaagggagttgggccctcccacagatctcttggaggaaaaaaatggccttgctgggcctgtcgatttccagtccccacccacctccctcatgtacatgtgtctgtttgtgaaaccttcatagcaccttagcttccaggccctccatcccggctgcctctctggcacttgcccttttactgtgcgggtccaaagagacacctatgttcagtttgtcaaagtctgaaataagcctgtcttttaatttcactgactcccagtagtaatttttttagaagacaaactgcttctctggcagttacactccagggccaattctcaaaggccaagtctggtgccaccccactccctctaagctgcttgagccagatgagagcttctgaaatgctgcagaaaagagctctcctggggcatccattaaaatgcagattcactggcattcccctaagagtttggttcagcaggtccagggtcaacatctgcatgcctcacccagggtcacaggtgattgttactattattggaccatttgaggagaggcaggtagaagtgcaaattcctggcaaagcaaacactcaggggcatgagagtgatgagaccaaggaatcccaaccatgtcttctacctcacctggaacaaaatctataccctttttgccacggcctacagccctgcagccctctgccctctccaccccacagcctggccacgcttccctggctccctagcctaggcacactgctgtctgccagtctgggaaacaggcccgcatgctcactgttcctctgcttgaaatgctctccctctgatcttgccatggctgactccttcccaccctgcacatttcagcttaaatgtcacctcacagaggcctccccagccacctctttaaagcagggggtccccattcttctctagaagcataaactatttgtttcttttgcagtgccaataattactcagaatgatattgttaacattgtcccttgaggtcaggaacttggttttgttcaaggtggatccctggtggctaagtcagtgcccagcacatacagcagcgcgcaatgagatatttgtggaaggaatgaagagttccgtgtggctggagtggaagaggagtggggcaaggtggggtgtggggagcaggaaccagagcacatgctccctggcgatgtgcagcgcggtcctgccaacccccacccatccctgccccaggaagctgagctttcatggccatggtgccctgcgcaggcattacctgcttggtcattcagctggttgtagctcaggtccagggacttcaggtctgtgtgggccagcaggagttcggcaaggtgctgggccgcctgctcctccaggccattccctgacagctgcatcttccgcatggcctggttcactgtgagggcggcacagagggcctgggctcctgccactcccagctggttctccaacaggtccacatctgggggacggagccactcctcagccagtgggatgcaaagccaggtaccacccccctcccccctcttctgccatcccccaaacctccaggtctgaggcagaggaaaaggacttacaggttaactgtcctggggttgcatggtggctctggctcccaatggctgggtcccctctgcccctgacctccccctccctgtgtgcccaccagcttctgtgtcaagcggttaaaactgcctacctcctggtactgtagagactgctgtggtggggggcagccaccccatcaatgattatgtctggcagtgatatcaccacccacttcagaagccctcactgccccattgccaggattggcaataatagcccaggtgactgtgcatggagcacttacatgggtcacacactctgctgatcacttcaggagtgcatttcacttcatgctcaccacagccccaagcctatgaggtcttgtgggggccatttcacagattggaaactgagctgctttcataggtcaccccgttttctcagtggcagagacagcatttggattcagcttcaatgaactcccaccttgcccacccctttcttgaacttccccgcccccaactctctgtgttgcaggactttccactctgcattcaggcactggggagtctcccatgtgcagggcagggcaggagaatgggtgccagccaacaaggaaggagagtggtggggtagggtggatgaggaagggacttgtatccagcatcagctgcacagcagagggtctaactccaccccacataccccctcctgtgatgaggcccctcctctatccaccagcaacaccagcaggacccaggtgacatggcccagctttcaggggtggaggcacatccctgaggaaagggaggactcacgcctgcccacctgccccagacccagcacctaccgcagatgctgctgcttttgctcagggcacctgccagggcctctgtacctgccccatagagcccactgtcccaaaagttcagccacttgacatatggattggagctcaatgaggaagccagagaccggcgccctgggacagacagagcaaacacactggccactatcctggctcatgctccagggctcagcccgctccacgtcccccacctggaaagtacccccctttccacctgcttaagggacacatgcttctccttttaggccccacctaggtgtcccccacccccacctctcccagagcccccagcgggttagaagcctgaaggctccccaacccttcatgccatctgtcatagcatcaatcccatctgtctctcagatgtcgagggtagggcatgcctggcacaggcagaagctggggagtacaggggacagactcaggggcactcccatggctgttgtctcccggggcctctccctgtaagcctggacccagtgtccttccagtggtacctggggccccaggccaccgtgcagcaggttcagctctggggcactcccttggcacagaaagcagaagatgggcacaatgctatggatccagcaagacctcaggtacagggtgtccccgaccagttctccaagtccatgggtgcctggtaggagacagggggatgaatgtgaacccctgcatggctatagccacctgcctcctcccctgccctgcatcactacctggcctattttttgcctctagaagcactgcttcctatgctccttaggaccactgcccgcatatgacagataagaacatcgaggctaaggcaacgcaaatcttttccttaaagtcatacagctgtcaaaagaaagctggacaacctgggcaacatagcgagataaaaaattatttaaattagccagatgtggtagccccctgtagtctcagcgactcaggaggctgaggcaggaggctcaccagagtgcagagttcaaggatgcagtgagctatgatcctgccactgcactgaaagctgggtgacagagcaagaccctggctctaataaatgaatacataaagtctcacagctagtggtagctaatcctgccagagtcaggcctctacctgtctgatgacaaatggcacactatgtcttttaacctgattgcagaccacaaatgttttgtgaatattttccccagggaaaaaaccggaagtagttctaaattctatacatccattatattagttttacctgtggattgggaaaacccagctctgattgcatttcagggcgggacagcctttggtgcactgtctggcgggattttccattttaacctccttctagaagcgccttctcatggtaaagttcctgatgccgccaggagcgccgaggagagggcagggggctggagacgccccgcagagggctacgtgccctgctggacagaggtctcctgcctcctcggcggcgccagcccacctcccacaacccctgcgggagaagcccccaaggggaggagacgggcctggcccctgccccgagcaccttccgtctctaggtcggagtctgaatcggccttgggaccctgcttggcttcggggacccctgcaagacgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgctgtaggttgccgtagaaaccgtggctctcctgcgctgaggctcctcgcctgagaggataaactgcacgcgccacgggctatgcactgggctgggcgccttgtgggcatcctccctgccttcctagggggttccagcatcgcccccctttcgtggactgggaaacacgcctgactccaggacttgtgttgtcctcactgcactggggaaggtggcgggggcagcttttcaggagggcctggggaacttcgcagagccaggtcaccctctcactctgtgcctcttagttatcttgcatgctctggtctttgcatacgctgctccctgcaccaggaacctccatccccatctttgtctgcttgtcgaacttcagaaatctgcaagggtcagcttagaggtcacttcttccggaagctttcctcaacaccctccccgccctgctgctgctgccctcaggccctcctctcacagcactgataacagctgtccgtctccaccctcccaccacctccactcccaccccaggaagtgaggccagagggcagggacagagctgctgctgttctctgtgtgccagggcccagcaaagggaatgtagggagggtgggaggtgcagggcagctgggattaggggttgagggctgggtgttggaggctggatctggatcctgctttagtggaagtgtccctttaacagcaactggcctggcctggctcgggccctgctttgcctcctgttcagctgcggctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtaagagagaagagcttttggccaggctggaggggcaagggaagaggtggggggtggggcttggtcctgctgggttgaagttgagggttgggctgtttaggggctggagtggaagggggcagattgggacggggttggggagagctaggcgatacaagacaggagagcaagaacaagctgtgtgtttgtcctgtgtgtccacttgcctccttcccaggcccccacccaggccccacccagggggcacatgacatagtccttaacatctgtgagagctggagcactaggcccccagagagaccaccagctgtatctcgggtcaggagagtctgtaagggggaagctggatctagtcaggctgggggtgggtgctggctagtgaaggtgattgtctgagggcattggctctctgatgcatggctggagcttctgtctcattcagggggtctggagtgggaagtggggccagagaggaggtggggccttcgatgttgggccgggagcctgtagggtgtggggggagaactgagcatgtagggctcagctccgcccctgtcactacacgctggggacacaccacactgcccgacttctcctccccaggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgggggccctgatgttgctgacgggggcgcaagtcctttccccactgacagcctgaacacccgccatgcagccagtgtgtgcgagagagaagcatgtgatgccagagacggctgcgggttctcaggaagggcttcacagaggagtggcacctggacaggactttcagggatgtgtaggaggttttggggtggaaaaaggggccactcaagaagccaggccagggttggacgtgctggctcacgcctgtaatcccagcactttgggaggccaaggcaggtggatcacgagattgagagtatcctggctaacacggtgaaaccccatctctattaaaaatacaaaaaattagccgggcatggtggtgggcgcctgtagtcgcagctactcgggaggctggggcaggagaatggcatgaacccgggaggtggagcttgcagtgagccgagattgcaccactgcactccagcctgggtggcaaagcgagactctgtctcaaaaaaaaaaaaaaaaaagccaggccagagaaactgcatttccaaagactgccaacagaaaagaagggagtgtccaggactaatggcttgagcttgagagtggtgtgaggtgctggggcatggaacttccctgtagccctgctccctgacctggggcactacggtcaggtgctgctcctcccctcttctcggctgcgttttcctcctccctccacccagctcatccccagcctcaactgccacttctgctcctctgatgcccagggtgtattcccagtgatcacctgcccagagcacagctgtcttctaggtgcacacccacatgtccaaagatcaattattttcctctcctggcatggcctctgtgacgcccactagtcatggtggctgtgacatccactagtgcctcagccagacccgtgactcaccctggaccccttcctgtcccttccaagatttttcaccactacccatgccatgccatgcatgagactatggcctcctagagggtccctagatgcccctctcgcctcctcccttactgctcggtgcacaccacgcagcagccaagctgaactttcacaccaggcatcatgagagcctgcagcgcctgcttctaccctcaggaattcccccaaccctgcccatgacggtgtccacactttcctcccaatcctaatggctgccactcccagcaccatctggccagccctcaccttcccttcctgggcatacattccccaaattcacagtgctctcacgagcagcactggagggtcagcctttctttccaatgtcctcggccacccgttgaccacagacacagctttccctcttctcccttggcccctgccatgccagtgctgctgtgtgtgagatgggagactcacctcgtctccatcctgagcaggtgctgggcccagctctcccttggatcttcagtactagaagcagcaggctgttggaatattctggttggagccaggcatggtagctggagcctgtagtcccagctacttgggaggctgaggcaggaggacctcttgagtccaggagttagaggttgcagtgagcactgatcacaacactacactccagcctgggtgacgaagtgtaatcctgtctctaaatacacacatacacatgcacacacacacacaaattttggttgagacaagagacttgtctcaagagatggacatgggcacaaggcttcctggtctcaaaaatggccagaaccactgccagcctcccatctctgcttcagtctgccttacagggggacagggttaatgacttgatggggccaacatcccttccctcataaaccaggctgccggcttccggcctttccagtcaacacgagcccagccaggccaaccttgagacttgcctcctagggagagaacgtgttcttcttggtgaccaacttccttgtgacgccagcccaagttcagggcagatgcccagaggtgagtttacccaggatcctcccagcgggtcccttgttcctccatcagccccagggggccacccgtgtttccctttccccttcccaggtggctgaaggctcagcctgtgctcggtgtcccccaggcactgggctacatcttttcctgaatcattatgttcagtcttcacatatcccctgcctggtaggaagtcctgtgatccccatttcagaggagaagactgaggctcagtgaggttgagtcactttcttaaggcctccaggcctgtgggtgacaggaccccgagctctgggcagcagcagttcccatgaggtgtccaggccctcccatcctggtcctgcctctgggtactctccaggttggtagtgtgacacccagagctgcgcacatgctcagggaggttctaatagcaagagccaagctggaatatcacctccccttgtctgtgcccagcctctattaatatgtcctgaggcagctttcatctttgtgggccaacacagcacactcttgctcatggtgaattcaggattgcttatgatttctggatagttttttttgttttatttttgagacggagtttcactctgtcacccacgctggagtgcagtggcagatatcagctcactgcaagctctgcctctcaggttcacgccattctcctgcctcagcctccggagtagctggtactacaggcgcctgccaccacgcccagctaatttttttttttttttgtatttttagtggagacggggtttcacggtgttagccaggatggtctccatctcctgacctcatgatccacctgcctcggcctcccaaagtgctgggattacaggcgtgagccaccacgcccggcctgatttctggatagtttttacatcaaccgtggtcaagccagagtcccccaccttgttcttcttcatttctgatccagaaatgctgattctccccctgacatttcaccttttccccttgcctggggatgtccctgggatcctgcatctgtcacagagcatgctcattctctccagctgtgaattttgtttgaactattgggactcaggacatagtcctgaaagtttacctccacagtgacatctttaggcaagtccaacatttacgtgcctcctgggctggagggtcgttgtgcagacagctgtcccctgagccctggtggctggtcctagcacagttgctggagacatcccatgtccgtagttggaaatatgcacaaaggattgcttactctttttgtttgtttgtttttttgagatggagtcttgctcttgtccccaaggctggagttcaatggcacgatctcggctcactgcaacctccgcctcctgggttcaagcagttctcctgctcaccccctgagtagctgggattacaggtgcccgccactgtgcccagctaatttttgtattttaagtagagacggggtttcaccatgttggccaggctggtctcgaactcctggcctcaggtgacccaccagcctcggcctctcaaagtgctgggattacaggcgtgagcctgccgagagcttggtcggggagacctgaacccagcggtgctaaaggaattaaagacaaacacacataaatatagaggtgtggagtgggaaatcaggggtatcacagccttcagagctgacagcctcgaacagatttacccacatatttattgacagcaagccagtgataagcattgtttctatagattatagattaactaaaagtattccttatgggaaacaaagggatgggctctggttggttagctgcagcaggagcatgtccttaaatcacagatcgctcatgctattgtttgtggtttaagaacgcctttaagcggttttccgccctgggtgggccaggttttccttgccctcattccggtaaacccacaaacttccagtgtgggtgtcgtggctatcacaaacatgtcacagtgctgcagagattttgtttatggccagattttgggggcctcttcccaacatgagccactgtgcctggcaggatgtgcttactcttggtgaacccacacaatgtccttctctttcttaatgctcagatgtgcatttagtgttcagtttgtagaccgttctgaaatttggctggatctgtgggtctgtgtttttcagaatctgtgcaattcctctttgtctgcaaccacacttctggctcttcccatgaaacgtcagggctgggtcgtaattatcagatctgacaacctggctttcccggaagaccagagttctgccagctcctctagggatcctggtgcctgatccctcccttacatgcaccatgctctttatagtgtcacctccctcagcagacaccgctgagcctccccgctgggccagggggctagctaggctaaattcacaaaactccatctcccatacttcaaagaccacccacatggacagcccagcccaggtggcaggtcctatgatgggacagaggctgtaggtgggggacctagggctgcacttgagcagaatcttttttttttttttcttttttttttttttgagacagagtctcgctctgtcacccaggctggagtgcagtggcgtgatctcggctcactgcacacctccacctccttggttcaagcgattctcctgcctcagcctcccaagtaggtgggactacaggcacacaccaccacactcggctaatttttgtatttttaatagagacagggttttgctgtgtcggccaggctggtctcaaactcctgacctcaggtaatccgcccaccttggcttctcaaagtgttgggattacaggtgtgccaggccaagcagaatcttaaaaaaaggtggggagaagctggtgagcaggtggatttggttgaagcaggatgtcgacacagagggggcttggtgggtaaaggccctgagctgtgtgaggtgaggtgcctttagggctacctgccactgggtggagctgaagtgaagatttggactggggtgggaagaaggtagttcaggatttcaggggcccctgtaagccccactaaggagctaaactgtttttgtttgtttgttttctttttctcttttcttttttttcctgtagcaatgaggtcttgctttgttgcccaggctggtctcgaactcctgagctcaggcaatccgcctactttggactctcaaagtgctaggattacaggcgtgagccactgtgcctggcaggagctaaacttgattagaggaacagaagagagccacacgtgggctcagaggcagggtgctcagtttcctgcacattgggatgcaccacttgggctgctgggcataggtggatgagggtatgggaagacgtgggggccccactggtggtcactgtggggtctagttggaggagacggtagcccagctggggtgaagaggagaggcagacacaggacataggtagggacaaagaagcagagcatgtggctctgctccgacctccacccaatcacgacggccctgtctttcagaaagtcccaccgcctcattctggcttctcagaggccctcagccttccttgcgcccctggtgctggtgttcttcctgctgcccctgagctgagtgccctgggcagcagtgtccatcctcagttggggcaggaccatgcctgggagagtgcccgatgctcaagggtgccttcgtctctggggtctgggaccccagaaagctcacctgtcctccccttctgccagagccccatagtcctatgcctctgtgcaggcattaatgtccccaggttacagaagagcgagcaggaaggagtagcctgtggtccctcagcaagggtgtggggtcctgcttcaatacccaagcccctgactctagggccctgatctttgtcagctatgtccccatgccgggcatcaaaaactcaccctcccaaggtatcttcaccttccctgatctgtcatccaaattggaccagaggagctagacctggaagaatcacttccgcatccaccagggacagaactgtcaggagggaaggggcagggtgcgttgtctcacgcctgtaatcccagcactctgggaggctgagacagaaggattgcttgaggccaggagttaaaaaccagcctggtcaacatagcaagactccatctctacaaaaaaaaaatattaaaaaatcagccaggcacagtggtgtgtgtctgtagtcccagctactgggaatactgaggtgagaggattgcttaagcccgggagggcgaggctgtagtgagccatgatcataccactgcactagagcctggacaacagagtgagaccgaatcactaaaaataaattttttgaaaaaggaggaaaggggtctccctttgtctttgaaatacagtactgtaccttcatctggccagggcattgctccgctccctcctctgaccacctccttttatttgcaccctccagctttcctgtgtggccccacactcagggtactctggcggcggggtggtgaggttgtttaaggtgggaagggggcctgtccttcccaccttgaacctccctgcctttgagactgggctgtggaggggagacatcccctgtgccattggtgactgctctctctcccacctcagcacccgtccgtcccactggctaactgctgggtcgacgaggactgccccgaaggggagggaggcacacacagccacggtaactgtgggctctgtcttccagtgcccccagcagggtgggggccgggctgggatcctgggtggctcctgagtgcaggccctgctcgcctctgtccctgcatctctctttctgccaacaaccccctggctgaaggcctccccaggcctgcagagatttgaaggtctggagttcatcttttgttttctaggtgtaaaaacaggccagtgtgtggtgttcaatgggacccacaggacctgtgagatctggagttggtgccccgtggagagtggcgttgtgccctcgtaagtgtccccacaatcccctaccccaactggcgcagggccccaggcctggcagaggctgtcacctcccttccacctgcaggaggcccctgctggcccaggcccagaacttcacactgttcatcaaaaacacagtcaccttcagcaagttcaacttctctaagtaagcagagtgggtctcatctgccccaagaccctccttgtcccctacctcatctgacctttcccactcctcccaggtccaatgccttggagacctgggaccccacctattttaagcactgccgctatgaaccacaattcagcccctactgtcccgtgttccgcattggggacctcgtggccaaggctggagggaccttcgaggacctggcgttgctggtgggtcccaagttgggggcagggttcctagagggctctgggagagggtcccgggcccacccaccggtggaaaagctatgtgctatgtgcagggtggctctgtaggcatcagagttcactgggattgtgacctggacaccggggactctggctgctggcctcactactccttccagctgcaggagaagagctacaacttcaggtgaggccccactgctcccagtgcccagctgctgggcccatcgccctctcactgtggcggccaggacagaccacacccaggcccaggcctctagatattccactacgtgtgcaagggggtcccaggagcaggagagagctgttctcaaccccacatcctccagcacaggctccgtcctgctgccccaagtcctgagccctccaccccatctgtcccaggcccctgcccagctcaggctcctcactgccagcccttcctccaccccacctcgcttctagtatctcccctccacagcaatggggtgtttcatttttactttccccttctccccttcagctttgttttttttttttttaagacagaatctcattctgtcacccaggctggagtgcagtggcccgacctcggctcactgtaacctctgcttcctgggttcaaccgattctccttcctcagcctcctgagtagctggaattacaggtgctcgccactactcccagctaatttttatattttggtagatagagatgggttttcacaatgttggccaggctggtctcaaacccctgacctcaggtgatccacccacctcagcctcccgaagggctaggattacagacgtaaaccaccatgtctggcctcccttccgcttttacctaaactttttttttttttttgagatggagtctcactctgtcgcccaggctggagtacagtggcgggatctcagctcactgcaagttccgcttcccgtgttcacgccattctcctgcctcagcctcccaagtagctgggactacgggtgcacgcctccacgcccggctaatttttgcatttttagtagagacagggtttcaccatgttggccaggatggtctcgatctcttgacctcgtgatccacctgcctcagcctcccatagtgctgggattacaggcgtgagccaccacgcccgacctttttttttgaaacggagttttcactttcttgtagtccaggctggaatgcaatggcgtggtcttggctcactgcaacctctgcctcctgggttcaggtgattttccagcctctgcctccagagtagctgggatgacaggtgtgcaccaccacacccaactaatttttgtatttttagtagagatggtgttttgccatgttggccaggctggtctcgaacttctgacctcaggtgatctgcccacttcagcctcccaaagtgctgggattacaggcatgagccaccaagcctgttttttttgtgttttttttttttttttttttagatgaagttttgctcttgttgcccagactggagtgcagtggcccgatctcggctcactgcaatctttgcctctcgggttcaagcaattctcctgcctcagcctcctgagtagctgtgattacaggtgcacaccaccacacccagctaatttttgtgtttttactagagatggggtttcaccatattggtcaggctggtctcgaactcctgacctcaggtgatccacctgcctcagcctcccaaagtgctgggattacaggtgtgagccactgtgcctggcctcaagtttcataaattgcatttattatcatgtctttgagtcttctaagcagatctattggatccttctgccaccgagcgtcacctcgtcatgcaggcaggcacacacgaccaccaggcctggggatgatgcccctcaacatagctcactgcaccccgtctgatctggcttccccaacctccccagcccttcgaaaccacgtggggctggctcccacccacatcctgttcccctgacctctgtgctggcaaaccacctgtgtgcatgttccttcaggcccagcctcatgtcccctccaggaagtctaccccagttcccagggaagagtgagttcccatctctggaatccctcagccctgagcctgccccttcacatcccccgctgctgggtctgtttagggactcctctgtcccccgtcctctcagcaggcagggaacttctgagggacaggtcttcgtttgctttttctgttttctcaccaattacatagggctgagacccaggactcaggcttgggctgggggtttatagagtcaattgacaagttggacagaggtctggcagggccagccccacctgggggtgggcaaagcaggtcaccagagccttctttcctgcccacaggacagccactcactggtgggagcaaccgggtgtggaggcccgcaccctgctcaagctctatggaatccgcttcgacatcctcgtcaccgggcaggtaggcacaggtaggggtcaggccggggatgggatggggcaggcagacagggctggaggaggcatgaggctgacagtcgtgggctgagaggttcagctcagatctctctcaggcagggaagttcgggctcatccccacggccgtcacactgggcaccggggcagcttggctgggcgtggtgagtgcgagcactgtgggcacctgcaggctgcagtgagtgctgctgaccagggtgtgtccaatgcatgctggagcctccggtgcctgcacattgagtctcggggtgcaggctggggaggtggcaggagagcaggctcgggggctggaacatgggttggccctgcctctcccaggtcacctttttctgtgacctgctactgctgtatgtggatagagaagcccatttctactggaggacaaagtatgaggaggtgagctgaggtcgctctgcttggaccctgggttctgccacacttaggaagatgttggctggatccctgacctgctgtcctcatctgcaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaacaagaaggctctgggcagagtccatggcaccagcaccagccaaggcccactcctgaagacccgaagcccagcccctggatgaaggtcctaaggtcctgaggactccccagcctgtgcaggcctgcaaacccaggctgcccacaacagaaggggctctcggcttgtctggcctctctggcctcccaagcaggtgtgggagggcggggcaagtgtgggctgatcagctactccatatggccagggtcctgtgctggtgcctggctggggggctgcatagcctgcactgtctcctccaggctgcccctggggaataccacgtagtgtgtggagttcagccctggcagctcccgctggttctccttgctatgccggatgccatagccgaaatacactgcaagtcctagacagggcaggaggcagggcatgagcctgaggtacaggttccagcccttcctgtcctctttgccctcctcctgaccccggtcccagcctggcccccactcacccatcagcagccagatggagaagcgcacccaggtcagatagctaagtttcagcatgaggcagatgttgaggacgatgctcagggctggaatcaggggaaccatggggatctgaggaggcagaggcagggcagggctgggccgggctgcaggaaagatctgccagcccagggctcactttctcgggaatccatagagcctttgttcctcacgggagattgtggagacatgtgctcactcaccatgcagaaaggggtgcgggatgggtgtgtggtcctccccagccccgtgagacttgttcattctgggatggtagtgggggaaggggaggcagctgcctgggccgagtgtgagtgggtgttggctaggggaggtacctgaaataagtcttcccgatactgttgctggtgagcccccaggacaaggaggctgagcagaaacatgacactggtgagcaggagcagcaggatgtaaccccagtgtgggaggtgcagggtcgagttcccaaagacaagcacgcagcctatggtgatggctgaggccaacataacgccaagcgcccaagtcaccactgctccagggctgtacccatccaagaagcccaggtagggcctcagggctggcttcagctcccctggctcagggacggaggcgtgtacagtgcccaccagctgtaggtggtctgagaaggagctctgctgcttggtcagggggccagggctggctgggcctggggagctgggcggggaagacttctggaagcgcagcacaatgatactggtggccacgaatgtgtaggccaggagtgtgccaagggacaggaactgaaccagcgactccaggtccagcagcagtgccaggaaggccgtgaggagcccgaacgccagggtgcccgccacaggcacctgtgtccgggggtgcacatgggcaaacacctggaagaagagcccatcggcggccatggcatagacaatgcgtggcagggagaagaggaggctgagcaggacggtgttcatggctgtagcagagagagtggggagggtcagcatggcggagaagcccaccaggggcctctgctgggggtcggtgcatgggtggctccttgggaacaagggcatgagcttgtctgggctctcagagtaagcatgagtttgtgtaggagtaatagattgtcagcgctttgcccaagaacaggacatctgggttaggtcacaggcccactggagcatcggatgagggctgagtccctctgcctaggaaataatctataaggacatgcccagaactaatatgctatggaccatgtgtggggcggtcccttccaaagtttctgaagaaactttttttgaagtgaagagtttctaataattagcactttccttgccccattatgcaactagtaaaacagccccagttgaaggtgcattccccaagaatctgaggacaaggtcccccttgctcttttccctgccaccctgcccaggaagagtctctcaccgcagatggagccagctgccacgatgaagccagcccacctgtagccccgctggtagaaggcatctgcaagcgctgagtcggggtccaggctgtgccagggcaccatgagggttagcacggtggagacaaggatgtaggcaccagctgcaatggcaagcgagatggcgatggccagaggcacagaccgccgtgggttctgggcctcctcactggaggcggcaatgacgtcgaagcccacgaaagcatagaagcaggaggcagtgccggccatgacgccggagaagccgaagggtgcaaagccgccttcgtcagcgctccagttgtgaggctgggccaggatgaagcccaggatgacaatgaagagaatgacaagcaggctgatggccgagaaggtgtgattgagccaggaggacacgcgggctccacaggagacaaaggcagaggccaggaggatgatgccagcagccaggaagtccgggtagtggcccaggaggggcacctgccaagaacccacgtgggtctcagtgaagttgcggatgctgtggctgaacatagagtccaggtagccactccaggcacgggccacggcggcgccaccgatgatgtattcgaggagaacattccagccgatgaggaaggcccacagctcgcccatggatacgtaggtgaacaggtaggcagagcccgtgcgtggcacacgtgccccaaattctgcatagcatagggctgccagcagggaggccacagcggccacaccgaaggacaagagcacagcagggccagccacctccttggccacggcacctgtgagcacgtagagacccgagcccaccatgccacccacgcccagaagagtcaggtccagcgtggacaggcagcgccgcagtgacgtctccatggtggagtcctccagcggcttcaggcggttcagcttctggcataagcgtgccaggctagcaatggtgggcagcccccgggccatggcaggtggccgagaagagcaccgagccagctactggaacctgctagggccagaggggaatgacaggatgcgtagccggggcctgaccagccttccatccctcctggtctgaccacccccagtcctctctctgtccctgacctggggacctggacaccctcaccaggggcctgctggagagctggaatggggcaggtgtcagaacctgtgggcaggaggtcacaggaagcctggaggccctgtctgcatcccaggcagcaaaggaggcctggtgaggccccacctgctcacccgctcggtggccctgaggggtggggagggagcagctccagggggagcagggtgagaggctgggaacggctcagtggtggggtcccagagccaggtgaaaccgaggcttccccagagtcgagccggacccggaacaggagccgcggctctgcgtcggggcgggtgtggcccaggcagccacctggccacagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccggcgccgagcgcagggcccgcccccatcccaggccccccgcgcggccccacccgctgccacacacccagatatttcaccctgcccactctgcccgacctcgcaaggtcgttaccggagctcaccggggtctagggaagccctgtgactgtgactcagtcacagatggagaaggtcagaccgccggctgactgactagcctaggtcagttcggggaggttaagggccacgtctgaaagtccgcagcccaccttctttctactgcagcggacacccttcttgatccctcaccccagtacatgaaccccacccagctgggccccagacaggccccacagcaccgtcatgtgagcttcaggcacagtgagttagatgaagacatgggtctggcagagtggcctggggcggtccctgacctctactcttacaatggaagagactgcagccttttgagagagttctgcgaattgagggaatgcattctggctgttttgagcctgcagctaccacgtcctgcaaggaagcaagcagcttctgggaccagcctgcagccctcctgtgggggagtagagctcctcagaccccagtggcagcccttcctagcctaggcacctctggcaggccgggagggccctatgggaccccaatagcagatccccacttgtgtttatcagcgacagccactgtgtcctgagtactgcattccagtgccccacgccccaggcaggcagctatgcaacaatacacctggctaattttttaattttaatttttttagagactgggtctcactatgctgcccgggctggtctcgaactcttggcctcccaaaaggctgtgattacattcatgaaccatggctcctggcctccccagaacgctatactagacatgtgttcaggcttacatgtggtttgtggaatggaatcttaggagcatctgcagcctatccagcctattgggctggtgacaggatgatggactcccagacaagatggtgccaatttggaacattctgcctcggccagaatgccaataccttctaatatttggctggtattgtcttgaggaacttctcagatggctcccacttccggtgggatggtagcttccttaccccatccctgtgttgcctgagcagacgtcccttgtcctgaaatgtcaccacaaaagtctaggcacttcaggccagagggttaggcagatttgtaatgggagctccccaaaggccttaccaatgactgccttattgctggtgtccagtgttttggagtgttgactttttatctacctggagaaggtgtgacaccacaccctctgccacaggcaccaacatacaacggatatgtgagactaagcagggctgatgcagtaaattgtacatttccagagatatttccctcactactgagtgagacagctacacagagcaaccccacagtgatgcagtgaagacaaaccaccaggaaacaaaaactttctaactcattctgcaaggccaggattaccctgacactaaactcaacaaagacatcacaagaaaagaaaaccacagaccaaaatcccttatgaatatagatgtagaaatccccagcaaaacacagtggactcttgaacaacacaggtttactaatacatagatatttttcaaccaaatgtcgatcaaaaatacagtatttggctaggcccagtggctcacaccggtaatcccatcactttgggaggctgaggtgagaggatcacttgaacccaggagtctgaggctgcagtgagctatgatcctgtcactgcacttcagcctaggtggcaaagcaagaccctgtctccaaaactactaaataaataaattaaaataagtggtgggtgcctgtaatcgcagctacttgggaggctgaggcaggagaatcgcttgaacccgggaggcagaggttgcaatgagctgagatggcgccattgcactccagcgtgggtgacagagcaagactctgtctcaaaaaaaaataaaaaacaaaaaacaaaaaattcatatggaaatgcaagggatccagaatagccaaaatacttgggtattttgcctgggtaacatagggagacctcacctctacggaaaggtaaaaaaattatatgggcatggtggcatgtgcctgtggtctcagctactgggagtcgggggtggtgttgaggtggaaggatttcttgagcctgggaggttgaggttgcagtgaggcatgtttgtgccactgcactccagcttgggtgatagtcagaccctgtctcaaaaaaaaaagaaaaaagtaaagaaagaaattaaaggcaacataaataaatggaaagacatcccatgttcatagactgtaagactttaaatataaaatggcagtattccccaaactggtctacagattcaggggttgcatagattgagtgcaattcctattgaaatcccaactacctgttttgcaaaaatcatcaaaattcatgtggaaatgcaagggatccagaatagtcaaaatacttttgaaaaagttttggaggacttacaattcctgatttctaaactgattgcaaaatgactgtaatcaagattgtggtggtgacataagagtagacacatagatgaacggaatagaattgacagtccacaaataaacagttacatttatcgtcaagtgattttttaaaaatagactttattagctgggaatggtggtacacgcctgtagtctcagttactcagaaggctgagttgggaggatggcttgagcctaggaggctcaaggctgcagtgagcttgatcatacctgtgaatagcctcttcactccagcctgggcaacatagcaagaccctgtatctaaaaaaaaaaaaagttgagttttcagagcagttttatgttcacagcaatattgagcagaaagtacagttcccatatacttctgctcccacacacgtgtagccccctctcccactactgacatccagcaccaaaggggcatatttgttacaatcgattaacctacattgacacatcattatcacccaaggtctatagtttacattagggttcattcttccggttgtacattctatgggtttggacaaatgtgtaatgacacatagacacaccattattgtatcacacacagtagtttcattgccctaaaaaccctctgtgctctgcctgtccctccctgctaacacctggcaaccaccgatctttttcctgtctccatagtctagtcttacttttgcagaatcttatatagttgggattatagagtatattgccttttcaggcttctttcccttaataatatgcatttgagattcctctatgacttttcatggctgaatagctcgttttaattttattttttatttttgagacagagtctcactctgtcgcccaggctggagtgaagtggagtgatcttggctcactgtagcctctgccttcaggattcaaacgattctcatgtctcagcctcccgaatggctggggactgcaggcgtgcactgtcacaccaggctaaattttgtatttttagtagaaatggggttttcccatgttggccaggttagtctcaaactcatttcctcaagtgatacacctgcttcaacctccccaatgtgctgggattacaagcgtgagccacccaaccaggcctgtgctatttctaaaatgcaggagatgaagttgccatgtgaaagatgcaacattcttatcttcaaggatgagaagttgaaatgagagaattctatacagaccttgttaaaacactgttatcttttaagcctccccatataatttagttgcctcttcataacttattattatttgtccaattcagtgtataagtaacagactctaacttcttctttgggtcttcaaatgtccttatgagggttcccaacccatgtaaaacttgtactcaataaatttgtgggactgtgtggtggctcactcctgtgatcccagtgctttgggaggccgaggggggcttgcttgagtccaggagttcaagaccagtctgggcaatatagtgagatcccggttcaacactttttttttttaattagattggtgtggtgggtggcatgtacctgcagttccagctactcaggaggctgaggtgggaggatagcttgagcccaggagtttgaggctgcaatgagctgtgatctcaccactgcactccagcaccccttatttataaataaatataatggctagccttagggactctgttcgcaagattaaagaacagaaatcagatgtagaatagcatataaataaatttatgtgcttttcttctgttaacctgtcctatgtcaatttaattcttgggcccagctgagactctagggatggaagtggagttttgccacccctacagtttctggtgacaaggatgggatcctctcaagcctaaagatgggatcctgggagaacaaataaaagcgggcacaggtaggaattcttaccaaagtgaactctttttttttttttgagacggagtctcgctctgtagcccaggctggagtgcagtggcacgatctcggctcactgcaagctctgcctcctgggttcacgccattctcctgcctcagcctcacacgtagctgggactacaggcacccgccaccacgcccggctaatttttttttgtatttttggtagagacggggtttcaccgtgttagccaggatggtctcaatctcctgacctcgtgatccgcctgcctcggcctcccaaagtgctgggattacaggcatgagccactgcgcccagcccaaagtgaactcttctggatctctgtctgtaatgcctggttgaaagaggagagtaaaatttttccttgtccctttctaaattcaaactggcaggagaaaagcatggtaagaattgattctttgagttatgactcttatgtcaaccttaaataatgagattcagaaaatatcagctaggcacgttggcttatgcttgtaatcccagcactttgggaggccaaggtggaaggatcacttgaacccaggagttggaggctgcagtgagctataattacatcactgcattccagtctgggtgacacagacctagtctccaaaaaacaaaaacaaaaaaaaccaaaggaaatatgatttttattctagtgcaaagcttgaggatggacacccaggaaacagcttccaaagggttggggtcattgctccaaagtggggaagctaaggtttcactcatagaggcagaaacagtgtcagcaggattgcaacatcttctgtacaaatccagtatgttagattccattagtacagcttgctacattccaaggaaaattgtttcaacattctgtgagaagaagtcaagctctgaggtcatcttatctctgatgctgctcagacatttctaaccatttacagggaaaagcagaagttgcaactgcatgctccatgcctcaggccacatggccacattcctcctgaggctcataataatgtaaagttccaacagcttggtggtggctcacgcctgtaatcccagcactttgggaagctgaggtggctggataacttaagaaaggagtttgagaccagcctggccaacacagcgaaaccccgtctctactaagtatacaaaaattagcccggcatggtggcgggcacctgtagtcccagctactcaggaggctgaggtgggaggattgcatgatcctgggagtttgaggctgtagtgagccatgattgcagcactgcactccagcctgggtgacagagggagaccttgtctcaaaaaaaaaaaaaaaagaattatttgatttcacacttccgaatttggtatttggctctgcatacatagtggctattgacccacagcctcccagaaataaggcttgttttccatgtctctgttgtgtggtttatcatatcttgttttatgtcttgagaacatggctctgtgaccaattgaaatattctctttggtttctgccagctgcaggggttgggaggacaagtccttgttaggctgctagccagctgcccaggaatcagaaacacagtgtctctgtccaacggttccagctctcagaggagtttgtcctacttgtctcagctttcattgccttgataacaattaggatatttgcctgcttaggctatcttgaaaaagactttggatcttgagggggattgtatcttttccagcctgtttgggatgctcttctgtgcctccagttaagccagaa

SEQ ID NO: 1159 - DNA, 268530 bp, Homo sapiens
ttaacaacgttgataagttgtttttcctctccggtcaattttcttctctgtaaagtgagtgcacgaactcaggactttgttgtgaggattgactacgttaatgcagcacccaacatttagtgattctcagtatatgctaatagtgttattattggacaggtaagttaatgaagacttgggtcgtacttgaatccttcacacttagcctgttgccaggtgcccagtgggtgattgataaacatttattcggttggtagaagaatgctacattcatttttatctgaagatgccactaaggagtggggaaagctcagtagaacgactattaaaatgaaaatagcctacattactcgagtgaaaactctgcaccagacaagccccgaatactcagtaaatactgactcattcaacactcacagaaaccctaaacagtagatcttattattactgctctcattttatcagtgagtgaactgactcacaggttaaatctcttgcacatggtcatatagtctgaattcaaacctggccagtgtgtggcagggaggaacttttgttcctggcacaggaacttttcatttctctccaatcctgcttttctacccataaaagtatgttaaccgacttctcatgaagatgctgagtaacctggctggtaataaccacgcaatggtttctccacttgtctatctgggttgctagtattcactctctcccctctaaatgatgaacatcatgatgcaagacataaaaatcagttaatattgcctttgagaacttatgcatgacagtgaccagacagtctgagaaaggtgttgagataatttggcaggttgaagcctgatgggttgggtaaggctgctatccggagaaccacttctatacttagagcctgttgaacttcaagacctagcttaccatcctgaactgtgttcagaagtgatacagaatgactcaagtgctgatgagaatcagggaagaactgaatgggaaggattcttagtaggcacataatccaggagtcttaacaggattatcaatggaatcaggaaggaaattaccaagtctgtaaaataagatgtgaaattgtgtataaacacggggtaatattcagagtcatttaataatgtataggaaattgggtaatgtttagagtcatttaatactgtgcagttcatagaaaaccaacaaatcagaaaggactttgattctatagaacagaaaggacagtggtcccagagaacagctatactagggcttatctgttgcccataagaccaggaaccaggtcagtttccatttccaatgttctaacaggttctcaaagagaaaaataaaagatctgtctaaagcaacacaggaatttagtggcagaagtgagaccagagcctggactcttgagtcccactagagctcttcaatcagtgtagtctgtcccatggcccttactgaacactgcaagagcagatccaagtgtgagctcatcatttctcaacatgacattgtaaaataagtttaagtttccctttcttctgaggagcacagtgtactctccataaactagggccactgtctaaagttattattatttattaactgtttgaaattggtggtttcactattcacaatagcaacaatatggaatcaatgtaaatgcccatcaatggcagactgaatttaaaaaatgtgattcatatacaccatagagtactatgctaccataaaaaaaaatgaggtcatgtcttttgtagcagcacagatggggctggaggccattattctaagcaaactaatacaggaacagaaaaccagatactgcaagttctcacttataagtgggagctaaaaacattgagtacatgtgaacacaaagaaaggaaccacagacaatagggcctacttgagggtgtatggtgggaggagggtgaggataaaaaatattgggtactatggtttattacctgggtgacaaaataatgtataaatcgaacactgcaacacacaatttacttatataacaaaactgcacatgtacctttgaacataaaagttataaaaatacaaaaataaaaaaggaaaaaataataaaataaaattagtgtttttatgcgtggtccaagtcagtccagggtccgtatgctcccaggattatgtgatgctttctctcaatgttcattgtaatagtgttgcctatggacctaagtttggagggctggccactgttggttccctttatcagtgaagttaaggactgacttgaggcactgcacagtaaatctccagttatcataaaggaactttcaaatttctcattgctgtagtttatcttaaaggttcagaatatggactttggagccaattgtacttggtttttgattgttgcaaatttatgcagtagtctaaagatgtttttcttgtctataaaatgaagataatcatattacctgcctcctagtgttcttataaagactaaaaaatgtaatgtataaacattcaccccataaaacaccaataaatgtccactattcataacaaaactaataataattttaagaatgaaaaatcatgctagtcagctagccaggcattaacatattgttgggcacataattgacaatagataaataaataattattgatgaataaatgaattatcatcatctgcaataatagaagcagcattttagtagaaagcgtattggttaggaaattctcactttgggatgatttggatgtgtaactttgggagagtcctttcccctctgtggatctttatttgtaaattgggagtgttagatttaacaaattgtaaagcactttctgttaaaacacacacacacacaaaaaaaaaaactacaatgagctggtgtgtcagatactaatggctaactaacatcatccttatataccatctagccaagtttatgtctatgtgacaagcgaagtagcaacataaggctgtgcatgacagtgctggctcaatggcttggggattaggtatgagagtttcagaagagggagagattaattctaattggtggaaggtataaggaaactttcctgtaagagtcaggactttcttcaaatgaattttaagaatttgtaggactcaaactaaggtgtgggagaagcatggcaaaattctggaagtcagacatacctaagggttatggaagtttcacagagttcaccaaatgttcactcaactcctaatcagtataaaacacagagggtaggccgggcgcggtggctcacgcctgtaatcacagcacttgggaggccaaggtgggtggatcatctaaggtcaggagttcgagaccagcctggccagcatggtgaaaccccgtctctactaaaaatacaaaaaattagccaggcgtggtagcggtcacctgtaatcccagcaactcaggaggctgaggcagaagaatcgcttgaacccgggaggcagaggttgcagtgagctgagattgcgccactgtactccagcctgggtgacaagagtgagactccatcttaaaaaacaaacaaaacaaaacaaaacaaaacaaaaaaaacaaaaaaacacagagggtaaaccccatgaggggctgcaaaaggcaaaagactgaggtctcatctttcagaagcttgaagtgtggcatagaatggaatacagcagcataaatctaaaatacaggaggaagggataaaaactaatcctctaggaatgatttcttttaatgtttcatcaagaacaatgttatgaagatatacgcactccattgaagtcaaagcacataggttagagttctgctttgaacatatatcttctagttaggtgattctgggtaaattgctgcctctttctgaacctgagtttcctatcttttcaaacagacagcaaaacctacctatttgagttgctgtgaggatgcaggttaggtccacgcatggcacagagaaggggctcagcaagtcatgctattcccaattgctatagattgagctcatcacaaagcattgctgaattagtttcccatgagaaagtcttcactgaagaaaaattaattgcacgccttcaatctcagttgatataaaagtggccaattagacagagattctgcaatttctggaaaaaattaaaaaaaaaaaaaaaacagatctgaaagcattgtccattatatgactcaaggcctcttctcaaataaaccacaagatacatttgtcctggaattaagcagaaggggttatcaaacgtttcattttccactcaacaaaacactgcaacatgtactgaatgaagagaacgcccaccatggcccatttctgatttctctcaaagcttcctcttccaggggattatcgagatactttcctgattaaaatttaaaacaatagcaagattaaaggtggattagaggcaggccagccaaacagctaagaatgtgaactttggagagagatagccttggttcaaatgtgtcatggaatctcaccaactttttaaaaatctcagtattttcagcttcatttttttaatctgaaaaattgaagaaaataagaaacattacagattataatttgaggattaaatgaatgtaaaattaaatatatgtaaccaatcagaatagtgtctgtcacactaaatcatagctaattattattactaaaggaataataaatgaaatttataaaataatatgcctttttacaatttttttaaagcatgcaatgtaaattagtggtcttcatctttaattaaaattctatgcataagaaatgccttgggcacctgagactaacaaaatagggcaccttggcatgagtcaaaggaccagggttgcaatgcagacgtttctgtgttagtttcctagtcttaaacctgcaggaagcttaagagagaaccctagttgattctaagccaaccactattggacacaaaaatttcaaaaacatacagaggaaaacatcctgaggtcaccgtcttcacttctagcctcagaggtccctgactcccaaccccctacctccagctcaggcaaacaatctgatcaccagctttctttctgtgcagctctaaactcagaacagcaataagtaaatcaccgtattaatttttgtttccgaaggatcttggagattctcaaaactactctgggctgtgggtaaatttatttttcatatgatttaagaaggcagaaggacagatagaaactgctgggcaattcagataaactgggttcagacttacctcctagtcttgtgaagttaaaaacttagtacagggtccaacacatagtgggtgcttaatatgagggagttattatgactgctggtgtaattattacaattgtcaactctagtatatatgttaaattaatacaactaaactactgttggggggaagtaaagaagttaatgtttatccaacaccactgacatatgtactcatcactgtgcaacatgatatccacgtcttatttaatcttccagataaccccaagaaatccataaaaaggggaaatgaaaaatgagattcaaaaggttaagtgatttttcctatccccttgagctagtacacagagtgctagatttggattggctgagctctccattatttatttagtctctccagttcagtgttgtttttttttctcctgtaaaatgggatgattattagatctcttctgtaagtttgttataaggattagatgagatcgttccaataaaaagcacttacatattgcgtggaacaccatgcatactcaatcaacgtaagctgttattgtaattgttatttagcaaagataggatttgaacccaatttattctactccaaagcctacattctttttagtgaccttcacttgagcaactgatgaactatatctgtcagggtgttcacagatgcatcatctgggaaaactgaggcagagaaaacaaagaaattaaattaattgtttattaagaaactaatagaatcatagcaccatgattggtaccacaggagaaaataaagaagctatacaacatatataaatatatacacttaaattcaacaggggttgtggacaaacatctttatgcacagcgctgagctaggcagttgggaaagaacaaatatgaatgcaacagtctctgacccaaatggaaaaaagaagcatgccaatatataatttgcctgagagtttgctttgagggtgtgccgatagaaattcagaagcagttctacaagggcccagaggagggagcccttcaggctgctcggggaggggtgcagtcagttgaagattctctgagcaggtgacagaactggcccttgaagattcttgcctttaaaggtcttcacccttcaaggattctaatcttggaggaaagatataagcaggacactacactaagaacaatgggagatcctatctcagtgagttccagattctgtgagacagacgatgcttgctttaggaattctaagacgagaattatccatctggcttgacataagaagtacatagggctctggctccagagaaaagctgagaaaaaaagctcaaagggccattaaaaattagatctgtggaaatgaaaagagggtacttatatattgagcacctactatgtcatgcaacacactaatctaatcctcatgacaactccatggtaaggtcacagagactcagagaaattaagcaacttgctgagagtcataggaacccaggtcagggtgactctgagatgtacttttaaccaccctcacccacattcaaatcagtctcaatctttagggctctactttgatgttacttttctaacttccagtagaatcttatgtcctttctggaaaaacgcttttagtaattaccaaacaaaatgaacactgaaggagtatatcataagagcgaagaaacagagtcaaagtaccttttaggaaaaaatcctcaggaacttaagggagtccctggggaggagggctggaaggaaggaaactaactgaatattggatgactagatgggaattgttgccttactccgataattagaggctacattatatttcaaatctggaagtgatcttaagaatatttgattccagttttttcattttacattagaacagaatgagatctaaagatcctacacaaagcagaataagatcctgagtcacctgacattgaaacgattgctcttctactaaaaatgattaaaagagagggaacacatccataaaagatcaagtattgtagtaaaaaagggatagcagtacatgatacattttatatatatatatatatatgtgtgtgtgtatatatatatatatatatatatatatatatatatgaaggtcttttatatatacatatatatatgaatgtcagtcatagatcaagggttagggtgggtcatgaaccaagaattaaatttcatctaattttatgcactcaattaaaaacaagcaaatacatacatacatatatgcataaagagttagaatggcttccaagacagatggaaacaaatagtaaatgtatgttcaatgaatggatgagtgaaatgtcttgccaaatgatcccagtgcatttgaggacggagatcaaggagttcaaggacccataagacatgaacttcgttgtcccttcgttttcctgcctcctacaggagagaaataacttggcctcctcaattcttgtttgtctttaagaacctgaggagcactttgtctttgacaacaacaatagaacaaatggtattcgtatatcatttttattgtttacaaaagattataccccagagcatatcttgtcctcaaaataaatttgccaagtagatattcccattttaaaggtaaggaagtggaagggaagagaaatgaagtgtcttactcaaggccagtgaactgatatgtgttggagggagtaggaaatgagaagtaaaaatcttgtgctcccactgctggtctgagaattgaataattcccagttgtctaggaatattcaaaattattgtatacaatgacttaaaatccccctggaagacatgcagtttctaaatgcctaattgccacaactgaagtaaatcagtagtcatggtccaacctctattggagaggaagggggattttgaatgatacaatttatgttgttcaacatagctctctttttatccaatggcaaccttttacagatgacttggagttgcaaaaagtcaaagatttgcttaggcaaattctttattcatgacattgtgcacccaagattttctttcctccagccagtctctggaaacacatttagggtattgtgctattttcattttatgactacagaaacagagttcaaacgttcttagtctaagactattcagcaacttctttctaaactaggaaggtatgaatctgagatctcccattttcagaaagcttccataatctttgcatatatcgcattccagctttcatagaggggatgtctgagtcatttgctcatccgacaaatcgtcatacttttgccaacaaacattcttccttggttttctctcttcctgaagcgtgtagcaatgttcctagctctcaagaaagatctggagcagctcggaagataagagcaattgaagaagaaagttacaatttagtggagttaattttatcgcagactttcagcacgctattcacatgcaaacttcacacagaatatttttatcactaccttattggaatagattggtaattaatagcttgtaatccaccattgctaacatgttttgacttattaaacacttggacaaaataaaagaagatctgttttgccataagggggagcttttgagttctataaagagggggaaaaaagaagaaaaaaatatattacatgtatgtcccagttcaaaaacagacctacaaagcagcaaatggtcagatccttacctgtgactttaacaatttcagaggacctgaattgcttaagttgaaaacattaggcaaattaatatttttctctcattttcttcttataaaattaaaataatttctaatgaccaacagagtattttaaagagtattcggggaaattcagagacccagttgtactaggactacagcttctgaaaggcagatgtcctggacagtgcctttcttctattttcttctgatgattccataagaactttggaaacatttgggttagctgaagccagccttatctgggggctcagaaaagaggggaatggttcatcatcgtacaactttaaggaaattctgagagggaaaaggacagggaaaagaagagggaaagaggtaaagggagaggaagcgggaagaagagtaagggagagagtgagaaaaagagaaagagagggagagggagggagggagagacagagagagagaattaaaaaaaaaaatctaagaatcaagtttcaagactctttatgtgctacagaaaaggatgaggtttaccagcaaagtgcaaaggggatcctaagagaagagacagatttttctcctgccatcagaaataataataataagtggggggagtgagggagggaaaaaaagcaagcaaaacaaaacaaaaacaggaatgtgtgttttgagcaggaatgagagctgggaggaccgtaagggggtgtgtacagaatttcattaaattgttactttaagattgtctccttaaaaaaaaaaaaaaaaaaagagagagagagagagagagaaaaggagggggtggtggagaagcgggagcgaaggaaaggaggcaaaaggcaaagtgaaggaaagctggatagctcggcctctccaaactgattgattagtcatgatccccgcagttttaacagggactcattcaattgggaaggtggagcgctggggagcagattagcatacgcttgtttactcatcttctgagggattttttccccctctttcctttcattttgagaagaaggagggaggggaggggggacttggggggggagaagggggctgtggcttgtgttataaaggacgcaaaaaataaataaattagagcatcttttggggggagggaattcagcggatcagtcttaagaggagcttttttttggagcgagaaatcatataaaataaaatgaaataaaacaaggaggaaggcaaccagctgttaggggaaaaataaggcagataaaggagcggggagagaaattaattgccaaccaggaggagttgggctgtatttttcaaaggtggggagagtggagcacacaccttgaggaggaaagcgagaaagaaaagaaaaaagcaagtggaaaggggggctcgcccaagaagggtgaagaagcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacaggtaggtgagggcgcctcggcgggcgctgcaccgtccctgcggccccagaggctcgcgggtgtctgggcgcgggtggcgggcgggtcgggggcttgcgggcgtgtctgtgcgagagctgccccgcgagcggcgcagagacatccgggcgagctgagagcctcactttgctccatcggtggaatgggcacactcggaaggcgtagctgctccatccctgggaggaacctggggagccctcctggcggccccgcggaccctcggccagtgagggctggttcccggagcctagggcacgtaacccgtgctccgaatggtcagatgcactctctccttttgggatgaaagggaggatgacccaattgagatgcatgtgaaaggagacttggggaccgttgatttctttgacgttttaatggaggtaactccccttcattaggccccattcccctgaaagccggcaagggcaaggttgttgtaatggccaggacttagaagtcctcgaagtgccccaaagttgctcactgattgaagcctgcctctgggactcaccctcaccccctccacgccatcccatgtcctagcttttaaagcccattgcctgtcactcggggctgggacgagaccttcctaacgcataccccgccagcgttccccagacgcggctgcgaaacggggcgcttttctcatatgggactttatgagcccgtaatgaatttgagttctccctcctcaacctccctctctctccccttcgctgttccacagcaaagcctatagtgaaatcggacactttgcgaggattgcaaaccttagaaatgctccagcatccattttcccccctctaaatgaatctgtggaaatgcctttaataaaactggggagcggaggtgggggcggcgctggaagagaggaggaaagttttgccttttctgtctgggagattccctttctgcacaaacaatcttgccatgtcctgggacgtcttaaagtgagagtaggggttcccccttcactgcagccaggaaacgtgtgaaggcgttttgcgatcccaccccctcacacacacactttcttagaagggaaagctgtgagctctccgggcagttctgcttcttcctgtctttccatggcttggactttcacagatgtagcactgactatccagttgacatgaagacccctttaggagacccacactctgctgctatcccaagaatacgtctcccgaagcccccgctttccagctatcaaaggagagcgatacagtgattccccccaacaacccacaactgacgtcatcgcatgctatttttcctttttttttttcctccgggaagaagaaggagactgaactcattcacttttaactcgcaagccctatttgcccagaggagggtctaatttggaacagaggaaacgttatccataataataatgacgatggtgataatttagagctgtagtatgttgacttctctttccaaacatgtgaaaaagcaaagagactgctgcttggaggtgatttttttttttttttaatctgtaggtctggtttttcctagtctttacctagtaccagtgatttggaaggcattccctggagagaggagagcacagggttatgcaggcatcatcagtgaaagggtagtgaatgcattttaactatgtaagtgtgtctacataaatacgtgtgtgtgtgtgtatatatatatatacatgtatatatatgtgtgtatatatatatgtgtatatatatatatgtatatatatatatataacacctgggattccacaggagactgctttataaatgtctataattcagacaaggagcctctcttcacacacattctcttgagcactcattcactctctcacacaaagattgttgcagtaaaatactttaattggatggggggcgttaggttattattgcttgtataaaatgcctggtccattttatgtgtagaaataacattcctctcaaaacgaaaaaaataaaataaataaataagcactgctgtcgtgtagcaccagaaagccaggagcttttcccctgaggattctggtggatttcttttccctcccctagttgagttggagccagatttggcggcgtgtaaacacctggctctgagccagaaaagactcattctgcatatcctccacatggtacaggctgttggactaaaaagaacctgcttctccttgaattaaaaagcaaacaaacagaggttctttgcagaagtactttttcagctccctccttcgtgtaagtttgggctgggagagccaggaccgaggtgggcagcaaggatcgggtgcgaaggctcaccctctcgcggcgacctcaggtgcccagtttgctgcctgacctctgctggctttctctggctgggcgttgccactttcctaggaatccctggtcacctatcttgagagagcagtcatcgctcagcagggaccgcgctgctatttcaggcagagagttgctgtcttgctgtcaggccaggctgccttacatcactctttgctgcaggattcaattgggtttcgtaaaggtctaattttacggtgctgttaaccgggtctgtcgtctggcagaggcaggccttgccgctcctggtaggcgggctatgctcccagatccgcccgggatgctatttctgccccggttcaaacttcactgacaccagttcagacaggcgctcggagagacagggggaaggagcgaaggagcagtttgcttctgaagctcagaaaacatgccttttatttttctgaaaggaaaggagaaaaatatatatactaatacataaaaaaagggaaggcttatgcaggcaaaaacaaagccaaagttagaaagtgcctatgtgtaggattctctggagggtccaccagtggatggtctttaggattgaagaatcctttaaggctgctgtgaaaagggtcctcagaggttacccaagccagtttcccttttggccgaatggggagagagacacacagagaggggaggggtgtgtgctggatgacacagctcctcagcggcaggaactaggatttaatccctggcatctgacttccaggccttgccccctgcaccgctgagagaatgtgtctcataaacaccatcacctctcaccccacacggacccaccacccacacacagccttcagccttcatgcatagcaatttgggctccctttcaagtcaggggatgaggggttgtttctgacacatccctttgcttttgtaccacaccaggcaggaggaaccagacccctgttcctcatccccaactgcccccccaacacccctccagtttgaaagaaaaggaaaacaaaagactcaatttgctccatcgagcagaggccttgagcagcagttaatcttgttaaagtttctcctgacctgttagataagtgaaatgtggaccccacaagtactgccctcctcccacccctgtcccactccccttgccttagtgattcggaattcctgctcagaaggagaaaaggatttacctgaatcccatccagcacctctgcttgccagccttttttcttttgttctaatggttggactggattaagtgtgctggttactcccaagaatctttttttccttcccttctgcacccccacttcctagtatccacccaaccctcaaaaaagagtacccacattttctccacttcagcattgctgtaacagtgaaggctgggtttaagtatatggctaggagtccatatattaacaaggcttttccccagtatctgtagtcctacctgggatctagaatattgtaatagttagaactcagttttagtagccaggttacctatgtggaatctctgcccctaactaactgtgtgaccttgggcaagcaagctagttgacttctctggacttcattcaccttcctcatgtacagagtgatgatggcacaagtacctgtatcatagagctgtgtaaatgctaacagaacttggacatggaaggtacttaaaactggacttggtatgtagtaggtgctcaacaaacttcattcttattagacatgattttccaaatatctcagtcttggctttctggactggggaacacttgaaggtatgaagaaatccaactctacctgggtgcttccttggtgatgctgggcactttccttgtgccagcatgttttgccttcacaactaccctgagaagtgtgtatcgtcgcctgtacttcacaaaagagaaatctgagtttcagagagttgaaatgacttggtctaaagtcccacaggttctcagtggagagagcctagatgtgaacccaagtcctcgtttcctctgtcagcagtctttttggagagagaagaaattattcacatgctcttccttaacctttctgtggaacatttccattcctttctgcatctctatgtgtcaaccatatacctacagatcgaagagggtgagaaatggatataaatctcaactgaagccctgcatgagacctggcagatctgtttttcttttcacatcaaattatcagacagacaggcttggaatttctcttacatgctgtgtaatttgagtcaagtcacttcatccatctcttccttggtttacttatctgtaaagtgggcataatgacatcaggatagttcaatgaaataaacatgcaaaaagtacccagtgcagtgtcaacttgtattagagactcagtcaagggtagccggatctaggaagtagctgcatctctttttccagtttgcggctttggctttcaaaaagtggggcctgtttgtaaggcttcccctcttgagttgctggggagtctctctagagtagataatgtatcttggggaacaattagactccttcaaatacctttctttcaatttgatcttctcctctttgacatgctaggattacccctctgtaataagagccaaaggaggcccagaaccactgggacctttaaacaggaaaacaagttagcattcagagagagcaagcacctccagaaaaggaagccacacagatctactgtcggcctcttgctccttccccaggtgctcctcaaactctcaccttccgttgagctgccactcagtgaacaagtagaagtgataaaggctgtgaaacctgggaaagcacctcccatttttccctgcacagaggaaggcaaaatcaaggtccagagatatggaactcgggagtgtgggttgtgtatggccagcctggacatgaactcagtgatcatctgggtcaaacagctcactgtgcaacaggaaagttgaggaccagggtcacacaaaattaaactgtattcacagatgatcccctctaaatggtctgagagatcatttggtccagcacttcccattcctggctgcacctggaataaccagcttttaaaacatccttctgcccaggctgcaccccaaggattctgatgttgtgggtctggggttggcctgggaacgggtgtttcccaaagccttctcaggtaatgttgaaggaccactagtgaaaataattactgatgtagtctgacatcctcttgttctgcagaggcccaaagggtaaacgatgttccctgcttactgagctgggtagtagctaagcatttggggaagttccggtgccccagctctgaaggacccctcttccatgctgacttcctctgttcactccaaacccctgggtgccacaggtcctgacatttcattttttccagtgccattcctgtgtggaaccatggtggtccccatctttacaggaggcacctgatgtcaaatgaatctctcggagttttggagagagaagcctctttgaacaggaaggattataagaaagggaagctcagctctaaggcattcaccattcactttgccctgggctagtcctttagaaagatgtgtgttcctattacttcaaaacccctcaccttgagatccctctgaaaccagcactggctgcaggtgtctccaatgaggagaagagaaaatctccaggtactagaggactccctctatgggcaacttgtatcttatctacctgtggctgagggctcgggaatccagtaggtatctatttctctccgcaccagctgccccttctctagaacttagttccctttccctaaggttctcctaactttcttcttactgcagtaagagctctgcttcttgccttggtgcagttactggaaatgctcaactgtgattctgacatcagcagctgagaaccgacttgtaagttccttggcttgtttgaagatctgtaagtgggaattaggaggtcagcgttcaggtcctggtttggcttcctctaagctgtgtgacctgtggtctctgacttaaccactggggcctcaggggagagggtttgggggatggttactctcaatgtccccatctcatgggctgtcatgggaccaggtgagacaatgccgggagaagccgttggctgaggtcagaccacagtgcacgggtcagcatggttaggaggagctagaaagtgagagatgtgagggattagtgcaatcaaggtcattcctggaaaggtgcttttattatgatcattcacactgtagatgataaacagtgatggagttagcaaaccttttcatgcctgtgacctcactggagttctttgatgttgggacttcataagtctgccaaatcctgccacttactgctttatgaccttgaccatttaccgcttctctctggacctcagtgttctcaggatgcaaaaggagggtcaggggtaaaatagcgactttcaaactgtcaggggtaaaatagcgactttcaaacttttcaaacttctgggacaagggtgaagggcaggactctgcctctctccttcccttcaccttattccacttaaattgtgtgattctacaagcttatgtttaaaggaatatgttcctccattacaaagagtttaaatggatatggactgacattgaggagttattgttaatcttgataggtgtgatatgatattgttgttatgtttttttaaagatcctaatttgttagaaatgcatactgaagtacttgtgggtaaaattatgttttgtctattttgtttgtttatttgtttaaaaagctccagaaaaaaaaaaaaaaaggttctgggggtagtggttggtgagagattagcaaactgataacaattgttgaaaccaagtgattaaaccttggagctttaatacatttttgttcatgctgtggtgtgtgattgaagatttccataataaaaagttaaaaatactaaaagtgtttgagagccacaggaggaagtgaagtctcagttccctgcgtgttctgtgacctgaaaggtttgcaaatacggagaccaccgtttagagagggttagggactcccccaaggtcgcacaaagattagctgaaagtcgtgacacagcccaggcttcagatctgaggagctccccatcccctcctctctgtacacttgcaaactcaagtgaaaatgattatccagggagaactcgaggggaataaaagtgatgaggggagccttaggaggagcatggagaaggggcaagtggaggcttgctctgcaataagaagcttttgagtgagaaaattatttgctgtatgggactgccctacatattgtgaaatgtttagcatctttggccctgtttatgagaatttcatgggatctgttagtgattgtgacaggcccagaagtattgtgacgatacacacacacatactcatatactcacaggtccacatacccttagttctcgtttttctggttccttatttctctccatccctaactacctggagagcaattctagagccttctagaggcctggggcagtgacctgcaggagcatatgtttactgaggaagtattttgcaatggttgatcacaggactcaggaatcaaactgcctggtcaaaccctgactattgcacctgctggttgtgtgaccttgggcaagttacttagtatctccaagcttcacttttcccctctgtaaagtgcagataatactagctgttacttcatagggttgttttgaagattaactgggcctccatgtggaaaatgcttagtaatggaatctagaccatgcggtaacccagcaaacgttaactcatatcagtattatgtgtgccagccattgccacgcattatttctaataatctcaataactctaggagttagacatacttatctcttttggcaaagccaggaattgccttttcctcccttacaactcaggaaagagttattgctgtcatcttaacatagaaaaattaaaaatttaaacaactaaaatgaaaggctaacaagataaacacattattgtgtcatttaaaaaaaaatagtgcatgctcattgtaaaaaaaatctcagaaatgcagacaaagaacaagagaccaggtaaaatttgtctatttcctgcccaagcatgcaacaactattttttgagtttctgctctgtgctgggtacagttttaggccttgaggacagaccagtcaacaaaagagagaaacatctccgccctcagggagtttatattctgggcagtgggtgttggggagaaggtggagacagactataaatgaataagcatatatatcccataatgtcaggtgaatgtttgtaaagaaaaagttgagaaggaagtctaggaatgctgtgtgggagtggggatgcaggaggagagaggagtgggatatgaaaagagtggtcaagggaggccatcatcagagtagctttgaagaagagacctatgagcaggcctgaggctctctggagaaggccatggtgtatcgcaaaaggaggagcaatgctttgagctaggagatgtcagttctagcactagtttgctgtgtgactttaggcaagtcactctccctctcagaaccagttttcacatctgaactttgtggtactgtagggattatttgcactaaagacacttctacagacacttcctaggattctataatcctcatcaaggctgtcctcagacaaaactgtgaagttggcaatagttccagttttcttccttttctggtgtattttcctccactaggtggtgcctgtgcctgtcaccctcaggggccaagtgtggacacattttcggcttccacacctcagcaacactggggaaaaaagaagatggtacaccttcttgctaagtaccattgactggtaacaacttggaatgttactgctccattggtggatactcttttaggacttcccagaaagctttgtgtcacaaagcaatgtaacagtggtagaatttctaagactgactgaagacattatttggggaatattggtacttcctgatagctggaatccatcctattaataatataactaattctagcccccacaaatatccagaaaacttgctgagtgactcccagtcatcacttactgggtgaatgctagcatgttcatattttgtaatttcttaggatataaaggccattccagacaaattcctggactttggaatagaccaccggccttgtagtattgcttatcattttaatcagataactcagtgaattaaaataccaaaactctggagtctgtcatcattttccagactattttccttcagaggatccctggaactgtcatctctgaagtatatccagcttcctctcaactccctccttcttctctctcttcctactcctcatacccagcttatttgctttgaccacttggatttttctccaaacaagataaagaaaatgtgtttgttttttggtattatttgccacaaacccagggtccacagaacttggaagaatataagaggttcccctcttctactttagattgtagagaaccctggtcaggtctcagattccaacccacttggaggaagctaagacataaaagctggtcagtaacaacttggaatatcgaagtatgtgagtaggggcagcgtaccactagttgctgagacctgttatagccttgtgtgtttaggaagccagtggtccaacctgtacctattatccttgtaatcaagaagtcattcctatgcctgtcccgtatccattcctgttgctctatgaatctgaaaggtggctcggcagaatgtggccaaatgcatttatatggagggggttattttccccagtgtgactgcagatctttcagctcagaggctgatgaatgaagagagaaggctgtgttaataggctaatcttaagatgcaaggcacccaggcagaaaacataaaacattgataaatgtgatactcagttttgtgaagtaaacttcatttaagtccaaagaaacaaggtgtgtcaaagtccaaggactcatccaagccatttatttcatagatgagggactgagggttgatgaggaaagtggcttatccaagtcagtgaccaagctgggtaaagacgagtaccattgactgataacatcttaaaatgttactcttccactggtaaatactcttgcatgactgcccaaaagctttgtgtcacaaagcaaacaacttagaatgttacttctacattggtagatcctccattggtagatactttaaagtcttaagccaggtctgggtccacttgtctcctgactttacaccctttcccatagattaattacccatctgtctactaatggtagttatttgtccagactccactgggctccagactcacagatccacctgtctactggaaatgttagcacattctacaaactccacacttccgaaacaatcatctttcctccaaaattccttgcatcctcatcttggttggtgtcacccactctacattacatcatctaccatattcaatcagtcatcaactcctgactctcctgcttccttataatgtttatagacaaactctcttctctgtaccttaaatcctctttatttcttgctgtgactatttccttagtattataatgcccacttctctgaaattcaatccctgcacccccttcaacctgcccaccaacatccaacagtcacatctgtccagaatgcaaatctgactctgtcacctctagctgaaagctcttcaataaaatctgaattatttgaaattcccccaaatgcacctggttctttaattatcactttttttacttggcttatcttctatttccagtgcaccattttgcagaatgtttatgccttcccaggattttgccagagttttctctcttctgagaagcccttcataacttccccaaagtgtaacttgttccctaccttgttcatctgttcccactatgctttctgcacacttttatcaaaatacctggaattatgacatttaattgtgtacatatttgagatcttatccatctcaagttctctattgcctagctcagtatctgacctataaaggggctatatgtatttttgtttaataaatggataactggataagagaaccagtttaatatctaatgattctgggagaaagagctcaggaaccttaggcatgttgcattacgtaaccaaagcacatgacctagcatgtgcatcactgtcagaaacattacacagtggttaattccatttacccctgagcaaagaagtcagaagggaaaagaaatctggccttccaaaacagaaggggaaggggaatagtatatttaagggccttctcagctcacattgggctttctaatccaagccatattttggccttggtcttcgcctctcagccctgtgcctgtttgcaaagcatttgttttgtgtgtgcacggcagcacataatcttaagctttgcttgcctctcaaatttccctctctcccccttatcagtgtccttctgagcctcaagtgtcctggcagtcatatctgttgcttcagtcttcacccatttccctcctttctgttaatggggctttctatctgctttccttgattttccttgatcttgtgagaccttgtgatgacctcaggatctggaattctctatccgctgtttatatacccctaggagagaagacacattctcagcagtaataacagtaatgaaagcagctagcttataataagcacttactatgtgctggcactatgctgaatgctacactttgaacactctgaaactgggttataaagttgcatgactccctgaagtaccaattgctaatgggtgatgaaactggaattctcatccacaccagtttaattttatctctcttcatcctcaaggcctgacacattgcttggaacaccgcaattactctgtaaatgtaccatgagagaatgaatatatgaatgactgaatgaatgaatggtggtgccccccagtggctaatgcaaacatttgaagaatgtagaatggaaaggtaaagaaggaagagagggagggatagaggaagaaatagaggaaaaatctgaatgaacattataagatttcaaaaagattggctaagaaatctcagatatgcaaagtatattttatttgcaggtgattttcaaacataaagacattttacatccattagagcatttcccacctttaactagtcctttaggagatatacagttgtccctcagtgtccacaggggattggttcgaggaccaactccctcaatgccaaaatctgaggttgctcaagtccccaacataaaatggcatagtgtttgtgaataacccacacacatcctctcatatactttgaatcatttcttggttatttataatacataatccaatgttaatgctatacaaatagttgtaatgtggtattgttttatttgtattatttttattaagtattatattttaatttattctgaaatattttcaatctgaatttggttgaatccacagatgcagaggctacagataaggaggaccaattgtgcacttatttcaaagatactctgtttgccaaaaatgtttttggattcttgttttgagaatcagtgcctgggacatgtttccccagatatgctcaatggagcctccttgtcatcctctgatgaggggccctgatgcattctcaggcaaatcttggaattatgtgggtgaccatgctgagtgaatatggggttttgaatagaacagtgactctggagtaacaaggctgatttttgggtgactatcatcagagctgattaagccttgatagagccaatattaagctctcaggatgacccctttacagaaaagcccctcaaaaggctgatttaatctgctaaaaacaaatgcaatatcttgaccttccctttcccaaattctaaagctggagtaacagaaactgccttatcaaatctgctcagtttactgactgagaaactgagatccatggatgtttacctgctaaattaagctaagctaagtgagtaaggttaagcagcaaattggcagtaaaattgaaactaaaatttagatctgttgacttccacatcagtgctctttccactgggtcactttattttcctttacagtgtggggtgatagttataactatgggtttatattagtaagattactagaaagcatcatacagctgtttaataacttttttaaagaacttcttatgtgccaatctgctgtcctagacattctttaagattcaatgagaaatgaaagtttattaggaaaggtaaatgttccttcatttcttccttctttctaaccattcacccttctatttcatatgtagttattcagcaatttttatatattatacattgagttaggagataagaattaaaaagaagaacaaggcatagttccatgccttgaggaactcccagtcctagtggtggaagcagactggtaaacagatagatgacatcatggtaactgctataactaagcaattaacagagtcctggggaagcacagagcagaaacactatgttatgaaacacccatgtttatcatgagagtgaaaaagtgctctgaaatttcaaaggcataagtgatcttttccacctggaaggattggggacttgttcatgaagtgaatgtgtatgtatgtagagtgtgtgctctgccttgtgtgggggtatagtcatgtatgtaattttaaacatatagccataaatcaaatgagaacaatcaacacttctggattcatgcctcagctgtagatacttacccagagtatcttttaggagtatggtgttaggaaattattggacaattcaatatccatcaccatctgcatcaagccaatgcaactccttatcttccctcctcatagcatttatcacactctattgtgatttccttggtatctgtctgtttctccccaattgtctctgagctccttggagcagagaccattttggtcttcatctttgcattattccttttacttcgcacaatactagtcatgtcggtgagggctggctaaacaatgttaaatgaacgaacagattagagatggctccaaataaggaataacataaggtgattgaatgtgagtgctgtgaagaaaaggtgctttgagaattaatagcataggccttagaaagaccaaagagtgaaggcagacacattgtgagtggcattgactgtgagatatggccctggtctctctgagctaaccagttacctattgaaatgtatatgcttatcatctttccctatctctcttcctctctttctttccagtgaaccagtataccatctatgccagctttaagtcccttccatgtggctgtccttcggcctctccaaacccattctttttttttttttttttttttttttttgagatggagtctcactctgtcactcaggctggagtgcagtggcacaatcttggcttactgcaacctccacctcccgaggtcaagcaattctcctgcctcagcctcccgagtagctggcattacaggcacctgccaccacgcccagctaatttttgtatttttattagagacagggcttcatcatgttggccaggctggtctcaaactcctgacctcaggtgatccgcccaccttggcctcccaaagtgctgggattacaagcatgagccaccgcacctaacctctccaaactattcttagaaagagctgctaagagctaggtggaattgtaagggatgtgtccatgctcctcctgcaatcttcacctagaatataagaggatgaggatggcacactagattttttttttttatctagtgtgccaggaagttatcagagagcttcaaacaatggagttactggatctggtttatggtttccaaagatcactctgactactatgtgtagaatggattgcatgaggccaagagtggggtctcagttacaacagcatcatgatcgattgctgatgttatgacttagtattttggttaatataattatcatttatttccttatgaatacgagtaccaagtgaaataccagaatagcactcctattttagatcaacgaggataggggagtttttgcacttgggttcagaagtacttgatttgtaaaccccaagacattttctgtaaaaatttgaggttgtgcatatttttctggagtcaaagttcttcttagttgcttaaagggatatatgtcccccaaatggtgacttacatgctgaaaaactgggggcataccaggtcatttcctgaagcttgttcccagctctaaaatatgaacactataggggatctgtgataatgagaatgttgatgttgagttgtcatatcagactgagcaattgcactttccttcatctgtacccttgttggagtaaatagaatttggacctttttttcctctgaggaagaattagtttatttcttagaaatataatctacaactttgtttattcaaactctgctttctgagtttctctgagtttttaaataggcaagtacacttcaaatgtggtctgaagtggtcctgcccataagtattcactgtggactttgaccatgaagccacaaatccagccacctatccacccttccatcaatctactcttccatccattacccatctattaactctccttccctccctttcttccttcctccctacccccttatctccccccactccctccctctcttccttctttccttccatccacccttccatcaatccatcccctttcatccccattcattccctaatccatccacccttcttttctgctatccatccatctatccatccatccattcatctgtccatccatccttccattcttggataaatgtaatcttccatttaccaggctttgtgctaggactggaggaagagttaggaggttccaattcttgtttttatgccgctgtgagttcttaaaaaaaaaaaaatcccctgagacatcttcactgaaccttatgcttccacatagtagagtgtgaaaaccactcattgaaaactaatttgaaaagttaaagtgttctgcctgcatagttctatcatataaatattcctggtagtgctctgagtctggatctagactaccagaggctcctttatcaacagtaatattttagatcaataacagtttctacccttaggttagcaggtactggaaaaacaataggaagtttgaaatggaagcctttctttgggaaagggcaggcttaggtgagaccagagaagggagctgctagtcacttagcctctgggactcttttttcccacagcctcccaaagcccttgtttagtgatgctgagccttcacattctgtgtatgcctctggatgtatgatgtagcagaatgcccttgtggcatggggttgtttcagtttccaaagcattttcgacatctacctatcatattcccactcgccttgtaaaacaagcattttcatttaatacagtgaggtctttgtattctcaacaacaaacacatggtccaaggctctaggacacaacctgcctttttctccaacccccactttcaacccccccaccactctgtccacccttacaaagcccagtgttagcagaaatatctgtttacaaacaagtgttccaaaagaacagtatcagtagctcaaacaagcctctgaaacatgcctctgattctatacttggaatccctgtgaacagtgggtatcactggcagcagctttcatggaaggcttcctgcctttccatccttccgtctgtcctcatgtctgactttctctgtctccttccccttattcattgaaaccatggggaggctgaactggagaggcagtcagatgctggcctgggcattatggatatctaggagacaaagcccagacagggagttgcttgcagacagcaagacaaacccaaacacatccgcctgcagtgttatctgaagcagaagctgattgaagaaggattattaattgggtggatataatagtcacatgataatcatgcagctctaagcctttttctaaggtttcatcgactgaggagctgctattgctgctctctggaagttgagtctactctagctccctattacctatgcataacagctaatatatttaatgcataatatgtgtcgggcactgttcataaaattttgcatatgttaactctttaatcctcaccatgaccctctgaggtgggtactattattactgcaattttccagatgaaagatgaggaatgttaagtgaatttcccaaggtccacacaagtcagtggtagaagcaatcttcagagtgcatattctaacccctccaccataaacctctctagattctctagactggttctaaattctgtagcctcacattcaccttcctccctaagcattgtttactactgtaactttccctcgttgcttccaccagggatgctaaacctcaccactattaacattttggaatgcataattccttgttgtggagtttgacagcatccctggcctctatgtactagacacagtagccacaacctcctccccagtgtgatgatcaaaaacgtctgtagacattgccaaatgttccctgtgagcaaaatctactgactgagaaccactgacttacatggattcttctgattaaactgaattacctgatactcctaaaacacatatttctccctctatgctttttcacatttgttttcccctcttgagcttacagtgttcttggcctcctcctcatcaatcttctctgtttcatagtctttcagttcctcagcatcttttacagccagaggaaatactaacctgtctggttactgatctgcttgtttctatgccttttttgtttaaaaaatggtcaccacttccaaacttttgatttaaagtcccttaaagatccctggagtcttgagtttaaaatttagtttgtactatgcattccacgatgttttacagagtctaccatgtatcagatctcaagctaatcactgaggatatgaagtcaaaggagataaaatccctttctttcaaggagtttatgagatagactctcagggaaataaagggatctgaagatcaactctccatcctccttcagttgaatagatggggaaaccaagagacaaaaggtagatgacattttctcaaggtcagctagagaccaggatcaaggctgaactaatcatcctctacctagtgcaacaaaatttaaattatgaagccccaaagagcatctaaaccctatttatccatttagagccttaaagcgttttttgagttgagttatttataatttatgattttctaacagatgtcaaaacaatagaaatttagtagtgtatcaaacctctctctttgaaattgtgctcacatttcaccctcttcattaatgagtcttaaggctaaatgactccagattgccacatgagcactagacaggagtcctgagactttagtcctggctctgttagctctgtgactgtcaaaaggaagaccatataatccccagctaatgatccccacccacccccatggactgcctcaaaaaacaccaaagattcattcttttctatggaagaaactttagatcttttggcatgtcattcacaaccctttgtgatctagcctcagacagccattgtacttcatttccctcagttactctgtgcaccctcaatcccatcaaaagcaaatatctttctcatctcgagagtgacctttaggtggacttcatagctcttgccattgctgatgattcaccttgtgctagaaagtctttgaccagcttctccttccccaaatcctgtacctcatgcaaggctcggctcttttgagactcatccaggaaaacttccctgcaccttcttgtcagaatcaagtagtctttctgctgagctctatttgcttgtacctctactatagaactcgctttattactctttatttatcattaaaagcagccccttgtcctggtgtagtcagctttcccctgactaagcagaaatatttagaagttaaaatgtgaattctggagtctgattgcttggggttgaaccccatctttgtcacttggccaacaggttactcaggcttaggtgagttatttggactctctgagtctcagttttctcatctgtaaaatggtgataataataatatttccctgcttgcattattgtgagagttacctgagttatctatgcaaagagtttcgcacaatacctggcacacagtaatcactcggtaagcatcagctgtcattgccctccctgcctagaaaggtaattctggagggcaccagccctgcaaagtggagatctgcctgtctggccttgtccctttcttatctccctttgccatctctctcctgaaaggctcaccctaggctgtgtgggccaagatgaggtgatggcaggctcatctgagagaggagctttttcttcagagctcagcccacactgtgtgggctgtgtttttatacaacttgctgtaggcctgcatcaggtatgaaatttacatcatttgacttgcccatgtgggaatcttccccattcctcttggctccttagaatgggtacaggtgttcagtgcctcctcctcccaatgctcttcagcagatgaggaaccgaggtccaaagatgaaaacaaggctgatgactcacctgttagacacagttggcacagtgcctgaggtctacagtacttttgttaaactacaaaaatggattaattctttcttttagaattaattaatttcttttagattaatttcttttagaatcagaagaaaaaataatataataataatacatctaaaataaggaatccagactctcaattacatttatttttataacaatgcaatcataaagcataattttggaagaaggagcctatgaaagtcatgaagtgaccatggatgaaaagaaatttgcccaagattaatagtggcaaattaaagcacaagttcccgtcttattaccctccaaatagaaatttttttctctgcattttcaagaaaactggtagaatttattttaccacagtcatcttctttcacaaataagaaaacggacacctgagagagagtgtgacttgcctaaggtctcgccaacacacaactaagttgtattttcctaactccctgttactcctttcactatttatacattcaaacctaatgaccactgatgtcaacctcccattatatagatggaaacatcgagggccagaaagttgaaggggcttatatgatgtaacaaggaccgccactcttgcctctaaatcagggcgccctccagtaccaagaggagcgtttgaaaactggatacacaattttgttagacagcaggaatcacttcaagagatctattatacaacatgatgactatagttactattgcacacttgaaaattgctaggaaaatagattttaagtgttctcaccacaaaaattctaataagcatgtaagataatgcatacttaattaacttggttcagccattccataatgtatacgtatttcataatatcatgttgtacagtattaatatacataatttttgtcaattaaatacaaatacaaataatacaaacttaaaagaagaagaaaagcttgtttgaaaccaaaactccccccaaattaggtttcctcacaagccttgggcacataaatctttcatttatttatccattcagcaaatgtttattgaggacttatgtcctagccactatatggagggttctatatagtgatacagggtggtgatacaggctctatatagtgatacagggtggtgatagacatgtactgtctgttcttatgaggcttacagtcgagtgggggagagtaccattggaggttgacctcagaaatgagtcatactgtcaacagtgatcattgccatgaaaaaaaattagatcaacaactaaacaaccaaaaacagtattaggacctcagaaagactcaggagaaaagagaggctgtgccctcaacaactacatgtgggaactatcaagaaacagcccaagtgtcctgtggctggtacagaaagatggctgggtcaaagactgactacatctgtgccagatagcaggtgctcatcaacacttatacactgatggtggagactcatgaagactgaaggtctactggaagaagtaatactggtattgtcttgaagatcagaaaagagaaaaggacagggacaatagggagacatttctacctgtaggaaacagtgtgggccaaagtgaggaaatcttaccagagtctgtctacacactcagagatagattgagaccaatttctgaaatgcaaaattgttgttggtctttattctgagagcatcagagaaagaggtttgtctgtttgggggaatagtgaaaaataggattttaggaagatgaatctggtgatgcttcacaggctgtataagggagcaatgaaacttctggaccatgggccagttagaagagtgttccaataatgtaattatgatggattaagcaccagctttgttttttcataccctttatggtgcataataggatgctcattttaccaagtaacagaagaaaagctcagaccaaaattatgacttgctctaatctctgctccatggtagcagagttgatatttgaaatcatatctcacaccccagcttggaaagataaatatccctctctcctgttagtctgtgaacttgtggatagaatactatagtatccacataactgcatgtagagcattcattcaattagagtctgttgagcacctactaagtgccaccattatgctaggcaatatgtgatatattcttttaaactttaaacatatgtgcatgaacatacacacaagcaaagttacacagagaaataaaaatggagttgacaagatgagccaaggtctgattatagcaaaactgggagaaagttaccacatcagggaagcttcctttacttctccaacagtattaatggctattaatgtcttgatctctggagtactgagaggaaagacccccccccccaatatttttattagtgacattaaattgacatgtccatgtggctttgcagggacatgtaaaatatgtttctgagcttattagaaacagttctctccttcttcttcaattctgtctcatttctctgatacttcccatgtgcatttggttttactttcctcacatacatccttcatgatgcccatttcttggatgcttattgtacaccatgcactttgaaaagtgttctatgaacagtgtcttattacatccttccaaccagagctgcctcaaggtcatcacagagccagaacttaaaacagctgtattcactcccaaattgtgctcttcactaccagactgtccactgtgctttcactcatgcaagcaccctcacatgcatttctttatttccccttaaatgcatgcatacatataagcattttgtcaacttaattggtgctttctacttgccaatcattgtgctggcctggaaatatgagtggtcagtcatttgttaaaatgttgtacagatgattcaaatatgaggttaggtgtgaaaggggatgattaaataaccagtaagagaatttccagccctgactctgcctaattcaatgaatggtgaagggtcagtcttggggctgccatgcagggtatgacagcaggatgcactggtccttgaccattttctggcaagtggtatcattgtctccaggcttgatgagtgagtggagagaggagcttgtagattctcaagtcattaaaatgaccgaaggaaagatctctcttccaagacagccccaacatcagccctccttagtccaccaggatctggtttgtgctgtgcaactttcaaggatgaacaatagttcatattgttatagtgtacttctttgaccccatcccccacctcttctttctccttgatctttttttcttgtccttccccacttcctttcttacgttgatgtgcaccaattttatatgcactgatttcatcgacaatgtgtgaaaaaagagcaataaacatgcatcttcatttcagagaacagtgtcagaaaggaacctttatgtgtgtgtttaacagcacaaaaaggggggaaataatcccaattctgaaaaagaaggaaagatattattttttgtttgtttgttcatttatttgtttgagacggagtttcgctcttgttgcccaggctggaatgcagtggcgcgatctcggcttactgcaatctctgcctcctgggttcaagtgattctcctgccttagcctcctgagtagctgggattacaggcacacatcaccatgcccagctaattttttgtatttttagtagagacagggtttcatcatgttggccaggctggtcttgaactcctgacctcaggtgatctgcccacctcagcctcccaaagtgcagggattacaggcgtgagccaccttgcctggccggaaagatatttattattaacacacatttttaaaaagtgtagctacaacaatcccattctatgcaaatgagcctttggattctcttactaaatcctcgaaatggcactatttattaagtacttattattatcagtttacatatgaggaaactatcaaggagataaagagattttgtccaaggctacacagctaacagggagcagagctgagatacacagatcagcctcacaccactgtccatgtgttgtaacacttgttttgttgccagtggccatgtgccaagtgctgtcacatttgttttatcattagttcccccactacaactgtcagaggaagatgtatcatccccattttacagatggggagactaatactgggaaaggagccctgactttcccatccatagctagtaaatggcaaagccagcattcgaactcagatttactggcctgtaatcccccaacctttctacgtccatgcagactgcttacacatgagcaaaggaggaaggctggagacacaagagccagagggaattacagtttgccatcccaaatgtaccacataagtctgtgtattattaaaacttatgggtttcaggaaccctcaggcatactactctcaagcttgcctcacatctggatagccttaaatagtttacaaggaaatatgcatacatttatctcttttctctctcagaagacatctgtgaagtatacaggataagattcttcatcctagtgtacatgtgggaaaactaaggttcagagaggtgaattaacttgtctgatgtcacacagctagtaaaaaaggtgaacagacccatttagtgagggtgctttcagataacagttcctggcaaggaagaagaatacaggcaggagaacagacacaggtgccatcaagggtgttcattctactgctccatgccgtcctgcaaaaggaaatctggtcctcctcctacacttgcatggccaacacatgggaaacacctgagctaaccctgacttggagaattgttccatgtggttactttcaatgctcctgcctctcttgaacaagacacagagatgtccagaacccagtataacttggtataatcctccagtcctgtatgtctccctttaagcctcctccttccactgagcctaaggcaaatcttttgacccggggtggacccggagggatgaggatgctgaggagcagtcccccaggtaccctcctcggtgatatcccagccttcctctgaatgcctgatggtgctgagtcctccaggtcattttggtgggtctcccccccgactgaaccaagtgcagggaccatgggtatacttaacccaaatctgtctgttttaatcactgtcctctggacagataaaagctttccataggattgctctctcaagcattcctctgtggctttgatactagtgattaaatcatggaagggaaagcaaaacaaaacaaaacaaaaaagggaccagctccaacctttagcttttaatttttttagcctcatgaaagaaaccagattgttgacctaaattccccctttcatcccctcatcctctcacctctgcttgtattctcctggcagatgtcccacagctagtgggcatcctttaattgaagggtctgaaactgccttttaccctgccccacaatgaccttacatctcccgcagggggaaccaaggctgggatacctgtaatcgctgggatcttggagtcacagaatgtggatggaagggacctctgtgaccatgtggtctaacactcttatatcctaaggaaaggaagtgaggaagcccagagtagggagctattcacccagggaccacagcacagcatggcagacctagacattagagccttcatggtggattgagagcaccaatccaccatggaaagcatcttggtggggagctttggctctggagtgaaagagatgagagttagaattgtgattctcccaatccctcgctgggatccttggagggaaaatcaattaacctctctacatctcagtttccttatctgtcaaaagaatactaataaatcccacttagtctgtgcttagtaaagagactactaaatagaggctttcagaaagtgtttgttattattatcattatttatttaaaaataccactttttcacagcagaaatgtcctggtggagttttttctccttctatatctactctcccaatgagagaaaacaaacaataatacgaattgcatataaattgtcatcctttgctaattatctccaccccgccgcccccagacagtgatggcagaaagtcaaatgttatcagagataattttatgttgacttaaagcttcccaggaaaacatcctaggcaagaccacaggaagaaagcatagctagagtccccctcagctgtgggggagctttcaaatttgaaatcaggagactcgaattccagtttttcctaccccttagtgctgtgggactttaggcaggggacctcgcctctctgactttccagttttctgatctgtaaatagtacctattgtagcagattgctgtgaggattctaggagacaccttgaggtgaggaatgtttcctgtaagtgatgaacacaccaccaattttgctatctttctaatacaccttgctctactcaaaacagcaattgagtaaattgagacattgcattgtaacaagagaaaaattctgaactgggaacaggcattaggagataagatagattttagaaaaatttcagtgggagagcttagaaaacttgttgaatgatggtttgctagggcaggcataacaaaggaccccagcctggctggcttaaatgacagaaatttattttcttaaaattctggagatcaaaagtccaagatcaaggtgtcagccaggtttgtttcttccaagacctctctctctctctctttctctctctctctttctctctctctctcactggtttccagatggtcatcttttccttgtatcttcacatagtcttttctctgtattacttgtgtcctaattttctcctcttataagaacaccagtcaaattggattaggatctgccatgtcacctcactttaatttaattaccttttcaaagactgtatctccaaatacagttaaattccaaggtactggggttacatctttaatgtatgaaatttggtggaacacaatttcatccaccacaatgaaaaggaaaatgggaggcagccaaaagcatggcagcaagcttgggaagaaaaatcagtatcgacattggaagttagaggaaacctgagtcagaaaccatcaggcaggtaggctggtaacggaaatccagatgtcgaaggacaagctcaagtaagcactccagatggacaactatgcctggacaaactttgggttctagcgaagtgggctgagcccagtggaatagattactctttggtaataaagaaccatcaattcttagttaattgtttaggtccctacagaagaatgataaagacagcagcctcctggctttcaattcaattcaccttgcttgtgggggtgctgcagaacttacagaagtatttccagaggaggccacgcctttaaacagcctacaacaaaacatttggcctttggcacttaatgtattgaccatgactaagagcctgggtgtgggaattctatagacctgcattctgagctgtgttgctttgggcaaccatttccctattctgagcctcagtctatcctgaagagggagcaatgctgatagacttgttgtgaagattaagcaagataattaacgtagagtaaatgatagtatgttctcaataaagagtaagatactcttatagagaaggcagaaatagggaagtatccccctgctccctttctttctttctttttaactttcaataacaaactctacagagcacttacaacataccagattttgggttggatgttaggtatttataaatgaagcaaacagccacatatgtgggaagcacagatcttgaatgagtaattactcagtgatgaggcagttttaggatggggaggagtatgatgaatatacaggaggaagatttgttggtgcctgggtggcatggggtcgtcagacagacttgtcttggggtaatatttaccatgatgatctttagagaatacccctaatgcccagagtattctcccacactctgtacagccttagccaaggttctgagagactctttccatgcctttgagcttttctcctttgtggatgttcttcctttctgggatgagattgaatgagtagatgagaagaaaaagaggcaatgaaaaaaatagacatcaagcttctgggggcctatggaacccttttcacatccagcctagctgcaggaagatagggtgcattagaaagatcagctggccagggttccagggatggttccgtaacaggaggaccatggcaggctcctttcctgctgcacctcaacctctccctctgtgcagtgtgcccagacacactactttaaaagggctcttgcacgctttcattgtctagttctatgtgcttatagcattgagacagacatacgctaattatatgtagattgtgtgcagaattgcatgtggccttcggttttgccacatgggactatatcccctgggatcatcctctagtcccacacagatggtgctgacttcagacaaattagcaccattttttttttgtactatgcctctatctttatggagaactgtgaggaagggcagtgtggagacgtgggggttcttttgtgtcctccagagaacagcattgtgtgtcctgtatagagatcctcagaggagacagaacctaagcatgcaagagttgcgaatgacataaggcatctaattccaatcaacacatatttttgagcaccttctccttacaaggaaccattctatcagtgaacaaaagagctcttaaattctagcaagggatcatttttatccagacccctccttttacagagaagggaaattaggttcagcagcataaaggaggtggtatgacttgtcccaggcaaggttacctgacaagtcaagctcagatctctggtgccaaacttctggttctgagctggtggtacaacgatgcttccctttcagaccctaaaataagactactgttgattaagttatgttcatatagaaataaaaccccattgccaccatacacccccaaccttattgaagctcggtgattttctttcactacttatactccaggtaaatatttccctctgaacttgtgaagccgctgcttcaaggttctcatttcccttaatgtgtttctttttggttccattgaaaaccttctctttgcccttcctctctgcctcccatggctaagccaccccttatttcttaactcttttgcagaatctgccttttctcacttcttcccccttctctcaactgcaaacagaggtggcctgagcctgggtcccaagccccggcaaggttctgaactgagagcaccctacagatgtgtaaacattttaccttgctaaccaggctagctgccttccaaaggcaacaggaaaaccagagactgggagcccctggcaaaataaaaacctgcagagagagagagacagagaaagagagagggaaaaaggatcttgttttagattttaattttctcattagaaggccattcattttcttttcatgagggatagggttagctgggagagagagagaaggtgagctaagaggtgggaaggacatgaatgtcatggctccaggaacctctgctctcaactggttccataacaggcagcaacagatagatctggcgcaactcacttcaaatctggagttggatcttaggcttttgaaggagtcagtggggaggcagcttttaatatgtagtctcatgatatcatctaagctgacgggatctatgatttctaagaagggtttgccagtgggtttgaggaggacctgggcttttttgagccttccttcttgatatgtcgtgcaagatgccttcagggtaccctctctttctggcctttctattttgtttcccgtcatttcctccctccttttcatcctctacatcacccctgaaccctccagcatcttaacaatgaactctcatttggacagccgttgtatgcggaggatgtcatattcactatgtcttttaagtatgacaatatatttagagatacagatgaaggaattaaggcttagaggtgaagtgattttgccccatacgtacaactagtaactgctgtcatcaaaattcaaagtaaattaccctgagtgcaaagatcctgatctttctactttaccaagaatacattttattctctgattctccctgtactttagtcacagagacataaattaatgcctttgattctgtttgtccttaaaatccctaccctttctcgtctccggctctatttagaatcattcccatgcctgctgtagcaaggtgctggagaggttactggaatgacacagacacaaccattgctctcgagaagaaaacagttcggcagagaggggataatggtgagaacacaggcaactccaaaaccgaagagcacatgtcaagtttcctaaaagtaaaaagagttcaaagaagagaataatcactattcacagggaagtcaggatgaacttcttgaaagagttaccttgcatgctagtcattgggaaatctagaataaagaaaatcagacttggacctaatatgtgacacagaaccttacttaacccgctcctttaccagatagagaatcaggacccagaggacaccagaggaggcatttggtgcttcactaaggttgtcctgatggtaagagcaggatgactttgtaaggagactctggccatttcctgaaaaatggctgagcaggaagtaggaggagaggtgtagattggcatagatgctggtccaagactgctggccatgtcagctgctgacaaagagatttacaccaattctaagctcccactgcccacagaggagtgaagactgtgtgggcctcctctattgattttgctggaagctctccttgctcatttgatgagcacttatagcaggtgaactcccagagttatggtgactgcaacaattctccagctgagagtagtcactgtccttctaaatgagcatcttttattcactctcctctccctctctttcttctcccacctggcctcatacatcatctgacacttaaaatacactcttaattagaaagtcctcttccccatccaacagctttgtctatgccagggacactgggtatattccagaaaggctaggaaatgggggttggtgagcataaagataattagatccagagagaatctgctaacctacttcctggggttcccagagtaactatagagatgcttggcttggaacttcctcaaatattgaactcaaatttgtgacatgccccaggtaggtggcatagcccagatgcctgatgattttggtgaggcagggggagctgctatagaattagggcctaggacagtgaatccaaggatctgatggatctaggatccacttaccaagcagttgaccttcaacctgtctctctatctcctttaacttccatattctcaccagttaagtgagaaacgtaatgtcaccaccttagggatattacatggattaagttagtgcatatacagaccttagcacaatgcctggcctgccatagaggcttgggagattttgctcattattattaactattatgtaggcatacccaatttatgttaagaaggcactcattatatgtgtgtgtgtgtgtgtgtgtgtgtgtgtgtatctatatctatatatctatatagatatatagatatagatatagatatagatatatatagacagagagagaggcatcagtgtaagaagaaagctgaattgggacacaggggaactgtcaatgactctgtgacataacaaatgccttccattctctgggactcagctctctcacctgtcaaacaaagggtttggaggtgatgatctttgaaaacctgtctagtttagctctgaagtgtgttttctttctttggggataaatggcaagattcctgttagagaatgaagttccagcttttcaggtcctgaccctcacttttatgccccaactttcctgacaatttaatgccactgatcatttaatgactgctaatggcagatgtacactcaaagttctggtaactatggtagggacctcccttctaaatgagcatcttctgttcgttatcatctccctctgtttctcctttcacctcgtatactatattacacttaaaataccctcttaattacaaagtcctcttccccatccaacagctttggaaaatggttttcagatttttattattattgctgctgttgttgcaacaacttcattagatgaagtaccctttcttcaaacaaaaatctttcttgtatgcttcatattcaaaaccaataaaagttaaacttcatgggttaaaattgtgatgaaaatgctccaaacccaacttactcattctctcagctcctccagcccttgccttgccctcgaggtggtcccagaggcaccattagcaactcctaggatcccacagagcagttggaaagcgatgagtctaggataacctgatacaaattttattagagaaaaataacttaaccccccctccttttccatcctttatttattcatctttctcttttggggccacatagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacaggtaagaccttactgggctaaagatgcccagttgaaagttgaacttgatgtcctccatattatagataaggcacctgaggccagtgggtgatatggggattttctggttcaaccagcagcttcatgattgaggcaagtcttttactcgggtcattgtggagaccataggtaaacccagtttattataaaaatatttattgagtgcctaccatgagtcatgagggaagcctgagagccctgttttctcaaagagcccagagttcaaattgagtgatataagctgagtacaaatagctgttgtattgtatgacatagagtgggtgagagttgcacagtccaatatggtagttcctagcaacatgtgcctacttaaatttaaatcagtcaaagttaaataaaactcaaaattcaattcctgagtttcattagccacatttcaagtactctagccacatgggactagtagctaccatactggcaaagcaatatgaaacacttcagtcatcacagaaagttctggtggacaggctcaaagaggtggggtcgcatggggctagaaaacctggccccatggtctcagctctctgtgacttcttcattttgtaacttcttagaagctgtttcttcatctgtaaaatggggagaataatggtacctattttgtcaagttgctctgaggattgatagagagaagacatataaagtacactctcttacagcacatcattaattctcaatagtatgtctgtcattacttgtctaatgaaaggtagtgtgctgtgtttagggagtgccctagatgatcaaagagaaaaagttgatttgcagcttgactatatcagggaagccttcttgagagaggtgacatttgagcaaggtcttcaagaatagctctaatttgaaggatgttagaacaaatctagagatctaatgaacaacaagatcaatacatttggtgtaatagaacaaatctagagggctaatgtatagcatgaggactataggaaataaggttgaactgtatttgggattcatgctaaataaccagattttaaatacttttggcacaaaaccaaaagaaaatggatgacttaagataatggatatgttaatttatttcactataataaactgtttgctatctatatgtttcccataacatcatgtctaccttaaatatacacaataaaatttacctgaaaaaagaataggtaaaattttgacatcagaaattgggtggaggaagaagggaggacactccaggcagaaggaatttctcatctactgctaaaaagaggacagaaaagggggccttcagtctaatgcctcacttagcctctgccattgctgtcagttgcaaccagtaatccaaaagtagagcccaaaaggtgaactcaagggtaacctgtattaaatgtgggacctggaggaactagattcaagctggagagaccatcaatatccactttcttgtttttcccagattcacactgaacttttctattctgtccaacacacaggaccctggacttgctgatggctcgagcacatttgccgacctctgcaggttttctgctgactcttctctttatgtctctctcaaaagagcaagggcctcccgtgcgtgaacaaaatacctatgtgcaaaggaatgaggatgctggcaggagaatgccctgcctggcagcaagtcagaaagcacctcagctcagcttcccggcaccaggagggcccctggactctcaccttggctccaagacatgagcagcccatgtgaggagaagccttggtgtgtgaccagtctcttctaggtcacagtgcattgtcatctctgctttcacttgggcctttccaaaacttggcaagggagtcaacacagaggttaacattcacatttgactgatgggaaatagaggaaacttagagagtggagtaacttagctaagttcatgggtcaagaaaatcattaggctaaatcacaagtgcaagtctatgatcagtgtgctccaccaaactagactcccaagaggtacctctgtgcctggtgagagtgggcgtggggtaggatgggcataattggaagtcatccattcatttgtacatcgatttatttgctcattcattcactcattcattcatgcaacaaatgtttatgcagcacctgccaagtgccaggaaagtggatacccttagccctgttttgctttgaaaatttcaagattcagaaagatgaagggacttacctaagctcaatctgctaataaatggatagcttggattcaaactcaagactactaggtccaaacctcccatggaaggaggatattttttaatctaaggaacaataaggggcaaaattaaaagacaagtgatagggagagtggcgctactaaagttttggggaaaaaaactgtgtatcattgagacaggatgaagagcagctggcctttgcagagcaccatgctggtgtggaggggccatggggccccaggttccagacacctcacaatcagcagacagcactggcaggttccaaaggcctcctcttttctaagtcacgggaatgcatgcccagagtgtctgtgagcgaccatgagccagctataaccgctgtgaccagggcttgtttgtttgctagctgggaaagctgtatgccctgggtgaggcccaccaggtcacgtgtcatctcttggtgaggctgggattttctgggttctggccgattcagctctcctgtgtgcagacagaaacctgtggaaggttgcagataaatttttgctttgtgaatttaaacaaaaaagggaggaagggaaggagggaggaagggaaggagggagggagggagatagggagggtgggagagtcatgattacatggtcatgacacatacacttcaagctctgaaggcctatcctgtgggaaagtcacagaattattctatatggtttctaagccatggctgtgactacagtgttgcaattacaggaggcagctttgagctgagtaatagatgatatcatctccagtcagaatggtcctttttggggagggctttgtctgtgggtgagtgagctccccttcaccagaagcatgcaagtcagtactgataaccatgcataatgaggccataggtgggattacagttctggtggagacggtggccttgtggtcttggggttgagcactgcacagtaatatcttattccatttcatatcagaaaaccaaatattgactgcttctcttctctttaacaggcatttattgggcatgtctatcccaccagcctttctgctcttcactgggggtgttgcaatgagttggacatgttcctcaccattaaggggcttccactttagtgggaaagtcatatagaaacataagaaactctgatttgtaaatttagagacacacagtaggacaggagactgaaaaagcagagatttatttgactaggaaaacaaggcaaatcagctggagggggcaagatttgagtaggcatttgagaataggcagcctgctgagaggtaaagatgcagactccatcagtgagggtcctagcaggaaacagatggcacattcaaacagaataattaaggagaattgaaggaggggctgttttcaaggagaagctgtttacaatgttgtaggcaggattaaggacaaccaacaaggccttgtgctatactctagggcgggcaaccatggagagccatttacccccttggcctgtaggggcaagaggagaaagtggttatgggacccagagagagggactgtatggaggggatttcctggcagcagctgtggctctcagcaagggaagcagccaggctacagccacctgaccagaagggaaccaggagagtaaattccatgttgtcattctctctgcctgccagtctcctgccagtgcttcccatttggtggatccaactgaagtcacaaaacaaaggaacctgttgatgcaatccatagatagccagcctcccaaggacacagagcagggtggggagtggacctgcattagcaagcagagaatgtccagagcctagagacagccagcccatgcagagggtagggcataagccaggcagtggagagggtgaggagtggtgtatagaagagagcatggagtttaaggggttattatggctgagatccagaccatgagcagagaaaagttcagtttatctcacggaaaactttaatgttaggcttaatcctctgttccttcctccctacattcttcccaccttcccttccttctgtccttttcttctctcaataaatatttgttgaatgctctctctgtgccagcccgatcactgccctcccagagcttaccacctagtgggtaagacagagaagtcaacaccccactgcaatcactggtgtgaatgaagggtccacagtactagccaggaggagcagtctgtgtgagcagtaaatgcctttctatgagactagccagttagaaaaaagacattccaggtgaactgtggccattctctacagtggtggagaatagccagggaggcaggacttcatctgcagccattagagatgtctccacgcaggtagaatgcacttcacacacccttttataaatgaaatggaaaacctggatattaatagaaaattccagtgtcaggaaatccaggggcatttgacactgaagactgtagctacctcactgagagaggatattgcagcaaaccaaccaagttcctgtttggacccttccaaaccctggcaccctcaagtgaactcacctttgttcatgaatatctactcatacaaaatgggatgggtggaaaaaaagacactttccctatacactgttgtctcataaggaaacatttcctttgtcttctctttattattatttgggaattatttcctttgtcttctcttttttattattatttttttgaatgtaacaaggacaatcccctgaggccaggtttttgttgttgttgcttttggactccagttaatgttgttggaagtctcacaaaaggggctgcgataagtcttgaggtcacccccgacccctctgctggcagctatagcccccgttagcctcttcccctgctctaatcagggccactgaatgatttgtcctctctgggtggggtttcctacttaatttctgatttgatctcatggagcataaacttcatactttcctcttccttttcaatctgaatgaaggactctcagagcttaatggatcagtagatgggtccagtactttcttgctgcagatggggagactaagccctcaaggaggggcagacactgacgcaaaccatccattgagaggggggctgagctgcgatggagacccagggtctcacttcctactcccatgctttttcaactacaccctatagacaccttagacaccagcttaaaacctggaaaggttacatttagtatgtttatgttcttacccatcatccacattccattaagacaccttagtatccagagaactgtgataaatgctgtaggggtccaagatataatctctgtcttcaaggtgcttgtatcctgtgattcaatgacattttgttacagtcattcaagagaaggcaagagggcagatgactaatttccctgtaaaccacatagcctataaggcttccatgagctctgagaaagggcaggatcactgtggtttggagaagttaggaaaggtttaatgatggagaagggatgcaataggcttttagcataagcaggctttgtaataatagaaaagagctggtgggctggccagacatgtagtgataatagggtaaataaattgaagtgggaagatgttgaggagatgcaagaaagatgtgagtctggttggggcttcatgaaggtagatgccacagttttttcttcagactgtagacactgaagactcgggctgatttagaatgaaagaattcaggtgaaacagattctagcctgggctgggcagtttgttagctatgcaatcttgggcaagccttttaatctctctgagcctccaattccacatctatttggaaggaataatagtatctgactgcctggatcacacaattgccatgagggtctcataaaataatatcccagaaagagttctgggaagagttaaccagcatgcagatgaaagggggcattgttatttttcagtcactttgttcattcttttccagtaatcatgtaaaagaaattgcttggaattttataatcagaatatcagggtttatttaatgtgactaatattcattaaagcaataacaggagtcaggtctggtgtagtggaaaaattatgcgtgctagagactgaccagggtttgaatcttggctccgctctgcactagctgtctgaccttggcacattgctcagtaagagccgctggtttctcatctgtaataattgggtgatagcagctatcctgtggcatgtcatggcactcaaatggagtcatctgtgtgagacacctggtatggtacagtgcctggcacatggtaggtgatggagaaaagtctcctccattcttgtgtgcacatgtggacaccatatcctccctgtcagcattgttttacagagactgtgttcctacaggctcataaaaaaaggcctggatgaaactgccatatacaaattgagagcatttgctgagattattttcgttctcaaaatattaactttttttaaaggactagccacagaattggtatttttaaataaagaccctataacttctatcaaactcattgagttattgaatttgcacactggcttacttttaaaatgacccaaatgtctggcagtgttaaaggacatatttctgtacaaaaccattccaggcaatgttgggatggctcataatgagagatatgccagacttgtgaagttactatatgtttccaccatctccagccctcatgcctgcttgagggttgatacacagacatacagattcaggcatactcacacatatggtttgattttctctgattcagtctgggttttcttcatgcttttcttctgaacaaagtccacctttactcacaagttccatctgtgagacttgcacacatataactttggtcttaagagcagaatagaggggtgaactgaattaaaagaagaactgttcaaggcccctaaagatgaggttaataaggagctcgaaacagtgacctatgaggaacagtagaagatcaatacagtctagcaaataaataagaatacaagttttggagacggaacatactacagtcaagtcatttaacagttctgtaaccttgcacaggtctcttcctttgtcaaagactcagtcacctcctctgtaaagtcaggaatgaaagtaacagtctagtgcattgggtggtttagaggattggatgaaataatacacagtcaaccttttaggacagcacctggcacatagtgaagtctgaaaatagcagttgttattgctgctgttgtttgggaattgccctcctccgatagatcttctcgcttcttattgtgcatatcccgaaattcttagccccttttcaatcctgagccccctcactacaatctcagtgcgggagtaagagacagaagtaacctaatcaaccactctgtactaccaaaagcccttttattttatcatcctcaggtttcatttttaaaatattttttttaattccaaaagtcctgtataaaccgaatgctaatatattgattatcccaagagataagcagcatgccacactaagtttaagcatttccagcaaaaaagcaaaggcatgtctgggattccaagttggggctcattgaatagtgagtagggaaggaactggaagctgggaagccaggagggtacccataatgtgctcaggactacaccaaccaaggctctctcctggcctgggactcttgccccagcatactctatattctcaaagtttacagataaaagttggaactcctttgcggggagaagtcaggaacatgccaggatctgaggtcctccttctttcatccctttcccaaatgttgtgttccctgtcccattcccagctgcctggatggatggcagtactggtgccctttcaagggcctcagcaggaggcagttggttttttcccaccctgggtttggcatgctcagcactctcattttcctttctgcatccactgatgacactgaccactcatgacagcctctgcacttggtcagatgcccttccaggttaggaaacaaagccgttgggcgtgcaagagatggttgaactgacagacagcagcacattttgttttattgaaatacattttcctaagttggttacagctcagcttgttgcttcaaactcactgctgggcagttttccacctcctgagagggaacctccacacctccactctcactttctgaaaacacaaaactagtgtgtgaacagcattgcattttgttcatgggtttgtttgcataactagaatatgctcgtgttttcccatttttcagaggagcattttctgtcttcctcctttctcctttcttctctttctcttttccatgttctaggttgttttagtggcctggtggtgaagggtggaggagcactgtctccacatcgagcttctgatgtgtttgattcaaaagttgtgtgagttcaggcagccaactgcagctcttagccttgaacttgacttctaactactgaactatttttatggccacagagggcaatgatgattataactccacaaaatcatgaagtaagagagatgcaaaggaggtttctttcccatgagaatccatggtagaaaaacacagtttgccagtggtttggccaagcgtgaggaaggaattgactagattcttccaggaacttagtggccagcatgaagtatgacacttttcttctcttatttcaaattcttcatctgtaaaatgggaggatttgaggtttgttcatgcacacatattctcaaattagacattggaatcctgtttccaagattgtgggaagtagaactagagtacagaggatgggcttaatatttaaaaggtacaaataaagccatgcactggcactggagacgccaagggatataagagacagtctttgccttcagaggattgaccagcccctgtaactacttgagtacaaagtgttcagtgtggtaatgaggagcaattatgctctatgacaagttgaaaaaaaatcctactcatatttctcaagtcccagcagtggccttgtgatggtaccccatactggggcagtctacatgtctgctattttattttcccttaggctccaaatgtggcatcctctttccaaaaatcaatttgaatttatttctacttttgacagcctggcatataatgtcatgctttctagcatcatttctctatacttgaactccttgatcatcacatgactttctaagagttgtctctgtttaaccccaagggagacccaaatttggagaagttactagacttattcaaggtcatccagagggacctacatctactgtacggcctgtattgttttaattttaaataaatttgttttttgcctaaggttaggtgatttgtatgggactatggtccagattaaaatttagacattgccattttaacacatattggtgattatataattcttgatttatcctttctaaacttagtatattttagttagtcttcacatcagttatatgcctacatggctaaagtctagagccaaactatgcagtcttctgaaataacccttgttcctaaaacattgactgctgcagctcatgaaggagatgtgattgtctttgcttagttgtgatttaagcataagacaaatcacagggctgttagtaagttgtgcatattcactcagtgtggtcagttgtgttatttatcaatttggtttgatgctccaagaaggaagtgaggtggtgggaagagagctgtgggcccttgaacggtagagttcagttgcaagaatgattgtctgacatgagataattgtattactactgtgttgcttttgaacacagcatcacaattcaattgtgcacctccttacttagcaagagattcctcaagccttaatggctgctctgaaaatatatgaactcagagtttctgaggctgtcaaaacagagattggagtaccccaagagaagatcttagggaagtgactattcatccaatagtttgtgcatgagtgtgtgtgtctgccttctatgtgccaagcacagtgctaggtgctagaagtacaacattgaacattgcacaagacatctgtaattctgcccttttggaatttcctgcagcaagataaatagctagctgcataattgctgttacggagaagtccaaggtgctgagcgaacacagagaatggctacctgactcagacatcgggggtcagagtagcttttaggctgtgtcctaaaggatgattcgtgttaacctagtgagtgtagctgagcttgccaggaaccaggtgttctgacactttgctttctgtcctaacaatctctaaaattattttccaaaaggtaaatgagaaaaatagcagctgtgtagtttctagtaaaatgcattcattgtaaagtagtgtgctttattctgagattattttttcttttggagtgctactcaagtaccttttattttatgatatgagggacctcatacatggtggagtgtttttttttccccttttgaatgctttatttattcatcgaagttacacaaactgctgacttccatctcaatgtttattattaggttgctgcagaagtaattgtggtttttgccatttaaaagtaatgttgaaaaccgcaattacttgtgcatcagtctaataatatcccaaaagtctaagaaccttgccactggcacactctgcttctctgaaccagcacctggtttcctctgaaccaaattctcaggattctccaccccacccattacctggtcccatcacgatccaatccacaaggagctgaaggccagtgattttcctatgggttagccttccaagagactcagcaaaggacatgccgttggcagataaatctctgcatttagagcagcaataaagggggctttgatatgtagtgtctgtgactgataaaagaaaaatactacaggagacaaaatcagaaaccagaccaacatttcagcttccctcactcccaccctaactcagcatcagatttttccccatgtgtgaataccactacttcttatatacattcctattgctgtgagacactgccaatgcctccttctccactttcaccacctctactccatctcccaaattccttcagaaatctccctggaaaatgtaaaccagatcattttatcctcttacataaaatctgccagggtctgcttgggactcccaggacactttcaattctccattgcctagtatacaagacccttcctgattgtcttagtttgctgtatattgcttcagaggaatacctgaggctgagtaatttacaaaggaaagagatttatttggctcatggttctacagacagtacaagaagcctggcaccagtgtctgcttctggggagggactcaaactgcttcccctcatgcttggaaggggaagaggagccagcatatgcagaaatcacatggcaagagaagaagcaagagagagagtggggagacgatagagtctttttaaccaccgactctcaccggaattagtagagtaagaactcactaccatgagaatgacaccaagccattcttaagggatctgcccccatgacacaaacaccttccactaggctccacccccaacattggggatcacatttcaatgtgacatttggaggggacaaatatccaaactatagcacagatgtagccattgctgtcccctccagcttcatcttcctcaaccttgcaagtgagggcttgtaatgtctcttctcatgcttctatgcttctgggctttctggagcttctgccattttctctatttcccacacttggttcaatatcaaaccaaggtttattctttatgtgaaaacctcagtggcttctgaccctccttcagctgggtgtcattgctgtatgctctcattatatttaacacccacccactctatcataacacatataataacaggaagtaagagactaatggctaaggatatggtcggtagcatccaacagactaggggttgtgtcccccctctgacacttttccaagtggagggaccttggaaaagtggtgtcagccctcttagccttggttccatcacctataagttggggatactctagggcttttgaaaagcttcaaaaatataacaaaaatacttcaacagttccagtgtgtagtaaactttcccaaatggtagtgttattaatgttatcatattatgttgtgatctttcatttattcgtctcactttcttcataaaacttctaataccttgataatgaaaatcatgctttttttcattgtctgtaggcaaagtttctggcttaaacatggtatttaatagaatctcagtaagtgttgttgatgaatgaaagcagaaaagaatgaatgaatgatatgtggaaaggaaagaaattagaaaggaagaaaggaaggaaagaatgaaagcagggaaaaagaaaggaaaaaatggaggtaaggaaagaatgactcattcaataactaaataaaggaatgatcaattttcaattagtctttgattgatgctattatgttacatgtcaggcttccatacaaaatctgttattttggaaactaatcattcaagattccaagaatttaataaactctcccagcattttctttctgtgtctctttttatagactggagaggcagatttaggtatttttgacaatgaaactaagcaggaggatcaagtccagattgttagggcccttgggataaagaacaaaattcaggtttttgtactggtcacagcttggagaaagcttgttatttggaacaaggatatggatgcaataaacattctgaggtttatcttgctttaatgacttgccttaagtggctttgatctttatatttgataatcattttcaaatggtctggtgtgttctgaaaattaagtagcggttcatggacttgagaacctccttgggaatgacaagctacaatcagaatttggaaatgggcaatgttacagaatttgctctatgagatggagaaacaggacaacctcctgtgaagaaggtaaacacattaatccagtgttgggaaccaggtttggctggtggagcgggaacccaacaggcactgggagctaaggccagttttctttcaatccatgaactagcttaaaacagaattctgcatctcgagggtttttcatgagttgggtactcttctaggcatttccttgtgcattacctccttgaatttttgtatcctcctttcttggttgaattttctaattcccatttcacatgtgaggaaattgagataccaagtgacagggtcagttgtccaagatcacagagccactttgtggaagaaggaggatttgaacgccagtttgtctctctcttaaaatcaccctctgttgccttttattctaacctgaaagaactgtttccagtctctaggttgcttaaaagtggcccactcttggccagtgttcagctcacacaaaccttcctccagttgagggcatctacgcatggccagtaccatctctgtgaccagccgcacccatcaagagcccaggaagcatgactctggcgtgacattgcttaaagatctcctcagctatcacttctgcataggggaagtccactgaagagtgacctgctttgagtgggaatagaaattgagagtcctcagtcttgatctgggctcactgtaagctgtaccattgaaacgggaaggccagtgtattatgcttctacaggtgaaaacaggccttctcacacttttttcccatgattttatttaacggatttgttgttgttgctgttgttgttttgcattttgaatgtggttcccttttgcttctctctcaataaaacaggccctgacagccctctcattcagattattacagagttgtgccatctcaggccagtgcatttaggaaatattttgttggcacttaccaacgagtgagatgcataaagaaaatattctaatgacagttgagttgagagagctttgatctccctccagaactgcactcatggctttgaaatgcagttctggcaaaggggtaaagtctgggcgccttggcaatcagggctgggctccctgaaatagacattccaggggacccgcaatctcaatagtgggatccaggtgcatgggttgtgtaggaagacaagagacactgagttaccactcttgagaggcggctcaggggaaagtttctaaatcaggagggacatttcaatctagccaacattttccaaactttgttgtttgtactgctgtttggtttttggcaaaggtggaagtgtgtaaggggaggggtgtggaggaggaattatggtcacatatttttgggtacacttcctgtgctatctgtcttactcttattttgcatatttgaggctccaaaaattcttgcaattaaaaaaatatgtatttaaccttgtttaacagaccatgtcccaaatccatttgactcagcgacatttttctttaaatattcatcattttcttacaaatttagccctctgtagaccatgatctggaagacattgatctatttcacaacctcactgaacaggtacggaccctgagctgcagaacaaccagcagagtatagtgagaagtggtcagatattcaggcaatgcaggttcccacacccaggtgtccagctgagggagagaatggaggctgccatccttcccatgatttgttctctaaactttgcagggaactgtgtccacctgaaggaagaaatgactttacttatgatacaaaattgctgctatacacaagtgacatgtacacaggttagagcagagaggtttgttggcaggcttttctacaacctgtattagatatatgaccttgggcaagtaattccctttccttgagctctggccttgctcatcctgttttgaaactatgtaatttgagagagaggtgctcagtagctgcccatcggtggtggttctctcttgaaggatacttttaagtgatacggagataataaagatttggtcccaactgccagaagctcattacctgatggaaaagacagatgctcacacagtgaatataacccaaagcagattgataagtactggaattaaaagtagggggcacagaggaaggaggactcattttcagatagaggtgatgatgatgatttgagtgttgttaataatttttgttttgctaacaataatgcagtaaaaggagcctatcctaatcagtgatgccttctctgtgccagtcaccatgctaggcacttaacccgtgttgcctctaatccttatgatgcccctgacaggtggtcatcatcatccctactctacagatgagagtggtcataagaggatacatggagtgcatcacatgtaagctggactttgcagggttcataagatttaaagggccaatcatcaggaagaaagattgcaaggcagaggagggaaactaatgggcattcttaagggttgggcataactggggaaaactagaggttctcagaataagaaaaccaagagaacttgagcggttgaggttgtagaaggaagaaggctgggtaatgaggaagagacactgaaagctgagactgggagagccacgcagaggcagactgtcagtttaggttctttcccagcaggagaaaataggagaccaggatatggggggctcacattttctagttatgtgctgggactgtgctgagctgtcttatttaatcctgttgggatccgcatgagctaattgatactcagagacttaaacctacttgtccacagatataggtctatctgtccaattctgagtagcaaagcttctacgcagattaagccacacagattaagctacagattaatacacacacagcttaatctacagactaatacatgcacagagttggacagacaacttgcccatagatataggtctatctgtccaactctgcgtgagtctgggattttgattgatttttctgggaagtgagtaatgtttgtttgcttttggttttgttttaagagatggcctattgctctattgcccaagtgggagtacagtggtacaatcatagctcactgcagccttgaactcctgggcccaagcaatcctcctgtctcggcctccgaagtactgggactacaggcatgtgccaccatgcccagctaaattttttgaattttttgtaaagatgggatctccctgtgttgcccaagctgatctcaaactcctggcctcaagcattcctgccgccttggctgcccaaagtgctgggattacaagcatgagccaccatgcccagccctgacattttaaagtacatttgaccaatttacgatgtatacacagggacagccttcccaaaaattgcaaaatgtaagtcacatggccattttccttctctcaccttcactatccctagacagtaatgttccttctaaatttgacctcctgtgctttctcttctatcttgttgacaaaagtgaaaaaaaaaaatcctttcaaggcataggggtagggaggtaaatacccacatggactcctgtcccaaagattttccccctgatatatttgagagacactcagcctggctctgtattagtgggaatacctcgggcagcaaaaggaaaactttcatccacagagctgtgttgttgctttttttttttttcccccctttgggtgggttcccctaggagaggtggggaagagagaggcctggattgctgctgtggagtcttcccccttagggaaatggaggcttcccaaagtatgaaaaaaaaaatcacatacaagccatgaagaggctcccacatcccacttctctgctttgggctaggatgaataccacttcttgaaaagattggcttctgcaattaccactgaataaacaaccaattaaaatgtctcccctgcccctaccccaccctttttctctcttgaagctttctcatctcagagctatggggcagaggtggctttctctaataacatttgtgttctctgcctgagagaacatttgatggaaatgaacaaatcaattagaaaataataaattatgtggaaagggctgatccaagaaaatctcagctcctctgtgttttcattctcctcccatgcattgtttctcttttcactctgggcctgggtgagcttggaaatgagggtgaggttgtgggaagggttggacacatctagatttgtacttggccttgtctccagttgtgtgatctctgaacccctcttccttcatctgtatgatggcgataagtgataagaatagctaaacatgcactgaggctttctacatgccaggcattattctaagccctttacactctctttattaactaccttaaccctctgaacagctgtatggggtaggtagtattatcaccctcattctttatataaagaaactgaggtgcaggaagttaagtacattgcccagggtggcccagacataaagtggaaaagctggattcaaaacctagggctgtagcttaagaatgagccatctcacccactctgttgcattgcttcaactaccaaacagggatgagacatgtgtacctagcacagggtctggcatacagcaaatgcttaataaatgttggctgtctccttcctcgttctcttccctgacgacagagcagactgattagaattcctcatgagatttccagcctaagaagttgaatgtgggttcttggggaagagaagggctcagcagcgagatttcaggtcaatatctgagtttgtgtggctattcttggaattagtcagctacacctagacataaatgtaagctctcctgggcccacctatctccaactcatgttttttgtgaaaacatgtacaaattatggtcacaggaatgtttggtttcgtgagcttggggctttctgtgacatgggcggccttgacacgctagatctcagacgtatcctattcacagcagggtagaggtgtaggttttccacccatagaaatgatctgtggagcatcaggcagctgttactaatttcaatgtattgataaggaaactgaggccccattagtcaggaattattgaatttgagactgagagttaaatatttttactcttactttccctaatttaattcaattccatcaaaatctactgagggctcaccaggtatcaagctttgtgcggagaactgggtaaacagagattaataaggcacctcgccttcccccaggtggccacaagtgtgtattatgtaatagaaagaggaagcaatttattgaaatggcaaatgagagacagtgctctgctagtaggaggtggacgagtatggagatgttaaaaggggtgcaggtgaggagagcatcagggaagtcttcctggaggagggataccagaacagactttggatttgttcattagagaacaaaatgctgatcagagtcccagcagaggaaacagcatgaataaaattgccaatgggataatgcaccgtacagggtacagagatgttttctgtatgcagtggggtgctcaagaaaggttgtagagatagatgaggctaaggagtaggttgtgtcttggaggctatattgggaacttgaactttgtctttcatacatggggagaccctttattattctaagaggggaagagcaggaaaccatcactaatgtgtgctactggctgggctctgtgagaactccttgggagagacagcattaagaaaaaggaaaacattgctaagtagcaacttgaacttagtaaggtatgaagaaggttctctaagcctctggagataacgatactacctacctctgtgttcataagaagcctaacaactttggcaagtctctaaaactctcgagaacttaattttatgatctgtaaaatggaatcatcttacttataatattattgggggaattcaataaggtagtatttttaaagtgcttagcaaaatgcctggcactcatagtagctctaaattatttggagagggcctgttatctttttgggggcatgataacagccaaggttctttttctgtttcagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtgagtcttagaaactccttcaggaggcaactagagtaggacagtaatacacttagtgcgatgatgatcattgttacgatcatgatggtggtggtggtagttgtgagggtgaacaaccgatttatttatcactttttaatttacaaaattctttagcatcctttatctcattttgaccaccaagcaattttctgaaggaaatagcaccatattattaaccatgttttatcaatggggaaatgagacccagagaggaaatggggcttatccaacatcacacgcaagacagtgacagtcacaattggaatttaagtttccaacactgcccattgtttgctttctccttataccctctgtctcctagttcctgcaaatatcttctcagtctggtaaccacactgtactggcacagccagtcatgggttggcttaaaagacaccaaagaggcaagaaaaagtgagtttgcaagaactctgtgttcctccatgttccacccaccaacaccaacaggaactcttcttacattcaaattatacatatccataaacaagacataagtttgtacaaaccaatcaccaaaagttagacatgacaacagtttctgaaccaggccctgtaagcaaacattgcagttctttaattttattttttccatgctctcttccaggacacatctatatgtaaacatgcatttttttaactgtacatttttaaaatcatagcatagatgaaattctgtgttcttttttcacttaatattatgctatctacttttttttccatgtcgcagaagtcttatccttaacttcccacccatatttttttcacttaatcacaaaagaaaagcacccttgtgggttattttcccctctctaaagccaagatttttaatagccacataatattcccttgaacaagggcactgccatttatttaatcattttccgtttggtagaatgttcccattatttacaagaatgaatcgtgatgactcagtgaacatctttatctgagaatgttcaggctcagcagtgacagtgctggatgtatcctcaggcctgcctggtctcctggtgaaacagagtccagtagcttctccattgctattctgtcttggaaatgagagatttaaataatgcaagttttgctcaatgaaaccatagacttagttccctccagacgactctcatttctcaattgttttttagagaatgaaaccaatttgtgtgtgtgtgtgtgtgcgtgtgtgtgcatgtgtgtggttgtataaataaagatagatacaaagataaatatctacttgttctcagctgggaggattttatgccccaggagacatttggcaatatctagagatgtttttgcttcttacaaatgggggaatgctactggcatctagtgggtagaagccagtgatgctgctacatgtccacaatgtccactacaaagaattatacagactaaaaagtcaatagtgctgaggttgagaaatcctgagacatatggtgtatgggtagatagattggcagatagacagacacagacaggtggggttgggcagaagagagcgtgcagcttaggcaaacttgaagatgatcagcttatatcacatgcctagtatgatatatgggagtaatgctagactagagccaaaattcgtgtttgttctcagctgtgactttacttagcagtatggccttaggcaattctctttccttcctcaggtctcaatgtccttcaatattaaataagcaggtcctaggaggccagaagaccctaaggatccttctcagttctgaaattctgtcctattagaaaagcaactgaaagggccatgatcagagtctgagaaggattgagtagcaggcttctactgttagaaaaaactactcctgataattccataaatttcagagtctggctcagggccaggaataagggaggctataaatccatagcatgttatagtatttcaggatgatgtcaggctcaagctatttcaccttttaagagaagcaatgaaacaggactggggcccaagtgctgtcactctgtgaaaaggggtgagttgggaggggatgaggtaaagcaaacagggctagcctagacattaagtctgcaatccaatcatcatccctggaatggtcctgtcctctcattacctcaataatgaagcttcatggagagacagagaatcattggcattattgtagctgcttattttagagctcaccagagatgcaaagtccattttccacagtcacaaggccagtgtgaagcagaacaaggattgcaacctatgtcagctaactccagctggactccaggctgccctctccccatcccaagagatgctgctcatgagtaattcctctgcagtagccccaatcaaacccaatttattacaaccatatttttcccctctttttctgctattacaccatgatccctggaaaaagccttgggtgggaagcggattatgtttcatgttatgattgacagaaaataattgagaaagatttcctgtctcaatttctcttcctccctgcctctgcctgcccccttctcatacccaagtgaatgtgcacacccgcacactcacatgccctctcacacatctttatctttgtgttagaaagctctaagcaattcaaaattgctcagaaattcaatctctgaaattaagtcctccagtgaccctaacacggagacagagtccttcttcaaaatcagagacctctgcatagactctatgagtcccttgactgagcaagcacaccattccagaggttcagtctaagataaaaccctccatgcccatgtggggcttgccagctcaaatcaacaagaccctacctcctcaccattcttttagaagatgctgctctacacctaaagtacctactttcaaggttcacagacctgagttttaaccttcccttaaacattttaaaattttaaagtttaattatctctctggcagcctgtatgcatctttccaatgcctaaaatgaacacagcacaaatactacccataaattctgctgagatctgttctgtctatctgcccaagccaagcaattctcaatcttctgaggcatgtgatatagaccattgcttctcaaaccagaatatacagacaagtcattcaaggctcattttaaaatacagattgtgcttctgtaggtctggggtgaggcccgagattctgcatttctactaagctctcaggtgatgatcatgctgcttgtcctcaagtgatgtacttgatgtatggaggtgctattctagttctcacactagattagttaaacctcacaaacttctttagataagttaacattcagcaaatattcaacacatatttaatgagatactctgctccaggccctgtgatagtcattaatcatagaacgttgattaagagtcctgctcaagtgacattagctagtatgaaaactgttacaatggtgaatacagcatggtgctgaccttcattagcgttcatgctcttacagcatcagggatgaagatatgagattcagagatgctaattactccactcgatgtcacagagttagtgaaggcaaaatgggaaccagaaccaagatctctgagcctgagggctttgtctagacaagaatatgtagaatatttggaaataagagtaggccttactttgtaagggaaaggttgcagcagaaaggtttactggcccagaaatcagagtttctgaattgctctccattgaaataatttgaaatcaccttgggtaagtcccttcacctctttaagcattggcgttttcatatgaaaaataaaggaattgtacaaaatgacttttgagattccttcctgctctgataagtcatgattcatgccataggttgtaacagctctcagggcaatggagtcctagggtggagaagcttgtgtttattttgggcagcatctctttatccttgatggacttgggggttcttgcaccaagaagcagagtacctagtttgcctgattctctggatttccccttacaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcaggtagggccctacactctgtagggtgaacaggtctggatgtcagatgtgggatccaatcctggctcaggggaaccttgaacaagctacttaccatttctaaggatggaaggcctagctctgccacttatccacctaatgtctttcggtcattctctttctgggtttcacttttctcaagaaaatggaattgttggactagcatctccatgatccttcctaaatgtgcagcacatttttctaagctagtggttgttgaaccttttttatttaacccatgtgtcccttagataagcataaaactctcacattctctgttattttgcaagaacaatgagagtgctttggactttgcaaagagaaaattatgacatgagattgagtatgattttttttttcctaactgcatatatcttatcatagtacttttgagtaccactagtaacagtgttaggagcattaggggatgccctgcacttccctttagcatgggatacatcaaggccttggagcccttttagcacctttggcaaattagaacaagacaccccttcctcagggctgtcatagcccttaccactgcacctgcagctaagagtttttgtgttagtcacaatgcacacaattgcacatggcaggccagcatcaaattctgttaccatactcaacttagtgtctttttccccactagaacaagcaaattctatcaagccaaagattgcatctaatacatcactctattctcagaagtcagcacaggggccagtgcttaataaatgtttgttaggaaaggaagaagtaaagaaagaaagggaggagagagggagggctggagggaaggaaggaggaaaatgaataaattctcttataacaggtatataaaatttattcttatcaaaagcaatatttctactcatgtaacaaaatattgtccagaaaggcctttaatatgctctctctcatttaattctcacaacaaatgtgtagagtcagaactatccccactctacagatgacagctttgaagctcactgaaatcatttgcaccaagtcacatatctgactccaagtatttttctcttttactcttgtatttcttctaaagagagctagctgatggttgagtggggaaattgagcaacctgggtggcttttacactctgttccacagggatgcttcagggcaactgccctggtggctatatgagtagggctttaggctctcattcctgctaaagccagggaaaacacaccccctttctgactattttacatttctgttgaggttttgcctcattgcatttgaagagaggaatttgctgctggaacccaaaggtttctgtgatccccagtggttctttctgcttgtccatttgggctgatgacccctgggggcctctccagtataaggttcctgcagtccaaatctgaattgaagtgtcaataacccacctctggtaccataaagagtcttagatttgagtgctcaaaaaagaccagggtgctgggtatttcctgaaaagcagattcccactgggctcccattcccagccaagctgacatcccacatccggtgccccatcccctcatacaacactgctaaagttccatttctatagcaccttttcttggccagctcaacacacatggaaaataaacaataacataagtttggaagtttgccggcctcttaggggctaggagctgccactagctaccagacccccataaactaaatctttttttttcccctttgtacagatctaaagggtgattgatttactattttttttaaaggaacccctcagctcagtgacccattaacagcagaactaattcactgagctacgataacaaacttacacccacaaaagcatattcaaggcaaccacgatctttgaaatgtttgttttccttgggatttctgatagatgaggtgacaaaagcagctggatgcaattcaaaatgcagaacaggactgggttctcagggctatggagagccatgcatgggagctctctccatcaagataattgggtgaagacattgctgggtcaacttcttctcgttgctttatcttcctgggtgcttcttcctcaggcctgatcactggtagggtaaaggtttgtggtgcagcactgccaacagaactttctatgaagatagacatagtttatatctgtgttggccagtatggtagccatgacctctactacccatgtggtaactgaacgattgaaatacaactagtgtgactaatgacctgaattatcaatcttattttaactaatttaaatcagaatagccacatgtggctggtggctaccatattggttagctcaggcctgcagtaattcttgagtacgtgtgacatgccggacactgtatgaaatttttcataggcttgtctcattgaatccccacagtagcccaaggaggtgcacaagttttacagatgcagaaaatgtggttcaggtagcttaagtatcttgcccagcatcacaaagataaaacaaggcaaaggtgaaatctaaactcaagtgtttcttactgcagagcctgtgttactaactagtaagtatctgcctcattttctggttgtggggaaggttgagagggccacaaatgctcagatcaagcaggcaccaggcagttgatggggggaagcctaattcagtaggcaggctggacagagctccagaggagtatagttatgttgaactcttgggtaactcttggaaaactcaacagataaaagagtagcagacccagttccactttctggagataataggctacaagagttcctggaggaggacactctggtcctcaaaactgcaggaagccaggctttctctagcctacaggagcaagtgtcctgtccccatctttctgtgtgtcatggcttcttaatatgcacacatagattgacccagcaattccacttctaaggaatatatccaaagcaaataagtcaattggtatgcttaaagatttaaccgtaagaatgttcttaatgatatttgtttcctaaatatttattaggcattcactatatgccaggtatagaaaacaaaatgtttgaataattagaaactgcttacaagcctaaagataatgcattgctgaagtgaactgcaaggtattcatgtgataggatattatagggccactaaagatgacagagaagatgtttgaaggacatgaacagaagtggaataacatggtggttcagagcatgaaatttggagtgaggagacccaagttgaatgttcggtgcccagctttgatcttcggcagtttacttctcctctctgagcctcagttatttcattaataccattgatgataaggatgcttgccttgcctgattgtaggtgtaatggtacaagtgaagcacttagaactgttgttgttctaagtgcccattaataatagactggataaagaaaatgtggtacatatggaatactatgcatccacaaaaaagaatgagattatgtctttttcagggacatggttggagctggaagccattgtccttagcaaactaatgcaagaatagaaaaccaaacaccacatgttctcacttataagtgggggctaaatgatgagaacacatggacacacagaggggaacaacacacactggggtctattgaagtgtggagagtggtaggagggagaggatcaggaaaaattgctaacgggtactggccttaatacttgggtgatgaagtaatctatagaacaaactcccttgatacaagtttacctatgtaagaaatctgcacatgtactcctgaacttaaaatgaaagttaaaaaacaaacaaacaaaaaagaactgtccttggtatcataattagtgctcagtaaatgatgattagtaggattattcattgactacttaatgtgaaaaaggtcagaaagccatatatatagtgtaagacctgtacatatgtatgtgatgataagaattatagaaatttactgtagatatttacatccatatacaaacacatatatatatacatacatatacacacatataccttagacatcaattttattatctataggtaatgagttcagggtaatgtttattttttgtaacattttgacatattccagatactctacagtgaagtttttattataaaattattatctacatctattattatgactattattactatcattatttttaaaaacatcaaaaagacagagagtttcacacaaggcaacttagttatccattcactagacattagttagcttgttaaatgctctcatcagctttatgagacagctaacatcttattcctcattttatggtgggtgaaaatgtggctgacggggggtcagcattgtgtccaaagtcctaagtggagtgaaggcatggtattcatgacctgaacctccatgcagtgtgccctttcagccacagatggacatttgttcttgagaggaagattcagttagcaaacccagggtaccgtatcaacagcatggggactggcataggcttcccagtgctgaagtcccgaagttctttctgctttgggacaagatacagacagaagaacaagatgagctggccactcctggagaccagatgaagtggccacagatatcaagaggggaggcactggggggaaagaagccaagtgggactgactctagacattagctaattgaggcagatcttttgtgatagatgaaaaccctttggtacctctccccagattttgatagctgctaagtctccaagtaatgtaccttgggatagatttcgacttcagctttttttttatttttattttttgaggcggagtcttactctgtcgcccaggctggagtgcagtggtgtgatctcagctcactgcaacttctgcctcccaggttcaagcgatttgcctgcctcagcctcctgagtagctgggattacaggcgtgcaccaccatgcccagctaatttttgtatttttggtggagacagggtttcaccatgttggtcagggtggtctcgaattcctgacctcgtgatccgcccaccttggcctcccaaagtgcagggattacaggagagagccactgtgcccagcctcaacttcagctttaaagttcaaatacattcctgtctccctactaggttccatcacctacccattttttcaaacttatttttatcaacaaatgtgaaaatggttccattttaagttataaaagaaaaatacacttttttgttgggggaaagcaagtaaagtagatgtttatacaggaaaaaacctactgtttttcagtgtcattcatcttgagaaatgctttttgtgcccttgctcattgaattctcacaacttcatggtttggagtttatttaaatgcccccaatttatgcacgagggaactgagtcttcaagttgtctcattttttggtcatgtctgattagtattctgttctatgtctgtgccttaaagtacacagccatttccctatgaatgaacagatgtgctatttctaatattttcaccattataaattatgcttcaagaaacatctttgtatgtctattttacccctgtttacccaagagtatctatcttttgaatccataaattccttattgttagatcaaagagaatgcatattttatatcctgaatttttttcctgcttccagttttctaacactcacacatacatgagcacacgcaagcatacacacacacaccacacacacactatttccaattcccatgtactaacatttatcatggggcaggcattgctcttagtgccccacacccctgcaccttggctgtgttttgagatgagcaatcgcgttatcatcactgtcttcacttcacagatggggtaactgaggcactgggggcagaaaatcacttgtccatttgactccagattctgtgtgcactaatctagtcacgtggccatacttcttcccttagccatcatgcccttctcctgcatgtaacctatttggtggcttttccaaagttttcaagatgaagtacaaagttcatggcaacaaagaaaaaagtgtccaattatctggcccttttcggtctgaggactttttccttgcaatagggagccatagaatgtttggtattcaggagttacatggtgggatctgggtttgagagagatttactcggttattcactatactgtgtttgttaagagacattgggctcttccacttctccaaatgtgttaaagacttccctaaggtgctggaaaggagattggcaaaaattactaaggggatttaaggcagcttctgcatagaacctccctcacaccctgcaccttccctaagctggattctcaaagccatgtatatagctgtccagcacctgcccaaatgtatttaatgtttgtttgataagaagaaaccagtatatgctgcaggattcccagtagcaagtttattttaagattggaagagccctgtactcctctgtctggggcccagctgcaggctccctgaccaggtggacacctctgggaagtggtgtttttggaaattaagccaaaacagtgcattgccctgtccctagggcagttgaataaaactgttggagggagaaatgcaagcgttctccctcagaaccaggtcttaggtcacaccctggaaaagagagattaggatcaaaggtccttagatctaaagacacctgagagattgtgttccaagctcccttagcctcagactcaactcccatttatcaaccacctgcaggattttatatccatacaatgtctcatttatgcttgaaaagaagttctcatattgatcagaagcatggccttgaagtcaggactgcctgggttcaaaccccagatgtatccctagctttgtgattttgaaataattatttaccctctgtcagctttaatatcctcttctgtacgataaggaaaatagtagtgcgtactccaaaactccagagaaggaaaggggtttaccgtgtctaaagcacagtgcaccaatggcagcatggagtgggagatgttactactcatattttcagcatgcacactaccctggtttgttcccaggtctgcctgactccctggcctgtgctctctgcctaaggcaccatgcctctgtagtcatgcagcactttctcctgcaatccctctcctttcttttccaatcttagccgtgcaatctgatcagcctcaactatctccttctttagaagccttcctggtcgcctgcctgtccctgcacccacccatgccgtcttcctcgctttatcagtgattgacatcacagactttagtagccttgtaacaaccttgactcatacactggactggtcttgactccataactagacttgtacctcatcatgggcaggaacttttaaagtttcatctttccatgcccttgggcacagagcagaaatgtagtagacactcagaaggtttgtttgaagggtaatatcagcacattggttaatagtgaaattaatgaatgagtggatgaaagaatgtgaaggaatgagttggaaccagtgagtgcatcaatgaatgagtgaatggataaacaagtgaatgaatgaatgaatgaatgagagatattgagtggggggtgagggagggagggagtaatggaattgttgacttagtgcccagtggatttgggggccatgggaaataggggaaatagctcatcttgcctgtgtcctttgccgtgacctctgggctgctctcttcccagtctcagccatactttttcagttacatccacccttccctccctcctgtttcctctcacctgtctccagaagtgatgactacactaatttgttcacaggccattaactcttgagagctggaagaggccagccctgagttggcaaggaacgacttgggtgctgactcttgggccgccaggagccgtcattactctctcatatgcctgcctgccttgcggcttggtgcttatctctccctctgcctgcttgcagatgacgactgtacggactccttcacgcccaatcaagtcgccagaatgcactgttacctggacctggtctaccagggctggcagccctccaggaaaccagcgcctgttgccctcgccccccaagttctgggccacacaacggactctgtgacactggagtggttcccacctatagatggccatttctttgaaaggtgagtgtgccctgtgtagtgttgatccctctctctctctcctgccaagaagaaggaaacttggaagggaagcagacttggagagggattttactgcatttcttgttcttgttcaaaaggtatctccaccacctagcatgttgtaaatttgggatcagggaataaataaatggtcattaatagaaacaaataaataacaataaatatttttaagtgaatgggtacttagattcactttgttattagaaacttggaaacctcttttgctacagacctcttctgggatggaggtaatagtctcatctccatgagctcaggagttgtgattgcctgggcaaaaacatttatattatattatatattatattatattaattatattgtatcatattatatatgcttatatatggatatatatatttatgtgtgtcacgtgtgtatataagtacatatttacatataagaatacatatacaaggccgggcatggtggctcactcctgtaattccagcactttgggaggccaaggtgggcagatcatgaggtcaggagttcgagaccagcctgaccaacacagtgaaatcccatctctactaaagcacaaaaattagacgggtgtggtggtgcgcgcctgtaatcccagctacatgggaggctgaggcaggagaatgcttgagcccaggaggcggaggttgcagtgagccgagatggcaccaccgcatctcagcctgggcaacagagcgaaactctgtctcaaaaaaaaaagaaaaaagaatgcatatacatatatgacatataaacataatttttgcaccaaatgttttttttttttattttgtagaactaaaggtagcattttataagaccagggaatgataaactgaggcacaaggtacctctattctgctgccctgactgttcgttaattaaccacatggccttgagcaagtcactttctgtctctgagcctgattctcccttccctgaaaactgggtctaatgatactacagtggcttgaaggtggagacctgaatcaagtggtctcttgtgatctttcccccatataaactccttgaggagctcaagctctaaggggaccagatttaaaagggtcatgaaaatagaccaaggtatttgcatctattttggaattttgccataattcagggaagattaatgtattacctctactcccagcccttctttgggatgcttcatctagtaatggtgatatattaatgatggtaaaaataataaccatgctaataattagttaatattactttattgtagttgctgggatctatcaagtgcttactatgtgatggattctatactaaatgctttacatacagaatctcatttaatctttctggtaaccttgtacaaaacaaatcatcttcctcatctgctagataaaaagagaattggagctgaaagaggctgaaaggtgaccagagggtcatggaaagtggcaggcactgggcttcagctcttgttttgtattgtgttatctcagactcgtatgtgctttcattaagttgtttcagaactagaattggagaaaaggcattacactgccccccgcaaggcaaaaaaaaagccacaaaaagaagcaagaaattctcatttacaagtgtatttgtctgcatttgtgtgtgtgtcaaagacatattaggcaaaggacctaaatagacacttcaagacacacaaatggccaacagctatgtagaagaaatgctcaacctcactaatcatcaggaaaaggcaaattaaaaccacaagaaggtgtcaccacacacctgttagaatggctattaccaaaaggaggaaagataagaagtgttagccagggtgtggagaaaagggaacacctgtgcactggcagtgggaatgtaggttaatatagccatcatggaaaatagtatgggggttcctcagaacattcaaaatagaactgccatataatccagcaatcccaattctgtgtatatatttaaagaaattgaaattagtatgccaaagagattgctacactcccatgttcactgtacattattcacaatagctaaaatatagaagcaacctaggagtccatcatcagatgaacaggtaaagaaaatgtggtgtacagatggtctccaatttacgataatttgacttccacttttttgtcttcacaatgacaaaaaagtaatatgtattcagcattgctttgagtattaagatggtataaacctattgtaagttgaaaatatcgtaagtcaaaagtgcattttcaacttaccgtattttcaacttaagataggtttattgggtgagtcctaaccccattgtaagtcaaggagcatctgtatagacacaatggaatactattcagccttaaaagcgggaaaattctgtcattttcaacaaaatgaatgaacctggaagacattatgctaagtgaaataagctaggcacagaaagacaaataactgcatgatctcacgtatatgtggaatctaaaaaaaatgaattcatagaggtagaaagtagaatgatgaccaccagaggcaggtggggtgagtggggaaagggacgatgttgatcaaagggcataaagtttcaggtagatgggaggaataagctttagtgatctgttgcacagaatggtgactctaataaatgataatgcattgtatatttcaaacttgtgaaaaggatagatttcaaatgtttttgccaaaaaacagtgtgagagatgatggatttgttaatttacccaatttaatccctccacattgtaaacatatatcaaaacatcttactgtactccatgaatatatacacaatcattatatgtcaattaaaaataaaatgttaaaaatttttgaaacctatttgatcacagtaccacataaaatgtgggcattaatttttcacattaccatcagtacctgagtctagaacctaaatttggtagctggcgaatgtgatcatcagggaaggaaatgcacttactatgctctgtagaaattccccttcccctgccccagccatcctcactgggagcacagagctgggtttgggaaacctcgtgtgacacttcagaggtttccagcaggccatagatttatttactttttctgtggtgatgagaagtatcagacttttggtcaagccttggcctccattccacttgaaaatggaagtttcataaatgaagcttcctgtgtatgtatttaatttatatttcataaagcagttactgtccattaaataaataccacctgattgttggaaacctatttgagggttaattgttgtgtaatgagatatgtctctattacacagtgtccttagcttcaatcaatatgtttttaatcacctatagtcagttggttcttgaggctcatatagtagctattctgttcagtttaagatttcataacatagttatcatacgttaaattaaaactgacatttccaaaacatatctaattagggttagcagctacgttgaccatagtctatggctaaaagaagtcagtccacaaattcaataaattgttgtaaagaaatggaactgtctttaacgtatatcactctcccatacagatggaatttatactcatgcaaattggcttagtagaaagtatacaagctttaatgccaggtcatacatttcccgtcctcagctttatcactcccagtcaatgggaccttgagcaaagccatctcacctctgatcctctgggccttcttccatcaaaatgtgctcatcctgcccacgtcacctggcttttgtgaagaatttagcaagataacggtgaaatgccaagcacacacactctatgttcaagaaacatcagctcccattttgtgcaacattttccagagctgtttagcttcttaaaaattccctttccctgcaaagcctctggtgttttccactacatccatcaatgccaacctctcgcccctggccatcctcatgtcctcctgctgttctcacatctgtggtctaagagaatacaagggtttcccttaaaaaaacatattcagatcctcccacagcctgtgtcctcacacatgggcaactgaataaataattcaaggccacccctggttttcctaactcctttatttttatctgtcttgcaaacacgtgttgactgggttgtttcagttatctgacaattggccatggtatattggaaatagtactggactgaaaaccaagaaacctgggtctgaagtctttgcgacctcatccattccctctgcctttggcctcagttttctgatgtgtaagccaaagatgttctaggctttctcaaccaaggttcctcttctaaattttaagacatggaaaatgatttgtgtaactatttcctcatttctcccaaagatggtatataataagtactattttagtttcataggagacaagttaattcattatatacaatggatgccttggagaaacactgtccaataggatttgctgcaataacggaaatattctatatcagtactaagattatagccattagccaactggggcttgaaatgtgactggtgtgactgaagaatcaaatttcaaattttatttatttttaattaaattaagtttaaatagccacatatggctaataggtgccatattggacagcacatacttagagctttaagctttaattttcatgaaacccaagtaagaaagatgagctctcccagctttggtatcctgcatgtctatgatttcattgtgtatgtttgtgtgtgtttatgtgtagatataggtatccatgaagacaatgtgaatgtgaaaggtaggaaacacatacaattcctagatgtgtaggacaggacatcatacatttgcttcagctggatgattatttgttcactcatccaagtatttattgggagcctgggatgtatcaagaattcactgaaactcaggtggctttatgtgtatcacccacaatgaaacatctaaagcacatagacgaaataatgaatgaccatcaaggtcagcatggttcctgaattcatcccagaacatttgtaaccccagtgtcagtctaaagccagtcatgtgactcaaagccactatgcgtggattgtggtcatcctaagggaatgcctccattagcagtgctgaggaagcctttctctccactcctacttttctgcatttgagtatatttgtataattgttattattgctactccaagagtaactcatgtatttaaaatatgtagaaaatttagaaaaccagaaagagtaataatagggggtgggatcaatcatcctatattccattgcccagaaattgctgctgataatattttgtttcatagtgttatttgaacattgagatattgctatagatttagctttggatgttactttttcatttaatattatagcttacacattttccatgaagttgcataatatttataaatatttctgcaataactgcttggcattccattaagcatattaaccatgggctatttaatgattctcttatcactgaatattaatattagtgtgcttgcaaaatttccacctacatatggtttcatatttacaatgataaggctgagaatgcaaaacctacaatttgaaggtctgcactaagttagccatgagtattagcacatgcctaagtgactggtatccatccatccatccatccatccatccatccatccatccatctatccatccatgcatacacccatccattcaactgcttatactgaccaacattataagataagttgtgtgctgtgctgtgtgaaataaaaagatggttattagatattgactttgtcctcaaggacctcacaatctattaggataaactctcctgcatgtcaaaaaaagttttcacagaggaaatgatgtcaaaggtgaacttgaaggaggagaaacatcagccaagtgaaaaaagtctgcagaggggatgtgggtaacatgacgcaacatgataggtagacagagcttatcatggagagaaacaaagctagagtgaagcagaggatagtatgaaagagcattgaataccacattatagggcattaggggataaaatcactgaaagaggtaagcagaggcatgacttgttcatcttgaggtttggggatgatctactgtccgctgtgtggaggaggaacggggagaaacagcacactctgatgctcacaagcacacggttcctgactgtgtgagcccagaggcatagtgaacgtccctgtgaggggaaagccataaggaaggcttcagacctggcttctccattgcatcctttcaggtagccaaagcacagaagttcttccaggaatgatgaaagagttatcatcaggaccattgcactttgagaaataatgggttgtgctgggacatttctcgacgtcttcccgagattttgtttccagtccctctgcagaggtcactcagatttgcagttttcagttcacaataagacaggagaagaggactcattcctctcccttctccacaactgcctcataaacagatgccaaatctggaaaatgagtaggatcccagagactctatagccaaaggaagattgaatccagatacacaagacccaacttggtaggggaagccatcataatattccacttctgggactggtcccattgagggattggctagccccttggaaagccgctacaatgaattagatggcatggtagagaaactgcttttgactgtaaaatcgaggagtgactcatccatccacagaatgtcaaggctggatggttctttaggcatcatttaatccagccctcttattttcagaagaaggaaccatgccatcttcatatttaatgcctaaaacacaagatggtgtctggcacatagtaggtacctgataaatattgtaaaaggagtaaactttgagaacgaaatggagcaagagattttctcataactacattgcaaatcctcagtggagctttatatgcctgataaaattaaaattattgcaggtggtgagacttcagcctgttgactttgtgctgctaaaagtcagagaaatgtatgcatcatcagaacagaagccacttaggctcaaacgaggttcttgctgggcaatggggaggcatttcacttacggttatttccagaagccttggcatatgtaggcaggaaagggggaaacacagatttgttgtgtcctctgccccattgactctggcctagtcccatcagttgctcattcaactgttcctaagtcggtgcattttccctctttccttggcctcctagagaattgggatcagcatgtcatctttgcctggaagggagaatcctggtgcagtatgcttccaacgcttcctccccaatgccctgcagcccatcaggacactggagccctcgtgaagcagaaggtaagccagccttctggaagctcattgacaggaggagtgtgcaaagaacagctctttcaatgtatatggggttttattatttttatgggtctttgccatgtatcatttcatttgagtaacatcatcctgcaaggttagtagtcaagcgctcatccatttgacaaatactttttgagcacttgcactatcctaacatgttgttctcatattacaaatgaggaaacaaagacaataagatattaaagaagtgcccaaggccacacacctgatacaaacacagtgtcttgggggtatttatatatccttcagaccccaactgcttgtagttacaaacaaggccactttagagtcaatacaaatattttggggcttcaaggcatcagtggtctttgattcttcttctgttatttcttagactatacagagcactttcacatgtgttgcaactattccttttaatttcttctatataccctctttttgggatctatttacctgtaagacacataaaggaagtgccttatgattgccactattatgggttccacccactatcagactcttccctgctcagggttgtctctcaggcttaccaaggaaccaatgatctctgtgctttcttacatcatcattgaaattaagagaagaataccttttgccaaatgcttgttgtcacactttgtcacttggcctcagaaccaggctggcagaggctccatactttcctcttagtctttcatctccccctccctggtactcagggatgtacacatagaccctgcccccacccagtccctcttgctcttctgcaggttagctcatgccagcagtcactgggtgaggacactattacaccagtgcatcagagggagcggaatcagtcttctcactgaacaccagtgagaactcctccgctatcctctatatttttagaaagaaggttgaaaagaaaaagccagagatagaataaagcaagggggaaggatcagagaggaaagtgaagttgaaaaacgacggcactgcactttattttttaaagtagcttaaaataaaaatgagagtcaaacttgggaagtctaaacaaatccatctggaatgtaaagcaagagggatgtctgggaaaagccctcagttcagcctcacagaatcacaggctgtcagacctgagagggatgcctggggtcatctggcccgggctccccccaagtgcaggaatcccctctatgtgcatcctcactgaggttccctggagcctgttcaagctccagttttttaggaagttctcgaaatctgcaattgtaatttttccacccaaactgaacccactttgggttgtcacagagaatgtgtgtctctgccacctgacaacattttgcatgcttgtatctagtgagcctgtctcactagtgaccaacacaggcactatatgctgggcactgtcttgggcacatgggcaaggcagtgctgagtgtctgctagggaagtcagataagtaaatggccaattaccattcaatgtgaacaggcttatggtaatagaagtaccaagtggtgctgggggcccataagaaggggaccccatgcagaactggagactcagtcttcccatgaaatatcacaacactattaacgaggtgcatctgagaatgtgaaaaagtttggtatgttcacagagtggctgttttctaaatctacttcagaggcttatagggttcctggagacgtttatagggtatcctcaaagtcaaaagtattttcatacaattacatatgacatcatttgctttttccactctcattctctcctgagagtccagtggagctatctgatagacacatgacatgtgatgtcatttgtgctctgatagctaatggagcacactcttctgtattcttgaatttttaaatttcttagctttagtttataaagcggaaactactaatagatataacctgcataagcaaaagttcagtaaggctataagagtttaagtaggttcagaacatgtaaaacaaggtagaggtggcagaggtaagacagatgagatagataatggccaggtgaggacgggtttggattcacagcaagggcagtgagaaaaccatgtgctttatgagggcatgatatatggtaagacctgcatgtcataaagattgctcagactgctgtgtgaagaagagatcaagaggatttggttgctagaggaagggaagcagcaaggtgactgttgccaaaatccagctgaggaatgatggtgggctggtgaggtcggtggctgtgagaatggagagaagtttatggggttgagaggtacttggaaggtagaattagcaagattctcccctgagatgtctctggctaaaattatcttgctttgttctaccacttgtttgaataaaattatttccagacatctccccacacttacatccaatgcaactattagttggtgaagtttgctcctagtttgttcctgaccttcttaaagcatgatatgcagaatggagttcaactggaggcactgaggtctctggttccctgagccaattcggagctccaaggaaacccagcagccttgggttttcctcctatgtaaatttagtacatgtgcaccaggaaaagacactgttctttttttagagcatcctattacagtctctgtgatccttttggctcagacccttttaatatccttgaagaaataaacttttccatgagccaaactctgcaatttatttctcaactcattctcatcctatttatcttcacatgtttaagtttttggacttcccaaactaacttaaaactcccaaattcatgagcaatgccagacatatctgtatggttggggaaaaaacatggggaatgcaggggagggaaaggaggaggattggaccatggtctcagccctactattgatgtactctgtgcccttgagtgagtcacatagcttctctgaaaatggcattgtatccacagaatgaaaagttgaaatataatatcctttctagctctaatattgcatggagctgtaacttcttttcatataatcccatattaactagcagaagattcttcatttaacaaatctttattggaaatctactgcatttcattagcttcatttctaagaaggtaaatacagtcatagaactgcttgcctttgttcatagacagtggttgcactcctaccccttgagcaaaaactgtatttcatacatgaatatttttgagatatttgacgccatgttttatctgtagcctataaattagataaatatatatttcttgatctgactgactcaaatcccagttaagatcacttatgcaagtataaaatagatcccaagtgttgggttttccatgagagattagcacatggcactaactgtttttattttttctcatttgtgtgttttctctatttttctgcccagaatatttcaggtgtgcttaactattcacctggaaaaaagcttggcaccaagtttttataactatatttgtgtcaacagctgcagtgtatatatatatagatatataacgggtgcctgtatagtgcttcacaaaagtaaatatagatcagcatgattatgtataaatatatgtctatacacatatatgaccttatttctagtggacagtttatataaacatgtaatttttaatttaatcactgtatatacaaaaggatatctattaataatgaagtaacagggcttttacacttagttctcttttcttctttgtttattcttttctccccttccacctttcctcctcccccttccttatcttcttccttcccttctcgctttgtttcttttcttcagctcctgtccttaccttccgactacatgtccaatcaatctcccagctgtgttcacttttcctccttaggaattctgacttgccatctccttgcatgctttcttgcagttcatatattgtctgcgttagtccaatactctcctaactagtcttgcaagactaaaagctccctgagaacagagatcatgttggcaagcttattctcttggagcctagcctacctctggacacacctggcactgaatagttactctttgaatgcatggaatgaatgggcggatggatggatggatggatggatggatggatggatggatggatggatggatggatggatagtgtctgtgtctctaaacagtggtttttcttttcttttctttttcttttttttttttgagatggagtttcactattgttgcccaggctggagtgcagtggcgtaatctcggctcactgcaacctcagcctcacgggttcaagtaactctcctgcctcagcctcctgagcagctggggttacaggcacgtgccaccacaccgaggtaattttgtatttttaatagagatgaccatgtaggtcaggctggtctcgaactcctgacctcaagtgatctgcctgcctaggcctcccaaagtgctgggattacaggcatgagccaccgcacctggccaacagtggtttttctaaaaggcgaccctgatgtcactcatttgcttaaaatttctcagtagctcttcgtctatttcagtgtaaagttcagtttcctccttaatgtagtatacaagccacttcacaatcttggttctacttagcttaccagcctcagcatttgttgctctacaattgcacttgaaaaccatagtaaccttaacttacactctctcccaactattctcatgcttggaatacctcctcttaccaatattttccttgttaatacgtccctactttccaggacagagctaatatatttatgggaatctattaatgatctcatcctatttgaggtttacagcaaccttgaggtaggtaacattacagtaggtaacacaatgagaaaccctataactgatattttaacccaactttcattccttcaaagcctggcacgctgcctggaccaacaatatcatattctactccctgccagggaatttctgaaccatctgagtctcagtttcctcttctgtaaaatgaatttcataagacctgcgtcacagacttagtgccaacgtaaaaagacctgaggcgtgtaatgtgcttggcacagtgcctgcacattgaggatggtcaactcgtgaaggctggcattattaatgaggttgctgctttggttatggttacacttggtgcctctagggactcttttttacatctaagggtttgtctctaataaccagacaaccacaagctttgctaagatttctactcctgtttacttgcttgagcataatgaccagactcaccttcctgtcctttggaagtatttggtccctctgttgattaacaagaaactagggaggaaggatgagccaggcagatttgtcatctttgctctcctgtggcttcccacccctgacagtcattttctccaaggaagggaggaagattacatcatcccttgccagttgcaggagaaagcccatggaggggtggaatgttcacctggcacccaccatcaggaagcatgctttaatgttctatgctgtaacttttaactcaatgttaacaggctagaaggttaacaaatatttatttagcatctgctatgtgaatactctatggactaggcacactgtattaagcaaaagctacatggcgttgagcgaagcagtgctctttaatagagacaaaatgacaacgatcttacaggattttgatgacaatcagatgagttaactaataactaggagatgtgtttcatatactgtaaagtgctgccttcaatgaagttgactgaatgaataagtgatacatgtgtgtcaacatcccacaaagttaagaaagtcaggaactcagtgtgtgggaaagtagacaagaagaaaggcttcagctaggtggggagtcctacttgtgttttacaccctaaactaaaggttgctttgagccagcagttactgcaaataatgaatgaaactagccaaggagagatagaggaaatcttgtaattaaatccatcttttcttgctgtgatgcattatatctaagaagcctctgtgtattttctcacccctccttctcttttcctcttctcttctccatctccacttggtggcttctttctttccttggctaagcagaggcaaggaggttagaggcatttacagccttcactggcatagttttttcactccaaataactttctagtattgacattatagtgattcctgttaccctgtaacattaccacaaagcgtttttaagcaaagatcttttttttttcttatttgcttcagaaatgtctagggtcaccaccaccctcccaaccaaccactgaggctgaagaaaaaaaaagaatgtggctaggtgggcatggggacacatgcctatattcagctactcaggaggctgaggcaggggaatttgagcctgcaatgagctacaatcagaccattccactgcagcctaggcaacagagcaggactctgtctcttaatttttttttaaggtgtctagttgggcaacttgaggtccttcatcttaccatccggtctgtctctctcatgaggctcccttaaacaaattagagccaatcactacattgagtcctggttattttcctcagtagtgcaaggaagagctctctgggagtctagatgtgatctcagcagagaaaaattcagaagtcgctgcaggctgagatcagtggggatgaggcatcatctccctagggaaagaggagaagaaaccctccttccttctccccgctcctcacccaaccctccccttcctgagtgagacagaacagagtgcggagaagctcagtggtatggaatgactgcatgtagagaaggggaggaggagagataagagggctccaaggctgccttccagctctgttgttcatggttctagacagtttcctcccaggtcctcagtctgcagggtggatgctatttatgctcacctattctttgctggtcggggggtggggttaggatttctgtcagtccaagtaggttttaccaatggcagtaataccacaaggattctaatttattctactgtcccctgcatccaatagggagaacagcaaagaatacagattccaaaatgaaacaaaactcggttccaatgctggcttttacacttcaagttgtatgaacctgatcgattcactctatatttgggagccttagttttatcacctcctaaataagtccttgcaagaattaaagttcaggggacacagtgggtgtttagccaatatgtaccctttacttcttttcatcttaggcagcacagcctcctaagtggaagatgaggaaggaaagtttgaacattgactcggtagtgagatgaaagcagtttgactgaatgtctggtgattcctctgaaatctgtattgcaggggtggggatgagatggatgctgtgtgtatagcagattcaccaaggcaccaagaaccttcctctccttttcccctctgtctaagttctagtcagaccaatttctcctggggtccacaggaaactctaaggatgggaataaagctctttccccaagaactcattccctcatctcttctgcataggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgacctttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatgtaagtgcattctctgaatagggagtttattaagtgggtgggttgtggaggaacgtgaggtgggtcagagaggcctggacagggggaaggttcatcacagtcaagactcactctatggattgtaacccatcattgggtgtagatttgtcttaacatggcagagttgatatcatgggaagagcaatagggaaggaaccattagacctggatttagtgacaaatctgatgtgtgaccttaagcctcataagcctttcttaatcttagtcattccaatagtaaatgaaggaggttggatgagagtagcagtgagaaaatcatttattactaatgaaagtagaagaactgaagtttgctaatgattttctttttatattaaattgaagacaatttatgcattttgattgctttttcagtgggtgaatcgggggtgaagttatagtagattgggtgggggttgggcacagtcctaggtatttgcacaaaaattgtgctggaaagtgaatatcaactttaacagcacttgtttttgtcttatttcctgaggcagaacagtggttcaaacccatttgatccttagggcctttgcagctttaggtttccgtaactctttctggatgctcactgctcttatgtgaagtagtacttgtctttcatactcacttcccggccagggaggtggctcactcctgtaatctcagcactttgggaggccgaggcaggcgggtcacctgaggtcaggagtttaagaccagcctggctaacatggtgaaaccccgtctctactaataatacaaaaaaattagctgggtgtggtgatgaacacctgtaatcccagctactcaggaggctgaggcaggagaatctcttgaatccaggaggcggggttgcagtgaaccgagatcatgccattgcactccagcctcggccacaagagtgaaactccatctcaaaaaaaaaaaaaaaaaaaattactcacttctcaagccacctctctattacttcttccccaaacatcctcagaatttctgtcttaggaggaagaccatcttataatgaagccattagtgcttttcctgtgtactagaaaatgggctaaggtctttgcatcttttactcattccatcctctccacaaccatagccctattattcttattttacaaagaagaaaactggggcttagagatgtgaagtcacttgtccaagatcacacagttaggaagcggtgaaggtaaggattggaatttcgttctgactcctaagccactgcactcaactggtgctcaattaaagatgtgattccaacttctgttttaatctacaaaaaggatagagtcttcgccatctaacttgggtgtcaatggtttctataggccttttgtggctctttatttggttctaaaatgatgtaagacaatctctgctctgtctacttgaaaatattcactaagccaatcattaatgggaaccaagttctagaggaaacttttaatctttttaaagggcagaaccactttcaaacactttaccagcacttccttttacatactagcaattaatgtgcacatcacaggcaaactcttgctaattcattgaatcagagatgaggaacagctgtttaagaactcagaaagagcacttggtttgtgtttgagaatgtacttaaaatttaaaggatagtcttgccttaaaaatattccataaccctgtctcttccatctcctcacttgtctagagtggtagagttctataaatatgcttccacttaaactttctttataaaacaatggagggaagaaataatagatgttttaaaatctcagtttaaactcagctttcctttttttgcctcgagttacgagcctatgagagctgccatgggttgataagtttgaaatggtgaaaattaaactgaataaatgaaagaacccttagtgatttagcttagttctattctcagcaaaatctcagctaaatcactaactggctctaccctcttaggtgagtcacttgtcctttctagtcttccgatgcctcaactttgcatgcaggaggttgcactggattaattcttctctctctctttttttttttttctttccaagacagtcttgcactcttgcccaggttggagtgcagtggtgtgatcttggctcgctgcaacctccaccccccaggtataagcaattctcctgcctcagcctcctgagtagctgggattacaggcacgcaccaccacgctgggctaatttttgtgtttttagtagagacggggttttgccaggttggccaggctggtctgagaactcctgacctcatgatctgcctacctcagcctcccaaagtgctgggattacaggcatgagccactgcacctggctagttcttctcaatttggattgcacatttaaaaactgggacatttaaaaattgcctgggtctcacttgtatcccatctccactctcccccgagatatttatttaatggttaagaataaggcctgaccattagaacttttaaaatctcataaggtgattataatttgcaacaagtttaaacaagtttaaaaaccagtgcacttaaacaagttctcaaagtgtggccccagaccaatggcatcagtatcacctgggaactgagaaaggccaggctctcaggccccagtccagcctagtgaatcagaaactctgagtgcagggcctctccaggtaatttggatgctagttaaagtttaatagccactgctctaaattatctccaaggccaggaatctccaaattctctttcactcatgcaactacttgctcaactcacaaatatgtaatgagaacattctatatgccagattctgtactggaaacagtattaggatgactcagaccagtccctttcttgaaggcactcaaacttaagtgctgagctcctacccactttgtaaaagtgccacgtactgtgccaaatcatcagtagtgaggtcgacactcttatgcacaatttgttctttcattcactctccaaatatttctttagtccctactatgtgtcaagcacaagggctagactgaggctttcatcggccttcctcttcgaatcttttgtgtttcaaggagtttattggagatctgggctgggatgggctgggcttcctgacctgaatgttctctgagactgaaaaaagagaaacacatccttccaaatcaacctaccatttcaactcctttatctcttggtaatttgagtcctgaaccccaccacaaatacctctttgtgtgtatatgtgtgtgtatgtgtattttgctgctttcacattttttccatatcaaataaattggctcttatacaagttctatataaagactgttttggagaaaaagaggagagggaaaaaatgctttctttttctttcctgactcaacccattacatgattccctttgacctttgtcttcattttttttctctcaacaaaaatatttattctttctgttatctacactggagatagtttcccaaggtatgacagtgatgaagagagagccttctgtgcttaccccatggaaacttctagtagactgattacttttggccaggaccagaaagaaatgtggaacatctccatctcccttaagtggaaacccctctatcgaatgagaaatgacactatcagaagaaagggtaccagtgccaactctgctacaaactcaccatatgacacaaagacacaccgcatcacctatttggacctcagtttccatatctgtacaatgagaggccaacacattaagcccttctctatgggtagacatagagaaggtgtctggggtaacaggtgattcacatacttttttgtagtaaaaggaattcaatagggattatctgtaagaatcagtacccagaggaaacctcactggctctgtatgccctactgaaatgtggaccacaataatgacaaccatttactaagtatttcctctgctttaagtgccttacaaacacttctgaggtaggtgaaaaagcttaaattcagagagtaattaaactaacctcatacagctagtaatgacatagacaggcctcaaacttaagtctaattccaaattccaccttcctaaccactacccatactacttcctactacaataatgtaaaggcagaattttagagctgagaaatgcatccaatctggccaaagctctaaatatagcaaggggaagacaggcttacaagtcagaggccactagtccacaatcagtccctgtggcccacccttgatgtcttggtgtccaataacacaaattacacagacagttctttatgcttctggctgggaagaaatagcagggaagcatctttttctccacttggctgtcaagtgcttctacactgagcactgtgctccttggcctatatggaatcttcagatttctccaagaagtaaatactctggacaaaactgagaaagcaaagtataaagcaaaccaggaacagtgaacagtagctcactctcatctacttattggtctgtctcattcatccatcacttcatgcaacaaatattcactgggtatctattaggtgctatgcactattttaagaaatggtgatccagtggtgctgaaaactcaaggtgctcacagtctatgggaaaagagagggacaggcaagcagtgtcattgcagtataataatattctgatggaagaaacagaaacacagagtcagaggtttctaacccaaacttggatgaattgaagtctaaacttagaactagaatataaactccccgagggctagatttttttcctgtttttctcctggtgcattccaagcacgtagaacaattatagacacaaggtaagcactgagaaaatgttctttaaatggttctggaatgaagaatgagaaggaatttagcatttgaagagaaatggagaagccaaaatgtagtaagcttgtactatgtgtcaagcactaactagggactttacatagataatctcatttgatctaatcatcccaacaaccccacaatgtaggtggtcctatccccagattatatatagggactggaaactcagagaaggaatgtggattatagtttacagctatcaaggggcaaagctggggtctgtaagtagatctgtcaactccaaagctaatgctcttgatcattcattctctgattgaacaagtatgtttgtttatgcctctgtcttcttaggatcctcagttgagagctagaaatattcttaaaagtcatctctctcaactggcttatttgtgtatcccaatttagtcatctattaattcttctctcacattcagacctgtaaagcttccaacacaatctatatctattttatctcacctccttggcattctcaatataattctttggggaaatgaatagacataaggaaaggagatgtttatatgatctgggtggacattcttgtgagtccaaattttacaaatcagatccaaatttttgcctctgaactccaaatgctttgaatacccatcaattagaaactttagtgcattcattaattcacttgctcagcaagtatttgttgacttccaacatgagcttaactactttctaacctctagggattcaataatgaatacagcaagaaaaactttttgtttcattgattattatcctgtagttgggagagataaaagaagcatgttattatataatatcccagttggaaaagatttagtgatttttagataggtggtcaggaaagtcctctctgatgagatgacatttgaacagaaaccagaagtgtcccccagtaacttataatgaaagctagctgagctgccatccctgggatcccagcctgtttggaatatgaatttcttataacatgatccttagtccttgatcacagtttgtgttgtattatatttaacagtgcttgtggtttttccttcacctggttcatattcttaagtacaaaatttatgacacttaaatgacacaataggggctccatggatacttgttgatcatgtgaagaataagtcagcagtagcacaaagtgggctctaagaagatgcgtctcttgctttcagatcttagttataacattgatatgtaatgtcatattaagcctcagaggatttggaaagtttaccccaaatcagggtcaggtgaaggcacaggtggctcttacatgctgtttctatggctcttgagctgagtcaccactttctttcttcctttttttttcctaagcctcatttctttttatagctctttccgtttctcaccttgtcatccatcctttgttcttgtatgtattaatttattcattcattcatccatcaactagtgaaaatctaatataatccatgttaagtaatacttgtcccatttaacaaatatttattaaatatctattctgtgctacgaatgcagccctgattaatacagacatgatctctggcctcatgagcacatggttctaaatgaaaaatattatactgcagcatgaaaagtgttatggtgtgaggagcacggggggcaggggggctgtgagaaaacatgggaagggtgtctaactgagcttgaataggtaaggagggcttcttggaagaagtgacatgtaagctgagacttgaaggatgcataacagctgatcattgaagaagttcaccacagttcaaatggttgaaactaagtggatgttcagccaagattgataaatgaatgaaagaataaatgaagggaggaaggaacaagcatactgcatgtcagaagggcatactcaaccacagatcaaatgtacagctttgagatggaaattgtattaatttgggatatctatctacttcaattcttagatatacttcaatctttttagctgctgtacagtatcccacagtatgaatgtgctgcaggtaatttagccatacccttaatggtgggcatttaggtcacttcacacatttttctgctgcaagcaaatgttgcagtgagcattctcgtacaaacatccttgcaggcacatacatgcaagcattttgctagggtgaatactgagaaattgccggtgataagctatgggcctttttcattttaatggacacaactatgacattctgggcaggtgaactagcttccaccccactagcagtgtgtgccaagacctgctattttgtatcatgactgcttattatttggcataatgaaagtgttttttctttgcacttttttacccactttgatgggaaaaatatgacttctcattgacatttctgttatgtgctcttaagtaagcatctactcaaatacatttactggataattgcatttcctgttctatgacttgtctattcatatccttaagatgggcctcatctttaatctccttcacacctctatttctcattcgttaaattgggatttcaatgtcagccctattgcatgtccattaatgttatcagaatccagggtgaaataggaagttaagagggaaatagcatttatgcagaagttactctgattcttcttttatgtattgatatatttatcaaatgctgatttagtacaatccctgtgctaagaaccatgacacattctgaagatacaataggtaacaaaaaccagcccggtttctgctctcagcagggcttaaatttagtcactgtgttaaccatcttcacattgctaatatgatttgtagcatttactactggtagcactaacattactgctaacaataactaccatctagtgaaaacttcatatatgctcagtacttttttataagtctaccaatggtgtttaggtattagcatgcctgacttcttagatggagaagctcagactataagagataaggtcattgatttaaggtcccccagttaatagatgctaaagccaagttttatatccctttgcctgaccccaaagggtgtgcctggcaagatacagagcacagtcattgtcataatgactgacaaaggacaagatggtatcttgatcgatggagaaaatgaatactaaaattagatcttcttatttccaaaagcaatagaataaacaccaaagagaggagaaagcaaaatttttttattgtttttttgaacatttaagcagatgaggaggaggaggcttaggaagtgtggacatggccaaaccagcatgatttccagtaacctgttgctgaaatgcatgattcaggctggaccccttcctgagcagggccttctcccacgcctgcccagcatggttttgcctacattctgatgtcccacccaccagaagagatgagcagcatcagtatagagagttgtttttccaagcccagaatgaataccactgctcttagctcaggccaggggagcacatagtcagcacaatctcactctggttctggaaaccaggcattatccacctatgactccctctcatcagtcttggccaagtatttctcagaatgaaatatgggttctgggaatattaggataagcaaaagggcttaacaaaatcaactgatctccagggtcattaacagccatagaagtgctatctccaagtgccttctcaattttgaaagggtgaagggctcctgtttggtgctaataccaccaaaattgcttatataaacttttatagattactctaatgcactactaaactttgtagtaagtgaaccattataggttctcttctacagatgggcaaactgagacccatagaagttaaaaattgaaccgatagttccattgataaatttattcatttgtttgtttctacatttattcactcgtgcatttaataggagtgcctactgcatgtcaatctttgtactgggagtgtaactctgaatcttataatctggtaggagagctgaataatagtacacacaaaattataattacaaactgaagagtattatttcaagaggttataatagagtatacatcccccttaaattaagagagagtctgtagaagatgagtaaagagataagaaggagccagactattataaaaagataaaaaataacagatgttggtaagggtgtggagaaaagggaacccttatacacttctgatgaaaatgtaaattagtacaacctctatggaaaagagcatggagatttttcaaagaactacaaatagaactactgtttgatccagcaatcccactcctgggtatctacccaaaagaagataaatcattagaaagatacctgcacccatatgtttatcacagcactgttcacaattgcaaagatatggaatcaacctaagcatccatcaatggatgatgggataaagaaaacgaggtatatgtacacaatggaatgttactcagccattaaaaggagtggaatcttgtcgtttgaagcagcatgggtggcactggaggctattatcttaagtaaaacatctcagacatagacaaatacctcatattctcacttagaagtgggagctaaataatgtgtacacatagacatagagtatggagtgacagacaatatggacactcagaagggtgggggaatggaagggggtggatgatgggcaattacttaaggggcacaatgtacattattcagaccgtagataccccccaaaccctgaattcactctgccatctatgcatgtaataaaattatatttgtaccccataaatttatacaaataaaaaaagaaggggccagattatgaagagtttgtggctcatgttgagtttagatttattcattatgaaatagagggactaaaccaatcaggtctgagattttacaatactgccctggtattctgtgaagaaaggattgaggaagggtgagtgaatccatttagggttgactgctgaagtccaaaccaaagatgatgattatttgcatagaaaagtgaatgaattggaggtatgttttaaaggtagaaccaacaggacttggtgatagattggattcaagcagtttagtaagaagtagctgtttaatgattctccaacttctggtttgaatatctggaatgagggaaacgttatttcctgaaatagaggaatatattttaatttattgttttgttgggcatggggtagatcaagagttcagtcttagacatattgtgtttgagactcccatgagtcgtaagagaggaaatgctaagaaggctgttaaacacgtaggactgaaattgctcatggctgaactggaactattgccacccatgtctacttacaacatggtaagaaacctctccgcaaagtaacagaatctttttccataaccataaaattactatctcatccaccatattttctatcccacttatctttcagaatcattaaaaataatctgctcaatcctgatgccatccaaatagaaagaaagcaatattctatatggaaaattgtgtgtagttaacataacccttcctggtttagaatgattttaaaaggctttgagaaggtgttttaaatgtgtatttgaatgaattatccaaaatgcattaggcctgttccccatataatgataggaaaaatgtaataggtctttacaatggacctgacacacttcccattaatatataatctcaaacagatatcctaatgtcctcaacagatttttcccccattctataaaagatgctcagataaactatgtaacgggcccacatacacccagctggtaaaataatgggtttgatgactctaagctaggactatttgtgttattatacaagtgtaataattatatccatcatttattggctatgtacaaggcattgtgctaagtgctttaaaaaatttttcttatttaatccttttaaaaaattctttgagcttttattattagttccactttacagctgagaaaactaatgtttaaggacattaagaaacttccctctggaagagttagaggtgagattcttagccacttcaaccttgtgcctcttataaacatgcatgaataaacttgagtggaaagaaacttcctggcatgcaagactattggttagaattgagatgtttctcctcagaaatgatcagagtctagacattgaagtcaagtttgctaaaaagcaaggttatagatagaaaagaaaatgaaggccaaatgcggtggctcatgcctgtaatcccaacaatttgggaggctgaggtgggaggactgcttgagccaaagagttcaagaccagcctggacagcatagaaagaccccatcttgacaaaataacaataataataatttagtcaggtatagtgatgtgcacctgtggttccagttactcaggagggtgagggaggaggatcacttgaggctgggagggaaaggctgcagtggtgagccatgattgtaccactgcactccagcttgggcaacagagtgagaccctgtctccaagaataaaaaaaagagagagagaaaataaatgttgttaccttggggaaggagatgatgggtcttgatcatccagctgcaccacattgatagaggaaatgtgtctatatctctcagcagaaaaacaaacagagcaattgttatatgtccaaatatttctatagatgtctatggattaatagtttcatgacatattaatatcaattctgagagggaaaaagaggtctgtgtgtatgcaaggaatgctagtttcaactctattcaggaggtcttgttctgcagaacttcacagaacatgctacttttccttttaattgtgaggctcccagaggttgctgaaatgctttatgtagtctattctgacattgtttgaaaaaggtaccctgttttcttatcacatatcatatgactagcgttactgaggaagctcctttggaaaatgatgagttagtgaaatcaggttgcaatgtgtgtcctggtgtcacctactactttgttattttctgttcactctgggggtaggtaggatggactagacttggttgtgctgctccaattcctgatttttaagaaaacaaataaatgaagaggaaagagaaggaaaataacagctgtcagagcaattacagatgtgagaagaatggaggaatttatctcacactgggcattggcaagaggaatggacaaaatctattcagtctgtgcttggagacactgagaatcatgagggcaggtcttggtgggtttatgttgtgtctgttaaaacacaacctcagacaccactttagagatgctgaatttggaatcaagagatctgactcccacaccagcaccagccttgctgtggaacagctttcttccattgtttaagcttaagttccttcccttggacaaagtgggtgactgtccatatagtctaacaaggagtggtgggaaaaactgataagataatagacttgcaagaacatgatgcaatctagtgaactgtaaagatttaaatgttcatgattctttctattgtttgatttttcactacgcttgttcttggccagagccatgatagagagtatgtgtaaaaggcaaacactctgacacatacagacacacacacatcaagcagtttcccgtaaactctaccaggagttgctatgcttcagtgttgggttagaagaaggaaaagataaattgtactttaacctttgtaactgagctaaagaaaaaataagagagaaaacacaccatgtgctggccctggatcaggagacctggattctagtactggtatcctgaaattttgttgtgtccttgatcaggtgggtccccaactgtgggcccaagacccctgtctataaaataaaggggtaggtcatagctctgaaattctgttcagattatcctttagctctcacctgcactcagtgcatctaattaagtaaagacggaggcagcaggttacatgtcatgttgttagtaagtctgaactttgagtttgggggctggccatctagatctaaagaaagcctccaggcacagtgggactctcaggactccacctagacccagcctctctcttaggacttacaaagctcttcctttgagacaatttcaaaatgttttggtgcatttttcctggatggcattttaacttgacactgagatattagaggtgggggctgtgtaatatctgccatgttattctctacccctagcttcttgtgcaaggccagacatcatgtagatggtcaataaatacagataaataaatgcatgcatgcatgaataaatggatcagtaaaccctgtggtacatcaataagtggtcagaaaatcatgataatacacatcatatctggtatattgaaggtctttcttttaacttctaaggtggattagttactagaggattgaaaggacaaatgagaatcttacagcatggtcactgctcctcttggggcctcagctctcttatccttaaagcaaaggcattgggccagaaggtgtaattctgtgtttcattcattcaacaggcaattatttagcactgtctgtgtaacaggtcctatagtaggcagtgaagataaaccagtcagtaagggacatactagcctttcaggagcttagtctacttaatgtgaaagtaaacacataaacaagtgatatctaacagtgcaaaagctattatgtaaagggaagcacatgggctaagagctcctcactcagcttcacaggttagtgagaatctcctgaaagaggcagcaactaagccaaggcaagaaaatttagccagggaaggaaagtgagactgcttgctcagggtggtggctgagggtaaaatttcaagaagagagtttgagcaaagaggccagagaagttgacaggggttagatcatgatgatcccagagttcattgctgtaaggtctggacttcatcctgagagtggtgatgagccattgagtgtctgtaaggtaagagaagatcttcattagatttggttttaggacatctttttggctgtgtgtgtatgtctggatagaagtaaggatggaggcatagatcaaaatggtaaacgaggaaaagcaatgttgccaaaactgaagtagatgatggcacttgtctatggtggtcaagtggaaatgcagagcaccgggtggggctgagggatattaatgggataaaatacttggaaaactaatcaaaaggaggaggcaggtgagtgtgttatgaaagatgcctgtgttactggcatcactgaaacacacaatgaatgcagctatagaggcatatttgggttgggatgaaacaaggagaaggagttcaaaagtgccttccagttgctggcctgtgaatcagaggcaggcatacagggcagttcaccttcagccacaacatttctttcctatgcagagatgcaggagcaattgaggcatacatatgcatgtttgtatgcatgtgtgtgtgtgcatgtacatgcatgcatgagtacctgcatatgtgtgtgtgtgtgtgtgtgtgtgtgtgtgtgtgtgtgtttggagcaggcaaacaaagacctgtgagaccacctgttttcatcatctgctgattctcaaagtgtagtccaatgttctaaagaggtcccatggggtatcgggggttaatcttccatagaactaatacctataacgttacaaggctcaggctttgttttctacccaggattaatcattcactcatgggctttaatacaagccagacacaacctcactgtgcaaagcaatgccagctccccttccattctgatgctagcttttacattcttgttgtcagagtgggaactaggtttttgccccagtttcagaatcctatgaagtgaaaagtttagaaacttccatccaaggatgttagtcaaaaatgccaggacagctggactcagccattaatttgccatatgacttgcggccatttatttcccatatctgggctttagtatccatcccacaatgagaaacttggagtaagtgatattcaaagtcatccagctctgatttctacatatttgtgtttccttcttgagctaagctctgtgtatacgaagtcagtctccaaaaattttaagcagagaattttgagatgcttgaacttcttactgtctgggaattagactgaaaaactctcagaccaggaaagattattgaagatcatctatgccaggactgacacttgacatatgagagaattgagctgaaagaggaagccacttcttcagagtcacacagccattcaatggcagaacagagaattgaacttagcgctcctaattcccagtccaggtgtttcttcccctatgtaacagagtgttggacattggccagaccttgggactcacatttgaactcagctccctctgatcatagagaagtctcccttgtttgctgggaatgaaatcttagagagctgacatagtaacgtcatggcagctggtgccggtgatggggttggtataggaaatgagagaacacatttggctaagctcagggttcatgtgaccctccaagagtcttaatttcaaaacaaactcaaccttttaggttcaagttctctctctcatcagaaatgtgacttcctgcttctaagaagcaaggcttacaaaagagctcagaagacttcgtggacatcaaatagctcttacaaaatagcgttttgatgagttaagtgtaaatgaatcagaaacataaggattacattttccccaagtgcacatgggtttcagaattgaggggaaatgtagtttgctaactgcacgctggttttcatggaactcaagccactcctgggaagggtaaggggagagaagaaagagaagcccagtccccaaatggttttagatgtggtgccaaattcgaaaatgctgttgggtttgccctctgccagtaataaaattgctggccacccagagaggccacagggaggagaaaggagatggctttccttactggcccctagtcctccacaactgtgttcagttagtgccgctcaatcaccagctgtcactggggccctccgttggactccctggccctgacttggcctcgattttcacactctgcagcatgcctgtttacctccaactgtatctggtgttttggctcccagagtccttggtgactggtcagcttgtcacaagcccctgctctgtaatcaagtgacctgtccatcaccagtagaatgtttggggaagctgtcacacatcgcctttggttgcattcaggaaaaaaacaagagttctttgtagatcttttcctctctcccttctttaatgctatccaggtgtggagtttcctccaaactgttaaatgtcttcccttcaaatctcagtctgacacaaattaccagttaaatctcaggaccgctgttacctcgtcccgggattcgaagctctggatcttttataatttccacattgtccctccattctttcccttctattttgttttattgcaccaagaaagtagaaaatcatttcaattggtggtaaaagatgattaaaacaaaataacaaaggccttggctgcaaactgttagttttattaaattggctactgtgttttaaattagtaccagggcaaatctttggacaattatatcaaagattgctggaattaatcagtcacatgtacacaattgctcctttcagagccttgtacagagtaaggatgtcgttgccagtaggaaaagaatgagttttgcattacctgtgtgagagggatggaccctagccccattgagaaggaatccaaatgcccaatggagtctcagatctctgtcatctcatttttcatttatttaatccagacaatgggttggagctcacagtgaccaccaggagaaataagaaaatggatgttacagggcaaaaggccattttcccaaagattttttcttggcactgagtcctcagcatgacagctttgctttaataagggggcacctgaagtggaagggctgcagtctactgagtagctgggtccagaaagagggaagatgggtgtggtgggatcccaggctatacaaagactggaggcagattcagtatctcaactacccttagcacatctaagttctgacttctacagctggagataggctggaggcttggagaattattgcattcagttccttgcgtttacaacagtgattctccgtcacttgatgattcaagccccaacatctcacctcagagcctcctgccatctactgctcactccacccaaccattttagcgaaacgtttccacttcctttggtataccgtgaatttcagtctaaatgaactgttcttaatctagaaaaatttacctctgtcttgttttatgctgtttctactgctcagagcactatacttatcactcacattttttgatatgtgtgctttctcaaactattaattcattcaacagatattgctgagaacttattctgtgctaggcactgcaccaggcacagagatacagcaaggaagggctaatattctctgtccttgaagcacttaacatacaccaaggtagtcaggcattcaacatgtgattgcaaaatgtgtgctcacttttgtaataaagtatgggacactaaggatacctgtggaaggaaaccaacataacccagctatcaaaaaaaaaagcctccctaagcctttctcgttctttaaaccactatttggtcttcctctgctagcactctccaaactctactttgtgttacaatcacactctacttggtttatcctctcttttgccctttgaactgtttgaaaccaatggcagtatcttcttcatctttgagtcctccattttgactgagcttcatacatttttttaaaaaattgaacaataaaagtgatgtccagagaaaaatagctgattgggccacaatcacaacaaaaactaataaaacagtagccatttttttctgatacttggtccacagtcagtatgttaaactatctttcaaaacatttcttcccaagggcatacaatactttctgtctcagatccttaccaaccacccctcaccaccaataaaaagtgagaccaaagtacctctcagtcaacagaaataaaaggtttccttaaaaattcagagtaatactcagacaaaattggaattaaggcatacatagtcatcactcagtggaaaaaactgtgtgtatataactttaatatgtgaatattaagaaataaattcttttgagaagactaatcacagctccaacgccattcagtaaagaaggacattttgtaagttttagttattgttaaataaaatagaatataaaaatatctagcatactaccaaaattttctaggtactcaatttattccatcctacagggaatatttggtctctttgccttcaggtactgccttttcaactttccttccaaactcattatctatactgctacctaaatggtcttccaccaaacaagtatgatgatgtcatttgctgggaaagccagtcctttcctctttctcctgatgacttctgactttctccagtcaagccagtatacctccttgggaaattttctcactccctccccatcatcaagggtaagaaaccaaccctctgtgctcctacagcccctacattttttaggctgttttaaagcctcaattttaatgttgtctcttccttgccatccaatgagcatcctaaaagcaggaccataatgtgttcatctttgcatcccagaaaccagtgaaggctatttcgttggataagtgtaagcatacctaaaacaatacaaatatatttattcagaaattttaaaaaataatcaaaccataaatataatcagctagcattaagctactatctgggtttacttgtcagtctttcttcatgaacactaaatatgaaatgatattacaaatttgtgatcttatatttatacaaaataatgtgtgtatgtgtgtttacacgtagaaagatactgaaagggccgggcgcggtggctcacacctgtaatcccagcactttgggaggccagggtgggcggatcacaaggtcaggagatcgagaccatcccggctaatacggtgaaaccccatctctactaaaaatacaaaaaattagccgggcgtggtggtgggcgcctgtaatcccagctactcaggaagctgaggcaggagaatggcgtgaacctgggaggcggagcttgcagtgagccaagactgcaccactgcactccagcctgggtgacagagcaagactccgtctcaaaaaaaaaaaaaaaaaaaaagagagaaagaaagacactgaaaggatcctgaccaaaacgttcctggtagctgtctcaggataatggaatttgagattattctactttaattctttcatatagccttctaatttgctataataagcatggatgatttttattttggggagaaaaaagcaattgagattatatactgtcacttcccagtctttttttaaaagtcagcttccattctaaagatatgtttgcgttgaaacgattgttctctacctttctacatttaaaaaatatataatataatatactctgagtttcaccttcctaaaatactttagaaccataaagggaagcttgttttatcttcaaatagtttttgtggtctgtattttactggatattactatatggctcactagggtgtgcccatccaaaaagtcagctcaatgtcttggaaagataaagggttctagagtcaaacagcatggtttaaatcttgttttataattgttacatctctgacattgagcagatgactgaactacattgaatcgcaactaaaaaattcaaataatttctgcctttcaggtttatattagaaatagtatggaaaatttggtaaagtaactaaactaaaaacttttccaatatgagcatccattggatattctagataaaatattacagatataactagcatcctttaaaatgcctgattgagattagaaaaacagaaaaggatatttccaggggcaagacatgcaagaaataaaatagaactgggaactaaacaggtaaaccctggatctaaatttgtggttggtatagtttggataagggagagccatcagttttggcaattgagtggcttgaatattcttgttcaccccaggagagatgtggctttgcaactctgcaaggtagtgtattgggactaacacttttaaaataaggattttaaatgagattttcaggacccctgaaacgacccctgaaaatctacatgtttggtgaaagggtgtactagggaaaaaatatgtatatgcatatgtctagctacctaccttaataccatgataattaacatgatttgatttaactgtcatcttactatctttgcctaggatctaagtggaaatttataaccattgtcttatacctcaaaagacttgatgtttgaatttatactgctcagtatggtgtgaaaatgcctgagctgaaaaattaagtgaaaaaaaaaaaaagattccaggttagtgatgttgcagggatacctagaaattaacgtaaaatcgctctgagggaggacatggacttgacccagggagcacatgattcccacagattaaaacccactgaatctgaaaattaaaaacatgaaaaaagtaaacaaggcatcaaaataagggtcagtaaacaacctaagggctttttactaaattttgactttggtgagaagtatacaaattagtattttagaataaacagaatgcaataacaacaaaaaataaataaaactagaaagtacaattttcacagttaagatgaacaaagaagagacaaataatggaaatttaaaaattcgataaatccaagtgaagggaagaaaggaggaaaggaataaataagcaaggaaaaaatggaaacataagtcattatactaatcagattaaagccaattggatgaagatagagcttctctagtcagatttaactcaagagttttgctgaaaggttaaaggtaaaggtggggacaatatttaccaggtaaatgctaactaaataaattaatatagttttcagactaaggaaacatttggcaaatatgttactgtgatttaaaaaaagaagtcaccacataatgataaaaggaagatattatgatttacaacctgaatttatgaaataatatgacctgaaaatatataagtcaatgacttttacctaaaaaaagataaatgcatgacattgtgatattttaacacatttttctcaataatttatagatcaagcaaactaaaatatagtaataatctagaagatcttgaacaacacaaaaaagtttgagctgataaaaatgtatagaaccctgatacagaactaaattatgaatatttccttcttgaatagagatgtagactattttttaaagttttttttttaccatgtactaggccacaaaacaaatttaaacaaatatcaaagtatcagtatcagatagaacataagctctgtccacaatgcagcacattaacaaacaaaacacaaataaacaaatgaaaaaggtaaaacttttcaatcaatggaatttctaacaagcgaaaatcttatatatttgccaacagaattcagcaatgtattaaaaaccacatataatgttaaagaggtgactttaatattaggtggtctattaatgtaattcacaatatttgtgaattaaataatttttaaaacaggaatttttactagatgtagtttttaaaaccctgtaaaatcagattccttcatgatgaaaaaattatagtaaactgggaataagtacaatgtaaaaagttttttgatcacagggtcatcttcagaatgcccagttttgccattggtctcctacctagcgcagctggacaaaaaataaaaacaaaaggctgggcacggtggctcaagcctgtaatcccagtgctttgggaggccaaggcgggtggatcatgaggtcaggagatcgagaccatcctggctagagacggtgaaaccccgtctctattaaaaatacaaaaaaattagtggggcatggtggcgggcgcctgtagtcccagctactcgggaggctgaggcaggagaatggcgtgaaccccagacgcggagcttgcagtgagccgagatcgcgccactgcactccagcctgggcgacagagcgagactccgtctcaaaaaacaaaaaaagtctgaggattgaaaaggaaacgacaaaactaacattattcttcatctactggaaacaatatagaaaaattactaagaatcaacaattactagaacaaataaaacagtctatgaggacttctaaatataatataaatttatataaaactcaattatttttattatccccaaactattagaatacaaataaacctacacgtaattatgtgtatgtgtgtgtgtgtgtaaatagctagataaaaagctactatttactgtaggactgacacctataaaatgcttagagtaaggcatatattgctaataaaaaatcatcaccatttttataatgaaagctttaaaactttactgaaactataaaagaagacctaaataagtaaaaagataaactgtgtgcataaatgggggaagacacagtatcataaaaatgccctttctcctcaaatacactgatacattcaatgaaattggaatcaaaatcccaacaggcatttgtaaggagaaagcttcacatggaatttcacatggaagagcaaggggcccttttgaaaaggaaaactatagaatgaacttataatgtaaatcaagacttttatgttgctgtggaaatcgctatagactgctaccgataaaacagtagataaaaaatagaccaatgaggctgggtggcatggctcatgcctgtaatcccagcactttgagaggccaaggcaggcagatcgcctgaggttgggagtttgataccagcctgacgaacatggagaaaccctgtctctattaaaaatacaaaattagccaggcgtggtggcgcatgcctgtaatcccagctactgggaaggctgaggcaggagaatcccttgaacccgggaggcggaggttgaggtgagccgagatcgcaccattgcactccagcctgggcaacaagagcaaaaatagaccgatgaaacaagataaccccgaaaaaaaaaattatgaaagtactgaaatgatatatggcaaaggcagtattacaattcagtagtgaaaggattaactgttatcttaaagagattaactagtgctggacaaataattttaatacatatttggggggaaaaacaatccttatttcacatcatttaaaaaactatactgtgggccagacatggtggcttacgcctgtaatcccaacactttgggaggccaaggcaggtggatcacctgaggtcaggggttcgaaagcagcctggccaacatggtaaaaccccatctctactaaaaatataaaattcgccaggcatggtggcacatgcctgtaatcccagctacttgggaggctgaggcaggggaattgcttgaacatgggagacagaggttgcagtaagccaagattgctccactgcactccagcctggacaacaataatgaaactccgtctaaaaaataataatagtaaataataataataataataaaaacctatattgtaggtgcttgaaaccatataggtaacaaacaaaaccttaaaattattgaaaggaaataaaagagactattttatgatcttagattaaaggaatgtttattcaacaacatacgaaaaacacaaatcatgaaggatacaaaattctcttatcaacaaagcagcataaacataatgaaaaattaggagtcatagaccatgaaatggtatttacaatggctttaattataaagaattaatatccagtatatgtaaatatacttatgtattaatatagaaaaacaaaacttaatttaaaataggcaaaaagatgaacaaacaatatgcatgactagaaacctacttgatccacaaacatgtgaaaagatactcaggcttgttagtaatcagggaaaggcaaaataaaacaataattaagtatcatttagtaaccatcagattgaccaaaaaaaattacatatttggcagaatcaagtgctgacaaggaccagcactttgggaatgggaagcctttgtgcagatgtgttaattgatacaatcattttggtaaatactttggcaatatctaatagttgaagatgcaattatcttaacctaatgataccattttagccttttttccctcagaaaactcttgctatgtgcacagaggaaaagaacacaaatatttcaagtaacattgtaaataataaacacagtgattaaataacaataatagcaataataaaagaaccaacctaggtatctatcaagaaaagaatggccaaataaattatgatatattcatatggtaaaatatttatgttagtgaaaataaatacgccagatctacttgtagcaatatgtgtgatctcaaacaatgctaaggaaaaaagaaaaacagccagctacaaaataagtatagtattgaaacatctatgaaatttaaaatatgtaaaacaatacactgtgcaaaaagtgtaaaaatgtgcatgggaaggaaatgagatacaggaggagcatacaggtgggtttaaacttgatcagtatttattcctttcacaccaaaaacaaaagatatgaagaaaatatggcacaatgttataatttgacaaagctgtatagtaagcctatgaaaatttgttatagtatagtctgtacttttctatataagtgaagtattttctaattaaaacaataataatagcatgtatagtctttggcacatcatctcaggctcaaaaagtgaatgtttccttcccttcccattcttggctggagggttatatacaaagtgcccagacattaccctctggttcttagctcaaggctacactggaatacttggactcttcctgagccaaagtcatcctaggtggtcccatcttacatcttctaactcagacaatctgggtggtaggtccagacctacacacgttctcagtgcagaattttaaatgctgaagcagtttctagcctatggaaaagctcaagacataaggatacaacacaacactcctccttaaattagacccatggattgcagaactaatcatcacatccttcccagattcttctttcatagttaaaaaaaaaatgggtggacagaaagaggaaatggcttgtccatggtcaatgagtcaacggtagtatttcatagggaaatactatgaaattaatacagaaaaacaaagatttggaagtcatgaaacacaaattccaaatctttcaactggtctttgtatgtaaggtctttgtgatccaaaacaaagtcttttgatttctattctgctgtactttgagaaagcttggggcttctgtctttggaaagcactgtcttggaatggagttagacagaactggttcaaatccctactccatgacaaaaatattgtgactatcggcaagtagcttaatcttcctaagtgttagtttcctcatctcacaaggaggataattattcgagggattgttcttttggttgagactgtaaatacaaaatatgatacgtagtgcgtagcatataataagtaggcaacacatagaaactatgatagctgtttttattccagaggatgaagttttaaagaaatataacacagtttagttatagagactatttgaagagatagacaatgataaacgaatgctatgatatagaaacaataggatcaataatgagtatttaaggagctcagagagagttttctggaagaagcaaaatgtgatgtttccatagggtaatgagcctgtctctccccttcctcctatatgacttttttgtttcttatttgaccttcacagtggtatgggacaagaatcaaacatcctaattaaaagacagaaaaacagacccccgcaaaatcacatgacttgtctacagatttcagataggttttaattgacctatcatattaactacataccaataaactttaatttatgcattttaaatgcatatttaagcttaagtcataaggtgcttaccctccttatgtatatattaatattttagataatgatttcacaacctgtaattaaattttagtgtaagttgtgctctaaattcgatacacatttaccatcagtatgactttctgaggcagaatactgagatcatatcaaccagaaatgccagcatttttgtttctaattatcagaaatacaaccctatggcacatatgccatttgcgatatgtgttaaagaatgacggttaaatgtagaaaaaagtgttttgttttgttttgttttgtttaaaaaaaaaatgcatgagggccaggcacagtggctcatgcctgtaatcccagcactttgggaggccgagtgaggaggctcactggatcccaggtgttctaaaccagcctgcgcaacctgattagaccccatctctacaaaatatattttaaaaattagccactgtggtggtgcatgcctgtagtcccagctactcgggaggctgaggtgggaggattggttgagccagcgagtttgaggctacagtgagagctgtgacttctgcctgggtgacagagcaagactgtcttaaaaaaaaaaaaaaaatcgcaaagattccacagaacaacccttcaaaatagacaaacaacttcatcacatttaaatatattagctacaaacataaaatattcagatgcagactttatgatttactactacggatggttgaagtttaaaaagaaaaaacttaaaatggcattcagaatttgatgtgagaaatcagaagtagccaaaataatcacatctcaggtgatctgctaaaattttagttccaaagaaagagtaaattggaagtttcagcttggtagcaagctgctgtcgctgcactaaatgaaaagattttgagctggacagtggctctaaatttaagaatattctgacgatgttggcaagactggaaacgggatatgcttgaagcaggacattaagccagaggctgctttggccgtcaagattgacatatgggcctcaggagagctgaagaaaggatgacgtggaaactcctgggtggggagaattgagagggcttagggtccatctgaatgtaggaggcacaggaggggaaggagttcaagtgatagcataaggctttccagatggttttaggagcagctgaaaggaacaacttgacaaaaatgtcctacttttagaccaacaatgaaataggttctaacctccagcaaagccttcagaagccactagcttatccttctgaaagaaatctattctacctaggttcttgagaaaagagccctcatttaacattaactctgacttaaacttgggtaaaatatagttttatcataggaatttttccgtggaaaacataatctttttagtaactgctgtacccatcccactgtccccaccttttaacttaagggagtgacttgggtttttatttttcaatctgaaaacttgggataacaacaccttcctcaaagagctgcttaagcttctggaaaacaatgaaatatgaaccacacacacacagctagaagaaggaaggttattaaggtttctgtactaatcaaatatgatgttagtggataagaaggaggtcggtgggtagacgttacagggacacagatttcgccccagggtaaagagaaaccttctgggatccagaattttcagaagctgaaatgggtcacctggaaagagagcaagctgccaggcactgggggtgttccagccaagtgaagtagtagaaaagatattttcatcaagccacggcacacatggtagatgatggctgcatcttcacgggtttgcctcaccaaggttacattacttatttgtctctccatctcttctagtaaggggaccatagcataaattcagtggacaggaatgttgataattaaccattaattgtaatggattaacatttattaaatgttcgtcataggctgggcccatatgtgctttataattgttctcatgcttcatctgcagataaatgctgtgaagccaggtttatgactgatttgaaataggctcagaaaggtaaaacaccggcccatgacttcctggctaataagtgaggcagccaggacagaaacacatgttttcttgtctctgtgttgatatttattgaggaaaaggaggaggaagagacgcgacgagaggacaaagtggagagaggagcaaaacattcacaaatattagccaaccaccttaaatatcatcagccgcaaatcactcgtgacacatgccagaagtgaaaaacacaatgtagagaagtacttttcatactcacccttttccagagaactacccccatctacttagacaatgactggatagccccagtggactgggatgtagtctgaagaaaatttcttattttatatcacaatgtggccgtttaaaaaatataaagcatgcctctgtattttagaaaaaaatgaacgcataatacaaggcatgtcatatttatcatgtaactttgtgtatcccctgggattgttacttttttctccaccccactccagttttagaattatcaccaggtgaagtatatgctcattagtctagatgtggataaagtagccaataagctaaatgaaatcataaaccctataattctatcaacaaattaggattcgaggtttacaaaacaaccatcactcatgcataaaaatctctcaagatattggtatgtccacctatttcatcttcattggcagagcactaaatctccagggatttttggtctacccacaatattagcagttccagtgctgctaaaacaaactccctttggggtaatacatccaacattctcaggaaagttgtgttctttcccagagtccttcaatgctcataaactccagctcattattgtgttgagagtctgaagacattctctgtccattgcccctgcacctgttatcttgttggccttaaccaaacagcccaagtcctaacagcagctgaaataacagacgggcaggagaacttgagattttttgacatcatccttttgtttatgaaatcccccccaatgctggaatctgacaggaattctcttcattatcattttgtgttttttcccatggtactttgttgttattaaaaaattattactaaaaataattgatgcagaggtagatgaaagataggaataacatcttcatttgaaaattgtcaaaaaggacatagggagggggatgtggtcgtgtggaattgacataaacatatatttgccttggaggataattggcagtagctgtgttcatttggtggtgtgtttgtgaggaagcccaagcaggtactaggaggtctttaggtcagaggagagatgcagtctaggcaagttggaaatctggcaggaagcagtccttggaattgcgattcccaggacatgacccaactttgcaaggggtgaggttattaaaacagacctaaaatagggataagataggcagaatataggatatcacttaatagcatatgattgtaagcaagttgctttaccttcctatgcctcagattcaccatctgtaaaatcaacatgtaaatactagcagccatgtagggatgttttgtttctcaaataagaaattcatgaaaagtgtttagcctaaggccctatattctattaatggatgctgctattattattattattttgtcgagagtgaaagaaatagggagaagcaagtggcagggaggcagagagccactgtacacacagcatcagaaaagggtttgctcacgtgtaatggagtttctgctcaggtcttaaaatgaggaaacatgatcagataatgccctaagaatctgatgtggtgctttcccacctctgtgcttttgtttatatttatttttcctggatggcttcctcacaaacgtcttcatttttagtcatttgccatctgatacttttccaacagggttgctgtataggttaaattaaagaaaaaaacaacacctagtaagtacatagttatcagtcaattgatgctggttattactgtacattttagtgtagtccattatacttagctaactgatgtagccatagtggacaatagaaagtattggatagctaaatgtgcatttgatttcaaaaatgagcaagactgatagaacctactccaggggatcaattttccattctctctttgtctgcccagtattgtaattgtataattatgtcttctttgtattttccagggatctaaatcttggcagtgtgtaccagtattgggtcataactatttcaggaactgaagagagtgagccatcacctgctgtcacatacatccatggaagtgggtactgtggcgatggcattatacaaaagtaagtagatctaattaaagaaagaagaggagggatgctggttaggtcaagagatggttagggtgctgaacagaagagcttatgacatattcttcagtgcatgagctgtgagctactagtggtccccagcagtctctggattggtctccaaacaatttgctgaactcagaagaaaagcaatgactctttttgaacacgtacattttgcgactatgtaatacaatatatgatttagacagaactacccttatgtacctactaccatttgctcttgctctcagttgctttatgtgtgctacaaggattccattagatttttccctcacagtcacagcgtacattcagttaacaggacacagttcatctaggttaaaacacttttaagttctttgctggttaccattcacatttatgaaaactgcatatttatttgttatctctattgtatcatattatacaacaatttacaaaatgggtcaaaggcttataaaaacagtggagtattttaactcactacaatgtttaaaccataaataataaacagtgctctggagtgaatattgaatgtgaatatgagtacactgaggcaaatgaagcatcatttgtgggtccaatcagtaagtgtggattttatcagattatcaacccattcatcttcctgttctcaggacaagatgctatgcaactggcaaacaggggtgaggagccaccaagacttttgcattgtttaaaactcaataaataaacttttaagtgcttttcctccagaataagaaaaaaagttttctagtacaaaatagagaattttgtctctagaggtggaaaagagaccaataattattcaaaattaaatctcttattgctaaaattatgttcctcattgctaaaatgtttatttgcaagtcacactattgctaagagactttttaaactattgacagatttaatgataaacattacatgtggagaaggcaaaacaagctattggcaaaattccttcattaaatagcactgttgggtgtcacataatatctgtgcaatatggaattgcaattactatttctataaggggaggggtggtatgaaaaaagaatttgcttcacagttggatgaaaccactgatgtgtagaacatgaatcaactcgtaggagtagtacatatatgaaagagacacattagatgactctttctttctgttcatcactaacactaagctagaggggaagaacaatttaatttgtttctgatgattttgtggtatggaatgtaaactggaaacctctgctttaggatgaaaggaccagctaggaatacagcaaggatgatgcagtaatgcaagtgaaaagagctggcatataaatactcatccacatagacatcagttatttgccagcagtgttctttctgaacatgatttaacattaaaggcaatagaaatattgcaaacatgatcagatgattggtaaattatatcttttaaacttgctgtgtaacaagatagtagcatgtacaagattctgttcctctttgctccccactccacaactaaagtttgccaactgttaatgaaaagataccaactcaagtttttaaaataagaaatggcggccgggtgcggtggctcacgcctgtaatcccagcactttgggaggccgaggcgggtggatcatgaggtcaggagatcgagaccatcctggctaacaaggtgaaaccccgtctctactaaaaaaatacaaaaaattagccgggcgcggtggcgggcgcctgtagtcccagctactcgggaggctgaggcagaagaatggcgtgaacccgggaagcggagcttgcagtgagccgagattgcgccactgcagtctgcagtccggcctgggcgacagagcgagactccgtctcaaaaaaaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatgtttatttcttaaatgtcctacacctaaaattttatatctgaattgtcaaaatgtttaagattgaagagattagtgtaagggtttataactgttgcattatggtgcaaatcagctgattgccaagaatttgactcctcaagcacagaatagaaagctcctcacttgtttgagctatttaacatacaatgctgtatgtatttaagatccacattcatatgaagcaacagaacaagaagatacagtttccaatgcagtaaaattggggaaagggaaacttctcactgttctctcccacattaatacatcaaattccagcttttgataaagttgctgtctgatggaacattgaacaactaaacagaggactctccatggagaaagtaccccatcatttgtgggtccaagattgaacttcatatctagactatccagaaaacatttgcagtcactggtgataactcataattgtgatttgggaatttctaatttagcccaattttttttttaagtcatcagatttggagcctcatctacagctcatctcagctcatggtggaaacagatatagatgaattggttaaacactgcaaatgatatcattcttgctgatctaaaactattagtatcataattattattaattttaaatagtatacttaatacagtttttttttagtatttttacctagaattagtatctttcataaacatcaaacacatgttcagttacctgtagatatcaaatatttgttgatatactttgtagaaaactaaatttagcttatggatgtttccctaagtaggggtgggggggtaggggggaaggaaaactttggggaaaagaagggatatcatcttagctaatacgatttttcatggaatgatgcaagttaatttgctctgtctgtaaaataatttatgaagaaatatggatagactcagcactcagtgaggcccttaatggatgagtgctgtcttaaatgatccatagcaacaggttctacatttgatagatcgggtaaaggtgaaggcaatggatgaacgttttgataatgacaataatatttatacacacttcttgagtctctactgtgcatgaagcactgtgctacattattgtctccttgagttctcccacccaacagccatgtgagataggtcttattataatactttacggataaacaatgaatacacaaagagattacagaggttttctcaagcttccacatctggtaagatgtagaaccaatacatgaacagagggcccagattctcatctggattccccattgcattgttgtgtgatgtgacaactctgcaaaactaacaagtaaaggagtggctgcatgctgtctgttatatcctaggcactgtgccagaaactggggtgctaggatgatgaagactctgtcacttcctttggcaaattacagcctcttataaggggctctcaagtaacaggcaaaggcagtcagtttgacaagtgctgtgatagatggagcaagatgtctgtggacacagagaaagatggccacccgctccagccccagaggtcaaataaggtttcgcagaacttctttatctaatgatagatctgtcatgcctagaagatatttgtagtgacccgaatattttgtttaaaccagtagaacactgtttgggtggcgatggaagggaggttgaaagtaagctttgtggcttagggaaccagcccaggtatttttttgtttttaaagtcttttccaaaacaacctatgcattagcttagaagcacaaggtcatcggcaatttccagcaagcaagacccactgccagacaatgctgagaccagctaaaaatacaaacttcttctttgctcataggtgtgcagacaggagaggacttgggtggctccttggagatcaattcaatgccctagccatcttaaggattgattgcaaggcattatcctgctactctgacacctcttaaaagcaacaaacattgcccagtgttaattgcctgggtgaaaggaaaagtctaaggcctcttccatgctgtgacaggtcccagctggtctctggggagggagggacagctgtcacacactctgcagagacctcccaacgcaaagtgggaatggggactgtgattccttgagcatcttctatgtgtcacccactgtgccaaccactttaagctactcagaggcataggactaattatctccattttagcacatgagaaaactgaagttcagcatccacaggagcactgttcaatggatttttctgcaatgatggaaatgtgttctgtgctgtccattacagtagccactagctacatgtggttcctgaatacttgaaatgtggctactatgactgaggattggaattttaattataattcatttcaattaatttaaatgtaaatcatcacagaaatatcagatcaagaggtcaagtgactttgtcaagattatacagttagtttgagacatggggttctaaacccaagtgttttgttttttaaaggatgaccgttttccagaaagcagtaacccatccagactttcaggtgttgttcctccttctcatcacctaagcccaattcaaagatcattgctcattttctgcccatcccaaccctttgcaaaatcatccttaggtggtggaaataattccaacaaaaacaaagggggcattagtatttcataacagtgtagtctcgcagcccttggagttcttgacaccaacaaatgacacacccgatggagaaagcaaaactttccaatggaaggatgactaaacttgaatgcatgaatgaaaaaaaaaaagttacctttaagtatattgggggaataagaaggatatcaaggcagggagtggtgaaggaccagaatctctacattttccttcaaatatgctttttttaagatcagagacaaggaaatgtctgtgagacttcctagacactgtgggagcaagaccatttatttgttcattagttcttccatgtcttactcccatctgacttaactgacttgagatctcagagaatgagttggaatcaggacttctactttgtcatcagaaacacaaagcaaggcaaatgtgaaagtatcttataaatccataccttttagaaatctcattttgaagatgaagaagcagagactcagacagagaaagggatttgtgcaaggtctcactgaaggttcatggcccagggagggacttttccatgtccagccatggttttaagactaaattggcaaatttctcttccatatctgctctgcagagaccaaggtgaacaatgcgacgacatgaataagatcaatggtgatggctgctcccttttctgccgacaagaagtctccttcaattgtattggtacgtctttttcatttcttgtggccttcatgaagaaatgaacggtgcagaatggttggtcaatgataatgccaacaatagttatgactaaatgatgattcactcctttgtattacacctgtttattgagtgcctcctacatgccaggcactgttttcaatatcgggaaatacagcagtgaaaaaacaaacaaacaaagcaatccctcaagagcttaagctctcatagatgatgccaatgacgggtaacttcttttgatcaagctttaccttacaaacatccctgcttttcttcacactaactgtccaggatgggtattactggagatgttttaaggcttttattcctacttcagagataagaaaaaatcaaacgccagaaaaatttcaaaagttgtccagagttatacaggtcaaaagtgattaaagacagaatcaggacttgaacctgattttgtctgattctcaagcacgtgctcaactcattttgctttgcaacctccagccgtgatgcaggaaccaccaaggtcccctctgcagactcagaaccttgggcagtctctctgatctgaggaaggaggaatagcagaccagcctgtgtttagaaagcaaatgtccttttcccaccttcaccgagtcatttgggaaatttgttttcctctgccttctcttggagtctggctgatcttgttgtttcagccccacttgggaggccctggtcagccccgggctggtaaacagacaggggttgggaggggcaggggtggaattttgagctggtccagatgagatcatacttcctttaagatgcaaatcgatacctgaagatcaaaggtcccccagctaatcccctgggctggaggtgaaaactaatcacaattcatttgcaagtacaaaagacagaggtgctctatctgaagagagaaggggcagttacaagcggatgaaaaccttcgtgggaagatttctcactgacaggcaattttctaggactaaagaggaaaagatagcattgcatcctcgcatctgcagtgcattacaggggtgcatttagacattctttctcccagtagattgtgagctccgtgatggtgaagaccatataccatgtgtctcttattcaattctcaacacgcatttgttgagcacctactatcttcttggcacccagtaggggttgagcaacacaatagaagtgctctgtaaatatttatggttggaagataggtagatgccccaggagaaaagacatgggagtttctaggcagggccttgggttttaaattgccaaaaaattttctctcctctgttgatttgaatatggtccggtccctagtaaaagcttgatattagcctagtgatgtggtggaaagaactttggattaaaattaggaaaaccaggttctagtaccaactgtgctgagaacttacataaagctggccaagtggcttccctagtcttggcctcagtttacctactgtaaatttttaaatgattgggttaagtggtcctaactcttaacttaagagccttacctgcacttctgttgtgtgattttttgaggtgggtgactgaattccttctaattgtgaactctacctgagccaaactcttacctttgtcgtcatccttatggcaaccaacactagtcccagaccatgctgaaaaatatctgcctgtttgacttgcactaatgtggcatgtaatttatgtgcttctggaaagaaagtaggatggggtgaaggtaggatatggtaccctgaaagagatgcttgagccttgacattcatctgctgtgttgatttagagctatgcaatgatcaggaaaaataaggacatctctaataggtagaagctcctcatccatggaaggggtctgcaaactatggtccataggccatagccagcctgccccctgtaattgtaaataaagatttattggaacacagtcacactcatttgcatattgactgtggctgctttcatgctacaatgagagttcagtgatgacagcagagattctatgacccaaagaaactaaaatatttattatctggtattttacctgtgaagtttatcaacccttgttccatgaatttgggatattttatatgcttgtttactggagccaggtgcagagagtaggtgaaaattataatgtggttcaccatttcttgttaacaaaaaactgaattttaaacatacagtgtagctgggagtggtggcgggcacccataatcccagctactctggaggctgaagcaggagaatcacttgaacccaggagacggaggttgcagtgagccgagatcatgccattgcattccagcctgggtgacagagcgagaccctgtctcaaaataaaataaaaaagatgagggagtttccaagaggatgagactgagatcctcctagattcattttatagactgttgttctctaccagattctgtgttctgctgctgatggtgatatttgcttaatacttcttatataccaagcacatttataaactcttattctcgtaacaactcttttactgaactgctctttcaaaagaggaaattgaggtatggggtgatgatctaaggatacacagttaaatggtggagctggaatttaaacccagagagcctgactccagagctcactgtggtaagctacctgcaaaaaaaaaaaagatagctcctggtcttgcaggctttcagggtgaatgaaaaaaaaacattgcaaaacaagtcgtatcacaaattaatggaatggaatacaaaaccatcagtgttgtggacagtgtctagggaaggctctctgttacccctgtatgttcagtggaatttgtattacaggaaagccttcagctacgcccttcactggccacttaaaatctcattatagacactcacagagatacaggcatcccagagatcccagctcccagggactacattccaaggacaaatcgtgtagctgaagtctagaaaactatcttcctccgaaaggaacagctgaaaaatagacagtgaatctttactcccagcagaccaatctttaatgagtcagagaagagagacaagtgtgggaggctgtgctgaggttgacattgttcccatgattgcatttgttaagacagtggtcaagataacagtcaggagatcaggcataccatgacttagatgtgtaactttggctaagcctcagtgttctcatgtagaaaatggtaaaagccctagaacccaacagtggaagatattgaccaatatttttggatactttctatcagaatttccttcttagacttaggagataattattctaataaggaagagcccaacgcttagtatagaagttgattatccaagcatctccttctccccgtcttctgggtagcttgagtgtgggtatatacaacctaggctttccctctgccctccagtcagacacaccaacccaagactttgaattggaagctagtagtgattagacttagggatactgtagacaccattttgctgaggatggtgggagtagccacatccataccagcctcctaagtaccagggaaggcatctagcatcaaagctgagctagctatgcacagcaccagctctggatcccctcactaaactagttctgggacctaatcttgggcttggaattgagcttcagagcacgcaagcctggctctccagagagtgttccatacgtaaccaatattctttgaacaaattttgcttgtttgttttgcttaagttatccaaagttggtttttgttgactgtcactcagaatcttgactgaaaattattgccataagataatgtgagatttaaccccatttctagcaagttggatgtgcttgatgcacagatgcacattagctattacttttctctatgtgtgtttgtgtggaatgttgcgggcacaggataccagcaacaaccaccatttatggatacccactaggtgataggttcttcatacgcatctttgttttctgtgaactacgggtcgtctcttgtttccgtatgtgagatctgaggtctcttatgacatcttaacttgcaccaggtcacacagcacacagaggtatgatcctctctccagtctgagtagagaacctggctttttctactctgccactctgcctctccatttgaatgactttcttccttccactgttctttctttgttcttcttttctcttcaccccttcctcttccccctttttcctctcctcctcctcttcttccttcactccttcttctgcctcatattcttctcctttttctccttctcttcctccacctcttctaccttcttgtccttctcctgcttcaatttagaagggctgatgttttctctggcttagtaacaccagcgttagggtgggtgacagatttatggtgacattcccattcacttttcagaagcccacacatccggaagtattcccaaggtgccagtgtgttattatgcaacaccctggggacttcccgttctcaatttcccacccctggtgccctcatcccccagcacataataagttgcttgttaaaatgaacaccacccacatgacctctcaggcaaggcaggcttcatccctttgcaatgtggaagttatcttgtctttttttcccctcttttaaaaatataacatacaccaggcctgaggtttcagtgaaaaaatgtggtatcagtaaaatgataactctccccaacaggcactggctgcaggcattgttcacagcattgggaattctgtctctaaagcattgagtcataaactacagacaggctgctgataaaagctgaaggaggtgggataatagtcaaattagtcagacaaaatgtgaagggtccccaaaaggggttatactgtgtaatatatctttagctggtgctggaaatgtgttaccttctgagatggaatctagtgcattacaggagatgcagctgtggagaagccctcatgctctgttttgactttccaccctgtattcttcagcatagttgggtccagttcccagtttagatctagaggcctcctggctgcagcttagcacctcagagcctcagtttcttcctttgtgaaattagggagactggactgagactctaaagcttcttccctcatctgatactgaggaatctccgatttgtcaaacagctatttaaaggctttaggtttcaaatcctgcctgacgctgatatatagttaagaaaacaaaggaaagggacccccacgtcgtctttcccagacgtggaggcattccctgtgtgtctctttttctccctccctccccactcctcttctctcccctactcctgccattagcatcactctgtgatccctgacacagcatccccagccctgtcctagagccagggccagtaactcaattagcaacccccagccccagctccctcccctcccctgtgagggacatcgaggagaggagaagaatcggtctgcctccccaccagttgctgggaggggcaggggttcaccgagccttgtggcccctctgtcaggctgctctggcctgctctgagccaaggcgagaaaggaaaacaagaagatgaatcgccacgtcttcttggtggaggttccgatgagactttagaacaacagtgactggaaagaaaaacagcatctgctggaggagagggggaagaatgggctctgctgggagttgcatttattattatttttctttctaacaacgtgaaatcataatagatgatccacctctcaccttaaaaaaattaaaattaagaaaacaaaataaaacttctccagactgcatgtattcaatcagacctccctccgtggaaaaagtagtaactttccccagaacacgtttttgaaataaagcttcccttggcttgaaggcaggcctatgaaagaggaaaaagaaagaggaatataggtgggggtcatggtggtagtgattaaggtgacgacgagggtgataatatctcagctaggttggtggcattcttaacactggagtaatgacatagggtatccattgttaagaacacggattctgggtggaaagcctgtccctgacacttagcttgtgtcgcagttttttcaatcataaaatgggttagtaagttcctacttcttagaattattgcaaggaaaaacaagtttatttttgtaaagcatttaaaatggtgacacctgcctgacaagtgttatagatgtgtttgctactgatgctattattgtcataattaatattttattttttattttaattttttattttttgagacagaatctcactctgtcacccagctggggtgcagcagcatgatctggactcactgcaacctccgcctcccaggttcaagtgattctcctacgtcagcctcctgagtagctgggattacaggcgcgtgccaccacacccagctactttttgtagagacagagtttcaccatgtcggacaggctagtctcaaactcctgacctcaggtgatctgcctgccttggcctcccaaagtgctgggattacaggcgtgagccaccgtgcctgactgaatatgattaattcagaagttatatccatcttcccagaaaccctatgagataaataatgttatccccgttttgtagaggaaaaaactgtggttcagagagatttagtaacttgcctacagttacacagagacatagcagacgtgagattcacagcatctaggcagagtctacacattttaaccatgaagttattccatttattagatacccagctgtgccagtttttctgctaagaactctttgtaaaaatgatttcattcaccctcccagcaactctgtagagtcaaaataattgcaccattttgctggtcagaaaattgaggcgttgagaggttaagtgaatatccaaagtcatatagccaggtaggtcagagaaggagacttcagagtttgtctgtctgccctaaagcctatgtccaactccagactaactcttgaaatagccagagagtgtttctcttttccactatttctgtttggtgccattgaatcacagcaggaaacaaaagtgaatgcacatgtccttgtgccattttcatgagtcatgaaacaacaattttcagttattatcaccctagaaatgttccatggcataaagctcatacccccaatggagggtcattctgtattttaggctgtattttcatttttaacagatcaccctccattgacagtagccaaatcgttttttttttagcatagaatgtgtttggcacttaataaagttgtcatagcaatgttggagacagaggagcttgagttcaaatgtctattggttgcaattactacatgggtctttttaggcatctctcaatacctctgagtctcggtttcctcttctgaaaaatggacgtaattataacacctatagttttgttaaggaaaagaatgacataacatctatagagtgtttagcacaatgcacagcagttagtggacaatcaaggatgtcagttaacgccacctcttcttccccttcctcattgcctatctcaattgtgactgatgcaaaggcagccaacccatcatcagcaaaaatggtcctgaaccaaatcctgatgctaaattacagtggtgccatttgcaaaatgatcaaacctcctagttctcagtttccccactgtaaaataatgagggaatttgatgagctcccagggagctttcagctccgatttttaggatttaaatcccaggttgttattgttttaaaactggtacattttaaaagaaatcagggcttggggaagagaaaggaattcctttcacccaaagggtcaaagggggtcactgaggggacaaaagagcaggaaaaggaggcgatggggcggaaggctgacgtgcgggcagcaccaaagatctgaagtactcaacagggaggtctgatggatgcattcaaacacccttgagtcagcaccggttaggatcaagcttgccatcctgcctcagaccaaggcttaccacctcctttggaaacccgggaggcctaccccacagagaggcagggctggaatgaaaagaaacagaacggcctctgacgccagaagggaggaattctagcccgcagcccaggtctgcttcctgactctcaggaaggggtcaggctcagggaaccgacttggtgcttgcttgaatgtgaggaatcgagaccaaactttgatgtgtgcctttgaaaggcagccagagtccaaggcaggtgaatctgggtagccaagaacaaggacttcattgtgatatttaaagtgaccagaaattcatctgcacatacatgtgccttgatgtacatctgtgcagttatgactgaggcggactgggagagggtagaggcctctaggctgggtatcagggccttttcttagctcctggctctcagttgtttcttggagtccatgttgggttggaaaagacatttaatattcatgagctgtgatctctacttgaagggagtgccctgagggaaattgaaatattaagcaagtgagggatatagacctaattgtagcctccttttctttttggacagaaaagtaatgtgcctaaaataaaatgatggatgggcagtaaggattgtgtgaaaacctcactgctagagcctgcaggaaaaaatcggctgcttgccccaacatgtgcagtcggacccaggcagaagattctgcaaattggctgctggatgatgtcattcattcatttagttcatattttttgatgcctgctgtatgccaggcactgtgcttgtttcaaagaaaacagcagtgaaaaaggaaggccagggaggttaggaaaatgatacaaataattatttaagtgtcattgtggaaaatggcactaaatggaaatacttggaagtatataaccaaagggcctcctttacattgagggggtcaaggagatctccttgaagatttgacatttaagctgagacttgagggttgagtaggatgtggactcattagggagatatggaacaggtaactgagcaaggattgcaagaagttaagactattcaattcccaaggcagagaagaacttttgaagagggaaaagcaagtcagcattgctggactgtagtgaacaaaggagggatgaggctgaagtctagcagtctctgatttctcaggcccttgaggactgtggtgaagctgctatttacggcatgaaggaaggagaagttgactcaagcatataccttctacactctctaccaagccctgccctgggcataatagccatgtgcatgcttgcacagaccaggtgtcagtaaaccaccacccatggccaacccagcctgctgcctgttttcatagacaaagttttactgaaacacaactatgctcctttgtttacatatttgccactacaaaggtggagttgagtcattccaacagaaatcttgtatggaccacaaagccaaaatatttaccatctggtcctttactgaaaagttgttgactgctggcagaggtggatgagtacacagttggcctgtcatatcctcagatcctacatcctcagattcaaccaatctcagatacaaaatatttgaaactaactggctaaataaataacactacgacaatttaaaaacagcacaaatagaaaaaacaataaagtatttccaatgtattaagttttatgagtaatctagagctgatttaaagtacatggtagggtgtgcataggtcatatgcaaatactaagggactttatataagggtcttgaatatcttcagatttttgtatccaagggggtccagagaccaatgcttcgaagatacctagagatgactgtgtaagcgggtaaaagtatagccagttgggcagaataagccagatgagagagacagcgcgaggagttagacaatcatttcatccatctccctcctgagcctataccagcatagctataatttcactgactcctcatgtattttacttccacatctgtgtcccttacccttaagggaagaagccttgccatctaccctcgtgtcccaacatccagctcgagccaatcattgagacactgaagcaaatgacactctgaggctaaaaagggtggccagaggaacccaaacagatgaccttccaaacggtttaggcagcatccaggatcctcccctgaccagtagaagggactgtattgatatttatggagaacctgctgcagtagctcatttcaaacccacagcacccctggctaccaggtattgttaacaccacattccaggtgacacaacagagcccccaaatgtttaagtgacttttgagaatgtggcctccattcaataaatatttactgagctgggaaaccacccaccagacaagcaaatcttcctgagtgctgcatcttatgccaggccaactgcctcacaccccacttaaccatcctcttgattttcccaaggctacgggaaggtaggggccattatcccccactttacacgaggagaagttcaggctcaagaagatgaaatggcttattcaaagcgggtgcttattaagtgacagagttgagatttgaaccaagatctgcccaacttcaaaactaaagtcaccagatgacctcctccaaaatatgaaacctttagaacaagaaggagccagtgagaaatatacagtcatccctcagtatccttgggcgatttctgccaggacctctgtgaacaccaaaatctgtggctgctcaattccctgatataaaatggagtagtatttgcatgtaacctatgcacaccttcctatatacttcaaatcatctctagattacttctaatacctaatacaatgtaaatgctacataaatagttgttatactgtaatgtttagggaataagaacaagaaaaaatgtctatacatgtttagtacagatagaattttattttgcatctcttgaattcacagatggagaacccatgaatatggagggccaactgcatagactgcatatatttccaccctttttccatctcaccatctcagacaaaagtcataatagtatacataactcaaattattaatttaattaaattaattggataaaattcactcaagctttttctctattaattccactggttaatcacattaatgctatgaggtagttttaacattatacaggcattataagtaaggaaatggaggcacagagatgttacgttcccagtaagggattctagccctggaagtctctggctcttaagccctcaggcttaactactaatttatgctacatctccatcattaaggttatctaataaagtgtgtactctcaagagctgaacagcctagcagcaaacagataatgagaaggggaaacaatgcaggaagctaaagaaatcttcacataacaaaaggatcccagggtctttttaagaaacactgtctgaagtgtttgtttacagatcattaaatacttaacagaggaagaaactaaaaaccactgactttctctaagccaatactgattaagtaccaaagagatgttaacataaagcaaataagaaattataataattattaaaggactgagtttttttcattttatcttactggacagaaagataaaatagcccaggtccagtgcctgtcactctgccctcatgcacacggttgcttttctctctcctccaggcagcagccatggtggtcctgcaatcagcctaaaatgcatgtgaccaggctcacactgattattgtctatattaagcacctgctgcatacaaagttctgtgcaatgcagggttaagcagcagaaacctttgttagagggctgcagaagacagtggtcattaaagatatgaagggattggcattagaggtcccctgggagcagtggaaagcctctggtgcaggggttggtgagcctgggaaagatttctggacagtgggactcagataagaccaggtttgacactctgccactataaagatccagacagagggtttttctctatacagtgagtgcaccagtcctaaaggaaactactccagggaagtcacagggggtgagtgggcagttctcatcccatagcaagcagtagtttctgggcagaggcataacatgataggagcagtattttaaaaaagatcaacctccctgaatgggatgctcttcaagggccaacaaaatactcttggcaaactgacccaaagagaaatcagggtgattttagctttcaacagcagtcagaaacccagcccaaattatccgtaagtttaaatttaactatcagccgccattggcaggactctgaaaggtcctggctggagttggttcctcagtttaggagtccaaaaccacatgtatagcttgagttcagcctcattaccaaggaagggtctccacaagagtctgaaatcccttttccatttgtcccgtgtgcattttgccaagagaacttctaaagggacagggagggaggaaaagctgattgaccagccccgaagcacaaggaccacttgtctgcctcagggttcatcccccaaatacctttttccacctgagaagtaggagtgatattcctgacttcatatgattgttatgatatattgttttattaatttataaacttattcattcatcacataggcttttatttattgagcacctcttatgtgccaggttcatgctagacaccaaggatgcctgtgtttgtgacagttcctgtcttccagaaagtgatcaacaaatattgattattatggctaacaaaaataataatctagttcttactcacaagtagagagtgacctgtccccggaagagattgagcagaaatttgagaatcattctttagggaagtcatgcatgagattctattaaatagcatgttcaaacagacatatttcaatatttttctcttttgtcttatctggctctttcttgaaattcagaactcctggtacctgtgaagtgttagcctcttctgtttttcttaacttttctgaccatccctccacagaccttctttcacctactctttaagtatcagcagtctccaatgttccataataggcacacttctcattctccattctctccttgtatgactccaaaatctctatctttagtctgggcctttttttttttttttttttttttgacccatgaacttgtatatctaattgctctactttgacgccccaagggaactcacattcgacacatcttacacaaagcttgccatctttctttccagacctgctgcaagtgtttttcctaatctcaactggtggcgccagtagccaaccagacatttaaacagaagcttgggaaacatccataactcttccctctctgccatttcccacatccaaataattgccattcttcccattttactttgaaaacgttatcttgtctgcgtccaaatcagtctctctcgccccatgatcattactctacctgaggccctcttcagctcctgattaggcttttataagagaaagcttgtaaaatgaacatgttgcttgttcatttttttgcttgccccaatctacctgcccataggtgagagcaagtttcctaaagtgcagacaccttttgttgctctccaattgagagtgtcagatggctccatgttgcccttgagataaatttaaattccttactgtgtcatttaagaccttgcgtgatctgagcccaggatttgcttttcttttctttttcttttttctttctttttctttttcttttctttctttctttttttttttttttttttgacagattctcactttgttgccaggccagagtgcagtggcactgtctgggctcactgcaacctccacctcctgggttcaagtgattctcctgcctcagcctcccaagtagctgggactacaggcacataccaccacacccagctaatttttgtatttttgtagacatggggtctcaccatgttggctaggatggtctcgatctcttgaccttgtgtcctgcccacctcggccaggatttgcattttatactccaataccatcttgtgctttatacctcctactatattgctggcctcatctcatttgctcacagtgtccccctgctggaatgtgctcctcaccacccgttcctcctctgagagatacagcccaggtgttgcctcctaagggaaaccttcttaaatctgggttagattggattgggggtccctcctctgtgctcccacagtatcttgtacctcatgagggtcagaatcctgtgccgtcatcatttacatatctcccctctcactaggacctgagttcttggagcactgagacctgctttaattcatctgatttcccaagagttagtccagggactgacaaataatttgcagttcagtaaatatagaataaatgagtaaaagaaggatgtatttcttaagagacagttttatttttcaggcaagaaagtgtagttgagctttgctggtctttagagtcagacaatcctgtttgaataggagactttcccccttagctgtcatctcgggcaggttatcttgggtcaggtggcttggggtggtggtttcatgctcagacccctgaactgggctgcttgtatccaaatcctagttcccccacaaaaggggtgggggcttctttaaaatgttaatgttactatatcgatacaccaagaggtagaaagtatgctatcttagccagcagtacttttttgaggcttctttcactaagtagagacgggctcaaatgctgcctttccttctctatctctatactgacagaggtcattactctttggtaaggtccaaaggctttagaattttagaagaatgggtgggtggaaccagtgattttggtggtatttggatcaccccataagactctcggatggccccaaattgagctgctttttaataccaaatctcagtctgcggcttgcttccatttggggagagagcctaattaactcgtagctggaaagaactgcaggtctgccaccccccaggcagagaattcaaaaggaagtggatagctgtgtaaataacactgctttaaggggcatttaagccaatgctctttgttaaggaaattgatggctttgtaagtactgcgtctgaagggagtacttgagctgaaggtccccatctcgcctcgtaaatttcctaatggactgtgggcctgcaggctgggcccagcgtgttcaatcacttgccaacaaaaactcggatttcactctaaaaaaattaaaaacgtttaaccaaaacataagttattgagcctgtgcagtttaactgtggcacaaggtagcagagacagattacttcctttaaggaaagggaaactcctcatcttttactttaaaaaatttgttttttaaatgctggatgtggtgctacgtgctttctcaacagcttctcatttttttgtcctcataacagttgggaaggtagtcattattttgccaatttgccaaagaggaaacggactcagggctaaagtgtgctggtcattgacaccagctaattagtgaagagccaggttgtgatcacagctccatcaggcccctgagcccccaagtagtgccaaatcatagggcatccgagagagaatcagatcagcccatctcatcagattctcctgaatatccacatccattcaaaatagattaactggacagcatgggaatgacttaccctcttgaaacctcaatttcattgtctgtaaaatggggataataataggaccaaacacggggctcttctagatttgaatgccttatgtacttgaaacatttagcacaatgcccagcatggagaaagtcatccagttattcatttcacaaatacgctaagtacaattttaactggggaagcggatgatggtataggaagacctagtgagggtccattagcccttctgggggtgggtttccaggcaggtttttgagaggttaaactgtgaataaaggacaaatggggactagtcacagaaaaggcagctctggggatttgaagaaagcttctgcaaacgtggggaggtgagagggaacatggtccactcagggcaacgacaatttgtgtctggagcttagactagagtgcgttcgagaagagagaagcctgcagaggcaggcaaggaccagagtacaccttgtcaatcatcatcaagctcctgttgggaaaagttgaatgaataactcagtatcttctagggcaaccactttcaattttagaccaactgtactttgttagaagagttttccattgtgtcctccctgagccttcttttcttcaggttaagcatcttcatacctacatgattattgctcagtggttggtgcctatccagggtcctattctttgaccatatcctaccacatcagtggcccagaattggcctcttcagccatgactggtccagctaggactggagacaacttctctggcctctagcttggaatctatagccaatgactcaatctgcagtctcatgcttttgtttgggcaaacacatccttcatttggcggaatctgacttcagagtgactgcttcttggaacttttcgtgaacatgaatagttatgatgactcttatcatccctgatcaaaaagggcagtggttttgattgatattttcaaatgttcccagttaactcttaagatttaggaccaggccaggcgcgatggcttacacctataatcccagcactctgggaggctgaaatgggcggatcacgaggtcaggagtttaagacaagcctgacaaacatggtgaaaccctgcctctactaaaaatacaaaaattagccgagtgtagtggtccgtgcctgtaatcccagctacttgggaggctgaggcaagagaatcgcttgaacccgagaggcagaggttgcagtgagccaagattgcgccaccgcactcaagcccaggtgacagagcgcactcaagcccaggtgtcaaaaaaagaaaaagagaaaagatttaggaccaatttatttctgtctccctccctccctccctccctccctcccttccttccttccttgctccctccctccctccctgcctccctttcttccttctctcactgctttccctcttcttactgagagatgagaaagacatatacacaccttgttaaagaagaaaattacagctaagcaatacaaatcagaacatatagatttaagttattatagtatttttattctaagggctgaagagtaacccattcattacataagaaaaagaaaacttacccaagagcaatcttgtgcactgtctctcttctgttctgtagaggactgcagtgtgtctcaccagcttggagatagaagacactgtggcttgaatggctcatctttttagacttatcgaaaccatatagcaggaggatggtctttgaggtgaaccaaaccagtcagagttcagggtgggagggatccattttaacactctggtttctgcatgggagccctgccaagaacatagcatgctgcggtcaccttagtcacaaccagctatgccagattggggtaactggcttggttttcatgtggtgcctgactcatcctcgagtccttggcccactggtagacatagcatccacttgtccaagcttctttctttgctggactcttatgcatgccctatcagaatgacgggctgcttgttttactggattgcagaatagatatgcatatacatatatatatatatatatatatatatatatatatatatagcatatatatatagcatatatgtagcatatatatagcatatatatatagcatatatgtagcatatatatatagcatatatatatagcatatatgtagcatatatatatagcatatatatagcatataaatagcatatatatagcatatatatggcatatatatggcatatatatagcatatatatggcatatatatggcatatatatggcatatatatagcatatgtatatatagctatatatatatagcatatatatagcatatatatatatagactttcatttgcatgcattgttttacttaatgcttacaaacatgcatttctcacagagcaatttttatttgacattgaatattcccaatatttgtataataagccttaatcagccagtcagaacccttgacctctaacatttatgcagcattcagtgagttacttaatctttctaagtttcagttgccactttatacagagaagcacaggaattagaatcatatagaatgtctagagaaccttgcagtgttaaaacgttcattcgttcagcaaatatttctgattatcttctatgtactagtatctgactgcaacaatgcacacaacagcctatgtttctgctctcaaggagttgccattctgttttagagagaatacaattatcaagcaaacatttgaagaagtgagatcatgctatgaagggaataaaatagactagtggtatagacactctagtgaaggtgaaaactatttgttgatagtgtgtttagaaaagtcctcactgagaaggtaatggttgagctaagacctaaacaaaaaattagaaaagccatttgataattggggagatgaggtctggattgtatctgcaaaagtaaaatgtgaaaacaacacagcttatagtttttatgtttgagtagtttttagttttcacagcattattttactttatctttacacccacttttgaaaatgggtaggaaaataatgctgtcattttttttaataagcaaaaagaatcagatgcagaatgatgatgtatgttactggtaccatgaaagtaagttagcaacagagttgaggcacacactttaccttctggccccttattccatctgcttttcgttatagttctatgcatgtttttcagaatgggttcatcatctacacgcttctcgatcttcattttgctgatcatgtttctccatctttttttttttttcatgtttcccctcttaactgaataactgatttagtgatcaaagggcaaaatgtcaagaaccaaatatatcttagagtgacacagctaaaagggatcacaaagctacttgatttaactcttattctatacaaggggaaactgcagcccagagagggaaagtgacttgtccaaagtcatagggttgatcagggcatctattctaatctccagttcccttgactccctgaccattactgtagcaggctgcagagtttgagaaagtgtctcatattttctctcttttctttctctctctctctttctttcttccttcctttctctctctcttttttttaatatggagatacaatcacactaaaactgctgaaactccctttgtagtttgccatcttttattaccctctttctttgccactttttgcacactctctgcatatccatgttttggatttttttttccatttattagcttatattatccaggccaaatttcatttcattatttcctgcccatacttttatagacctttgggtcctaggtattgctcttccttctgtttgtggttagaatgccagcctatctcttggctgctatataattcatgtgacactggattttaccgcctctttcatatcttgagatatcattgaaacccaaaagagaactggctgaaagtcatttagggctttgaacattctgctctgttggctgcattgtcatttataaggattactatctttgcttacaatctttttaagccattcaaattactatactaaatttaaggtgatgtaaatgcatcttcaagttccaattcataagactgtcaaatctctttattaaattttactctaatatgtgctacctttcctatccagatattccatttcttttcaaattcagttaggatagaaaataaaacaatatataagacagatggtgaggcatgatgtctcataggaaaaaaaatatattgtgggacaatttgtgtagaattggattttccccctaatatgtgcttggatttatgctctgacctctttataattaatattttcataaaaatttttacataatactatctgctaaagcagattgaaatcaggtttgggacatcttcagaatcattgataacagagattctaaaactccaaaataactttgttaattcatcatttactgagtatctgctatgagattgacactatcctaagtattcgggatattaattaaagtaagacaagggccagaaatatctgaaaattcaagagctgtacaaaatcattcatttattcacttattcatgtatttttaaacatgacataatatagccaggtagttttcttgaccctaatggaaaagatgcactttgaaacatgcttctattaaacttgtgttggttgtatgggagcagggaacaataataaataaatattttattttttattttatttattttaaataaaataaatatttaaaatagtgaatactacagtaaaggaaataaaacaatatggtatgctactttgcagtggggatggaggattagaatgtgaattaactgcttgttacttgaatatttgaaatgactgctaaataatgaagaggtcatgagaaaagccaagaaagagatattccagaaaatgtgaacatcaagttcaggttcttggatgcttacttaaggaatagatacttgttgtgtcgatagatgtctgtctggatgaatgaatgaatgcatgaatgaatggaaggtagtgagcaaggaggacagtaacagaagatggagggataaagcaggggcttgtaggcctggatacagactttgaactcttccacatgagatgttaagccattgaggagttttagatgaggggcatggcatggcgtagtttacgtttttagaagagcactatagctgttctgaaggagggatagttgggaaacaaatggttgagaaaagagaagcagataggctggttaagtgagaattgcagcagtgatgttggcttgaactagggtggtaatgatagaacaaattagatctattttaaatatcccagggaaaaggagcctataaggtatactgatggactttgtgtggtgttaaagggtgagctgaaaaaaagtaggacagatgactgggaaggttttggtttggtcattgttaagtgatggtgttgtcatttactaaggtggagaaaaagggaatgtggggagaaatcagtatttttgttttagatatgttttttgatgtcttttgatgattttgtgatgcctttaaataggcagatatttagtagagatataattttaggcagttgggactcagagaagaggtcatatctaaggctataaatgtttcagtgattggcacatagaggttttaaaatttttatttagaaactgagacaggatgagaaactgtagataaaaaagaaaaaggggtccccatctaaccctgaagtctggcagcattccatgtagagttagggaaggagaagccctcaaatgagtctgtgggggaggatcccagacaactaggatgacatgatgtcatggaagtcaagagagggaggactgcaagaagacaggagggggctacttctttatatgcttcaaggcagtctagcaagatggggattttgacatcatgctcagctttagcaactttgaggttgatgacgacgttaatgagattgattttggtggagtggtgagtatagaagctagactggagagaaccgataggtgaagtgcaggagacaaagtgaataacactagtttagataacgcaataaattttactgtgaatcatagaaagagagatgtgggataggagaaatagtatttaggagacgtataacagaatgaaaggaggtttgcgtttttattaatttaaaaactttgaatttttcaagaatttttacatttttaaatctttagatgggctatattctattttgctgatttgggagactaatgatgtaggaaatagagggaaatggtttgtaccaaacaagtagtgatgcagaaaagtgagagatgtcatggagctgaagttgctagaactgaatcttaatggaagactcataggcaggaccagcctttcaggctaaggaagtaagggcagatgctctgagatgtgagttctgggaaagaactggatgcatttgacggtggagatgtggttggaactaagaataaataggaaagttggagctagattacaaaaagacttgaaagctagttggggaagttaaaattttgtaggagtctatgaagtatttcaaacaggctgggcacggtggctcatgcctgtaatcccagcattttgggaggtcaaggcaggcggatcacctgaggtcgggagttcgagaccagcctgaccaatgtggagaaaccccgtctctattcaaaatacaaaaaattcgccggcttggtggcgcattcctgtaatcccagctactcaggaggctgaggcaggagaatcacttgaacccacggaggttgcagtgagccaagattgcaccattgcacttcagcctgggcaacaagagcaaaactctgtctcaaaataaataaataaataaataaagtatttcaaacatgaaaatattcatattttagataaatcattcatagattcataagctgctttgtgagaagggattgaggtgaggaagatgcaaagccagttttgagtgtgtaagggctaagtagatagaatatgaggctgtgctataggtgccttccttgatgggcctgagtgtagagttagtgtgataatgtgattacttccagggatgctcttcttttccagtgccttcagtttgttggaggatgcttgattctcacagtgaaacacagggaggaatttctggcccatgtgggtatgtggccaacctttgaaggaactggaaaccaacttaagctcctcagattcaggtctccttcagtagacctaatcagcatctgaagcttgttagcagattcatggttccttaggagccctcactaccctgtcttttgtactctgggcaggctgatctggttgaggaggttaagaagaaaccctggtttgaatagaattaaatgaggtcagcaatgtgggtttgacacgaagcctttgaaagataggctatataaagtcaagatatttctgtcccagaggaaacatatgccaatatatagccacctcccagccccacccaagcttcccctttgtaaaccttcagcaggtaagcactcctgctccccctgttccaagaaactaacgtttaagtacaaagatcacgctttgttgtgtgtgggggtgtttctttttgttgctgtttggaagaattgtgatgtggcataaagactgttgttattgaacccatctctaaataaacagctaaacttaaaatatgctactttttttctggcctttaaagatctttttgaaaagtaatcgttggactaaaagagaatatcataatgccaatcactgttttattagctagaaatagaaatagatgctaatttctcaaaagctgtcctatctttatttgcaagaaatttagaaagacaggtgaatccactcatcgtttggaaggaggttcatttcagaagagtgcacattcaaaatctttgctttctccttgagctctaaattagtgactaagaactctcatctcctcatctacaggtagttttgtgtatgtttggttttctttttggctcatcaatgggctggaagattagtaacctcaatagcttcccagactagttatatttagccaataccagtgaatgttacaaaaagtgaaatcagagatttccaaaagtaatattgagacttacttaagggtaatcaactattttgctcccagaattatatattgaaaagtgggccgggcatggtggctcacacctgtaatcccagcactttgggaggctgaacggggggtggatcacctgaggttaagagttcgagaccagcctgaccaacatggtgaaaccccgtttctactaaaaatacaaaaattagccggatgtggtggcgggtgcctgtaatcccagctactcaggaggctgaggcaggagaattgctagaacccaagaggaagaggttgcagtgagccaagatcgcaccattgcattccagcctgggcaacagagcgagactcggtctcaaaaaaaaaaaaaaaaagaaaagaaaagaaaaatttcaaagtctcctcatttctgaaggataatttcgatttatttaacatagtattgcaatcttttttaaatctagcttcagatcagtttcttactgtattagttccaggatttactgcattcccttactcaagtattggtcaaagtttatcctttactcagacacctctctttacatgctcaaactatttataccctctaagatgtttctcccaaatcattttgtcaaggaagccttctctcattttcccaagaagtattgataggaggagggcctgtcctgattcattaacgtatttccagcaccagcacaacaagaagcagatgttagtatattgattaaatgaatgtatagacttctccagttctcatctactgattagaagatattttagctggggattgcaatagccctcactcctaaaatctccagaaagctttggtagctcttatctgttgctcattcattgctgaaataatcaaaaatgaattactgggttcttagtgttagctgggcatctcagaaatgtttgagaagcaatcccttggggtttaattttgaaaactgcaatcccaaggtttgaggaaattttatagtgaagctgataaatcttttagaaaaagtgtgacataccctataagaaggtgcctctgttttgatgaaatctggtttgtagtactatcatggtatggtcagtaatagcattacaaataagtacacaagcacctagttagtttagtctatgtataatctggtaataaatgaactcaaagataaatccgttgttacctttcatttgttgtttatctagtcatatattcctcaatcactggtttggtgtcccctttactctgagcactgttatgggttggaaatactaccgtgaaggactccacaattctgttcgcagagatcttgtctgcctgataaggaaacagacccacagacagacagtgaggaaactgtgatggaagaaatctaggaactgtgataacacaggaatgacactcagctagggtggggtcaggaaaaagggatgaggaatagagaagacttgcaaaggagatgctctagatgaaccttgaagaaccagtgggagttagcaaagtgaaaaatggaaagcacatttcaggcagagaaaaacaacctttgtaagggtgtggagaaatgaaacggaattgttcgtgtggaatgtgcatgaagaggacagtttgtggatggtcttgtatgccaagctaaggaaaatgatgttttttaaaattatttttatgtgtttattttttttttgagacagagtcttgctctgtcacccaggctggagtgcagtggcgtgatctcagctcactgcaacctccacctcccatgttcaactgattctcctgcctcagcctcctgtgtagctgggattacaggcatacaccaccatgcctggctaatttttgtattttttgtagacacagggtttcaccatgttagccaggctggtcttgaactcctgacctcggatgatctgcctgcctcaacctcccaaagtgctgggattacaggcatgagccaccatgtctggcagaaaatgaccttctataagtagtggggatctatcaaaggaggggcatggtaagatttgtatgtcaggtagaagacttatagccaaaataccttaaattatcccactatcctagagaatacacattatctcaggccatgtttgaagaacacattgacttcagttagcttttacagtaaccgataacttatgactatctgttcaacgttttgaaactgatgagagtcaatgtgaaggcaagtttccttgtgaaaattatccctaatatcttgtactgagaagacacgaataatttaatttcttcctcccttctccagctctgacctctttaacctctttaggtatttctgtcacttattcacctgagtgattctagtgacatcataaattcccaaagtttctaattcagctaagttaattattgtccaccaattgtgttgaaatcattccaatgtaagtcaatatattcttttctttaggttgttacttttttcttttgtttgtttacttgcttccttggcatttatattgaaaatagctcatgcatcctctttaatcatgtctatccttcaagataccttagggtctagggctgggtagagaaaagtagaatctctaattaagaagacttcttctccaactccaacctcattatcatcattgttaagaatagaccctgtgtctttaagaccagtattattttcccatctcagtctgttatgctatttgatcatcctcagaaccttgttgagaaagtctaaaatgtaattttgttttcattttatatatggggaaactgaggcatagggaggtgaaataccatgtccaagattaaccaataatcagagatagatcaagagcttgaatccaggatttctgacttcaaggataagaactcttaacaatagctctaacctgagcctttgcttcaaggtaaactaatatcattttcctaagatttggttttccaagctttcaaatgggaataacgatctctgtgcatcttaagtagtgtcctgcagacatgcctcaggaactcagggacatggcatttcaccttgatgctccagataaatgaaaataagtcagctggtggcagtatcaactatgtctgtccacttacaccaagtccatctgcctcgggctcttgaagctgaactcatttcttccaaaaggaaaagaaagtttctggcatatgaaatctcaactggagaagacagactttgctaatggcacctacccacgtcaagtctcctagctggatagaacagatttctaaatgtgtcaccacatgaaagggaatgaatctgaagtgaggaattccctgatatgaggggaagatggcgtgggatggagaaatcagaatgcccagtgcaatcccactatcagctagtcaccacctggcttacagctccatttccttctccctaagacatagtctaaagaaaatagtcaaagggtacagagtttaaactgtatttggttgagagtatatacatcggggatgccagattttggtcattcgttcattcaacaaatatttattgaaagtgtattatgttttcaggatgtgtatgtgtataaaagtgtgtatgtgtgcacatgaatgtgtatgtctgtgtataattttcttagtatccctcacagtgaaatttactgtattattatcaatgctacctagctactacacggaagttatttgaccttggtattgacttcagactcttttcactacaacctgctcagcatctagcagaaagtatttaaggagcaccaagtaaattgatgtaatgaaaacaagaccagtttgttttagtgttttgttgttgctgtctttgttttttgcggccgcacatttgtattccattcctcactctgttctcttctgtgcttggggcagagggagtagagagggagagagaattccccagacacgggctggcagatgtagctgaagggcccccgggacactaatagcaacagaaactgaatagctgtgtccaaggatgttattttaaaaagagactcacaatagctttgtcagcagaatcttggagaagaaactgcatcttctgtctctctttctctctctctcccttgctttctttttaactccatcttatttttctgtcttttaactcttcctctacgtatctatatatcatctattacttatcgacctgcctgtatacctgtttacctacctgtgtctatttctacctttcctccattctcaggttctgctgattcctagcagacaaatttattgtggtctttaacataatcaggaagaaattagcctttagaagaactaaaatctaaccccaatttctgtcattccgagaggttttttgctaaggaaattaagtcactttagagactagatcttacccttacagagaacataatcttaccctatttttctttacattggaggagaagaaagtgataccaagaattaggcacccctatgatcttatttccaagaggttgttttcgtcattctgtagctgtggcatgtagggagaagatttctctgctaggtgtaaaaaggccagtcttctacttcttgctctgctaccacctgtctctgtgacctggaagcagatggcttcttcctcaagctcacagttttccattagataaaatggatgaaggggccagcattatacccacaatcatctgaaatcactgcaacaacgctgggtaaatatcattacctccatttttttttttttttcagatgaggaaaatgaagttcagagaggttaggttattttatttatgtcctctttgtagtgcttataggaagcagaattcagatttgtacctacttctgcctgatgtcaaaacccttgctcttttcagttctctgtattgggtttctgaagagtaaagtctggatttatggctggtcactcttggattgggcctaggttatacgatatgtagagtggccacattcacatgaggttggagctactgagaagtactgagcctgtattctttctatattgaactgccatgaatgctactggtcacttataatgaattgatttattctgtttcttttgctcattctttctttcttttctctttctgtttttcttttgttttgttttgttttgtttttttgtttttttcagacagggtcttgctctgtcacccaggctggagtgcagtggtgtgatcactactcactgcagctctgacctactgggctcaataaatcctcccacctcagcctcatgagtagctgggactacagatgtgcaccactgtgcccagctaacttttgtatgttttggagagacagggtctcatcatgttgctcaggctcatctgattgctcaagcaatctgcctgccttggctctccccaaagtgctgggattacaggcatgagccactgtgcccggccctatttgggctcttttgatagtatttcactgggtaaactgttggcagaaataaacaagggattttgcagcttggaagaagttcagcattctggtgcccctgaatccaatgactcttcttttcagatacttagcatcatagaaatctgtcttgtttctccttggcaggggctctttctagctaggggaaagttgcttgaatgtgtttcaagtgagcactgatttcacaagctgatttaattcctccacttagaagcaaatcaacccattaaaagaagagtattttttttttctctcgatgattattctaggatgtacaaagcacatttatgttcatttcctattagagttctatggttatcctgagaggttttcctggttgggactataatttctacattacagactggggacagggggaagaggccaagaagtaagtgaagccagttgtgcaaagatacatagctaatgtaagggacagaaaccaaacccttgtctttggccctaaattcagtgccctctccagagctccactctattattttgtggaagaatgttctaaatcaagcagaagccttagggtgaccatatatcctgatttgcctgagaaattcagattttcccaggatatgttccttttgtctggacataatttttaatagcaccactatcattttcaaagtgctctggtttggatgataaattatatagtaaccctaagacactggctagcaactatatttcaaggagctcagaatctttcaaaagtcctgcaacatgtagacttaatagcagcacagtgtgataagtgttaagatagaaatctttataaaataggcacccacacaggaggtggtatttagctttgcctagaaaagttgggaaaatagcacagaagagctgatgctagaattagtaaaaaggtggacaaggtgatctcttttggttggccacattgaggtttttccttgtattgttctgtgttgaaatatcaagaaacatgcataggtcacacctacttagaaggcatcctactgctagctttgtgcttctgttatccttgtccttgcagctaagtgagaatcattgcagccggctgcagctttaaatcattccaaacagaagcacttgctgtggtctagatgacatgggagcttgagaattcacttggtctttaactaaaactcctagggtatccgacaagcccttagaagcctatagcattagacaggaagggttcttggtgtctcaatagtgtaacctctttctctgctctgatggttgagcccagtgtggcaaggagacttattcaaattaacagagcaatttggtttcagagctggaattgaagccaatgtcccttgtaaatcagttcatgttttaaagcaaaactgaaatcctctttggagttaaacaacccccagtttgcctctgtgaaattcttttgtgtcaaataatgcactcagaacttggaaagtgaatgcctgagttggagacccagatcaggtattaacacactgtgtgatcttgggcaagttattaaagatgtatggaatctcagtttcctcatctggaagaataatatcttccacatgaagtttttatgaggaatatttcgaataatgaaggtgaaagtgtttgtgaactttttattacagtatagacacacaacacaaggtctaccttctttatatattttaaatgtaaagtacaatattgttaactataagcacactattttacagcagattcctataactttttcatgttgcacaattgaaaccacatactcactgaaaagcaactctccatttcctcctcccccgagatcctggaaaccaccattttactttctacttctatgagcttccctactttacatgccatctataagtcgaatcatgcagtatttgtctttctgtgactggattatttcccttaacatggtggcctccacgtttcctataacatggttatctccttgaacatggttcatccatgttgttgcagatgacagaatttccttctttttttttcaagactgagtaatagtccatcgtgactaatgtgatgggcttgacagtaccaatggttttggtggtctgactctgcagctgctgatgattgctgaggccaaagaacaaatatttatttattctctccctttctatgtcaatcttttgcagatgaacccagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtaagatcctaaccatgtgtggcatttcctgcagacattcaaagtctccgctatgccccacaaggctactcacctctaaggcagtgtcattggctatagccacttgagcatatctttattaaatgtactgttagggcttcatgaataccatttgtaaaagattagatctggaattgttagggcagggaacattgtatgatagggtaatgactgtcctcctatttccttgcctgtaataactaatatttggagaaagaactccattttgcatatatcatgtatttcaatgaggtaagaatgaatttatattggaagtcccactttttagggggcgccaagctgtgtactacttgaattaacagtaattatacagtaatttgctatgtggccttagactagttctcccacctctctgggccctatttttcgactcatccttaaaataaagagtagttgagcttgttgatctccaagggccttcccaattctaagaagctgtgactcatgcctcagtcccctaatgcactatttatgtgccacagttcttccccaagggactgacagcttagtccagggagtgagagttttggggccactagtgcttgtatgattctagagatggtcatgctgtcccgagagccccctttccaattatcctaccaaggaagcacctgccttccccgagactcaaatttcccagagacacgactcagtgcttctggctgcctggcctagtggcctttcagagaccagcctgcctcctggccttgcagatgagctgctattcccaggcattcctttccaatattgctttcttgatttaggtttagtcgggtagccctggcttctagatgaaagaaagatatgaccttcctctggggtcaagtgaagaatcactgggtgaggtacagaataggactacctcatttttagttgttgcctgtatttgattatttcttcattcactttttgtttatgtttacatcactaaagcctttattcatttgcatttatttttgaatgccctcaggagagtggaaacaaatggtaacatggcatttcctgatgcttaacaatgtatagtgccagcctgctgaatgaatgaatgaatgaatgagtgcacagatagatgaatggctagggttcatcctccccctgtgccacgtctgtacttggtggaatcatctgtgtggttgcatttatcatactgaactctgaagtatctatttgtctgtctggctcccccattaggctgctggttctttgagaacaagtttcagtttattcatctttgtcctctcatgttcaagcaaaggctagataggtgcccagcaaatgtgtgtttaattgactgtagatacacacacatacacatacatacatcccattgccacatgcaaatgaacgacactgacagaaaacactcacgcattgcctctctatcacatagaatgtcctgcttcagaaacaacagtgctggggccagcaagagaacaaggaatccaaattcaacactagcatccagttcttagaaatgttttaaaaacaaccttcaaacaagagaattattaacacactcagaacctcccatgaggaagagttgaggtagcagctgtgcttaaaaatcacccaaatgttattgcgactaatgtgagaaaaggagagaaagaattttccagtcttagcatttgaaaagaagcttcatggggcaattattccaatcttgtaagggggggctgtcaggaattactggtgattatctcttcctaaacaaaaatccaatttaaaaaatcattataaatactagctcttcgatctacaaagaggagatgaggaaacaaaatcatcctattgaattattcattgtaaccaattttattttaatgaaatcgactaggttccattactctgggcttggacataatctttgttacaaggagatttcagctgtaactaaatttgccataatgagatcagctcactggagaatacagggtcggggagggaatatgtgtgcaggctgggtgcagggccaggaagagggcagcagaacaaaagtctcctgaattcctcatctgaaagcaagtacctagaagtcattcacaaacacacacacacacacaccctaccaccaccacacacagaggcacaggcacacgcatacacaagtacgtgggcacacagacacacacacacacacacacacacacacacacacacacacacggagtctgcataattagaggtaaaggctattcctgaagtgtaaacgtaccttccttccaacaacagagaatgaggaggaagtataattgtgctcttcattaccttgtacagtgattagaagagattggtagttaattttcaccctgtcagggcttccagtgaagatgttgatagcttgagaggaggagctgggaggctcttagaagttgggcttaggaagaagatgggaattgtatcatgtgcttctcactttccccccagatgctcatactctccctcttctctctctctctctcacacacacacacacacacatacatacacaaatttacacaccaaaaggccctgtaggagcatgggagtaccaaagcagatagaagagaatagcaggaaagaaatagtagttatcaaggtccaccaggcactggacacatgtatgcacattacagccaatccccttgtcattcttcaaggtaggaattgttgtctaccttggagaaactgaggaacacagtggcttcactataagttacatggtccataagggaagaatctaggattagaagaatctcatggaagatgaatgacagtgggtccttgggaacatgaggtcacattcaaaagttggaagtggctggattcctggaaaacttcactacaaaacaggcagaaagactcctagatggatagatctcagcattgagtgtcactctgcagacctcatgaggtacttcagttctccttgaacaaacttatagtcactgcccataccttcaaattcaggctgttcccattccctgacaaggtggccctgttccatgatgccctggagttccctaggacactccattaacttagggaatgatgaaataacctagtcattcccatttcctctttacaattcagtttggtcccactttctgtctttccctgatgcaataaaaatgataaatgcgaaggtgtttattggagttatgtgcctagttctgtgctagagcctgtggaagaaaccaaagaactgaaatacccagcctctgacctagtcactgtacaagagttaggagtgagaattctatcaaaggcacattcttatcacaataagtctgcaggatctctatgactactgcaaagaaacaacatgcattgtgctatatggcttgagaatattgattaaaacttcagttttgatgttgtaaaagcctgccatatctaatggtttccagtgtttctcgttcattcttttcaaacatgattcccaaatttggttagggcaaagctaaccctgaacattgagtctcatatccaaatcttatcagaagtatcaaaacttcctggttgtgcaaattgggttgaacatcctataataagagacattctttggatattttggccatgcaccttcctggcccagctggaatcaagaagttcctgagacagaaaaaaatggaaattaaccgaaaaaatcaagttatctctcttctgggaacctcagaacctggtttggtttaagtgcttgcaaatatcttgtattgttcttatttggtctccatgtttcacatttctctaatgctttacacaaaaggatgccaaaatgagatgttgatattccttccttttaccccggcctccagcatttctaccaaagtctgtttcctcctatccaaacaggcacctccctcctttgcagtggcctgaggaggaaatggaaatactaagactatctggaatttacagtgctctcctaagggattacagaccttcagtcaaccaaccaatttatttccttaatcctttgagggtaaaacttagactaagcatttcaaggggagtagtttgagggccaaagtaaagaaaacttttcaaagaatgagaactatccacagtgagatggagtgccttgtgatataagaagttccccaacataaggcattcaggctggacagctgactgaacagaagattcctgcactagaaggcaggtgagacctaggtatgcctcttttctttgtaattgattctctgactttatgtcccattaacccacgattgggtatattagtccttggccacttcattttgagttgctattatcattccttggcccatccataatacttcatgcctctactagaatacaaaccaggccgggcacggtggctcacgcttgtaattccagcgctttgggaggctgaggcgggcggatcacctgaggtcaggagtttgaggccagcctgaccaacatggtgaaaccccgtctctactaaaaatacaaaattgagtcggttgtggtggcaggcacctgtaatcccagctacttgggaagctgaggcaggagaatcgcttgaacccggttcaagcggttgcagtgagccgagacggtgccattacattccagccttggtgatgagagggaaaatccatctcaagaaaaataaaaataaaataaaatacaaaccatactataccttgtaatataacaatttatacattaatttatttattcacttgattgaacagaaatatatttgagtcctgcactgaggaatgtgagagagagagagagagcatggccgttaatgaggtgaagtagaaatcatgcagatctggctctgctctcttaaattccattctgacatggaaaccttgagtaagttactcttctgggaatcttagtgtcctgtagaaaatgagaatgataacatctacctggtagaaattaagatgaatgatatctacctggtagaaatgaaggatgcagagaaaacactctgtgctgggtttgttaacttgatgggtagttcaaatgttaattctctgtcttgttcatgtcaggtttccttctttgcactccccccaaagctggctctagggacccacacagaacagaagctcagtcaacattttgttgaattaaacacagttgcgtcagcaaacgtttgctgcatcctcagaactgcagcaggcactttgagaagcttcagagaagtactggttctttttctgccttcataaagcttaccatgtcatcagaagggtgttttcaactagaaatagtagccaaagacccaagagtgagagtgtaagatctagagggagtttccccgaggaagaaaccacactgctatcagcttactcagccagtagtgatgagagccagtgtgtaagatagaaaagtcctttgcccactttcagaagatcctggacaaattataaaaatagcatttatcaacttcttccaggctttccaccaaatttcacgaatcctactaaagctactacaaaaataggaatcactgttttcattttacagattaggacacaaaggctcagagagcagagtaacttgcttcagggctcatctctataaggggcagaaccaagatgcaggccactgtgttcataatagaaatacagctacaggaccaggcagctcaagcctgctccaatgactgacacatgagaacaagctagaagagctagtgtcttttgcatcttttaatatgtggtacgtatttaaggaacaccgggaaagtgggcattccctctctctaatacccaaaatactgccctacaatttttgcctgctgctaagatctccatcttttggcccccattctttcacccattgccctttccagagagttttctaaaatgtgtgtatggaaataagagagacacataagtgttgtaaattgccaacccttgcatgtaaaaattatttcttaaattttggaatgtctgcttaattatagtagggatatggggagaaaaaaataataaatgcacaaataggaagaagaaactttgctcaatttacagttttgtcacaagctatgtgctatacataggaaaccttaaaatgtcagtgaaagggaattgtaagatgtgcatattttctttctttttttctttttttttttggcaaagtctcactccgtcctccaggctgaagtgcggtggcacaatctcggctcactgcagcctccacctcccaggttcaagtggtcctcctgcctcagcctcccaagtagctgggattacaagcctatgccactatgcccagctaatttttgtatttttagtagagatggggtttcaccatgttggtcaggctggtctcaaacttctaaccttaagtgatccatcttcctcagcctcccaaagtgctgggattacaggtgtgacccactgcgcccagccagatgtgcatattttctgatggctgccaagtctgaggcaggaggggagaagccattcatctgtgtcttcttcatccttgtctccacagcaagggactagatacccactagggtattgtatggatacaaggataagaaatctttccacgtacacttatgatgcagtgtaggaagtgctcagagaggcggactgagaggaggtcagggagaagtgattgctgagtttcaactaagaggataagctggaggacaggagagggaggacgggagagggaggaaagaatcacataatgggggctgcgaggggtatatccaaaaaaaggtaaataatagatgaaggggaagtcaagagagatgagctaggaaacatggttaggaaaatcctgccaatgcttggaacttgacattatcctgagggcaatggggagtttttctgagtttttcagcagggggctaacatgtttggatcattgaaagaagaacattgacaagtgttgaacacttcttacatgccaggccctgtattattttgcatagatttcagaacaaccctgctgagaattcttaatattcctctctcaaaatgaagaaactgagtctcagggagatgaatcaccccacccatggtactctttcttctgttttcttttcttataccaggatactggtattgcattaaaacagcctcacttggaaattctgcattgataagcaattctgcaatgctaattagagtgtgctatttgcaaagggcaggaagaaatcctgtgctctatacccaatgccgaagtcacttctaaggggctctctgccccttccttgcctgctctgcctgctatggccttcaccaaagcattcatctcctctcattagtgaaatgagagagcctttgccaatggtggtggaaggaggaaaggcgaagggaacatgctgaaatttcagagacaattccaagcagttttcccaaatacccaaaggatctgctttctcctggtggtttctgaataatttttcaagagcacgtgtgcaagtcatctaaggagacagaacagaaagtaccatggtctagttcagcctgtcccatggtgtggggcaccaaaaaaatccctccaggaaagtaaaaatcagagcctgcctcagaaaggagcccactgagttggtcactataaccacccccaaaactttcatggaaaccttggactgtgggagactttaaatctactgaatcttatggggccccagcaaagagatctactagattctgctcctggctctctcttctattcatcctttggtcatttaccctttcaatatctgttcaaatctacaaaagtctagacactctggccctaggatttggactgaaaaactctgagtgactggagctttataaaaaatgagatctaggatcagttcaacctgattttcagttctagagtccaccacttactagctgtgagactttaagcaagtcagttctctttgcccccaccccagtttttcatctgtaatataggagtaataacatctccatggcaggtatttgtcaaggatgagacagttgatctagaaatacagttttccttctggtagcaaccgacaaagttttaaagaaacacttctgtctgcctgtgaagttttggcaactgaggaacaaatcgaattaggaacaacatgtggactttttttttttttttttttttctaacagaatagtatttggggcatagaaatttaaccagagagagactttgagagtctcttggtcttacttcacttaattaagacttggttttgattaaacaacttccctgaacctctcaatcccatccgttataaaatgattctggtatttggattcaaaatcaacagaatcttgtgaatcttctgggtccaaagcatcattttcaacatgaggttgaacaaagcaaccactgctctcaggcagtaagttatgtgccatggaggaaggaagacaccaaaatagcttctttcgataagaaaagacaaagcttgcaaagtgctgtgatatgtggacaaatggaattaaccttagaggttaacctttgaggaggaagggcgaacctgaataaagtgacaggttatgtagaaagtgatttttctttccacttgggcatttgggggaagctttaaaaaacattgtagtgtagccatattgtttcacagaggaagcataagctttaaagccagaaagacctgacttgggtactgtttgttaccagctgtctgatgcctggcgaatgatttcagttttctgagcctcaattgtcctcatcttcacatgatcctgctgtcattctgtgagatggtatgaggatccaatgagctaacatatataaagtgtataatacgtggctacgtcttgcgaggcatctaattcttgtcagttcacatccctactaaactacattatccctgagcaaattgaatctggagaaggaacaaaaatgtgtaagagaggaaagcaaggaagggatgggtttggcatttgtaggcatacaacaaacacatattgattgatcagggaaggtgccacgtggaacggtgagatcctgctttgaatagcgagtcttcatttttcagttgacacttgactcttgacttgaagcccaagaataagcaaggctttgtggtttggggctgcatctactggttctccatgtagactagataaaaccctgccaaccccttccatggcccatctaggaagattccttggcctctgtcttcctttttcttccaaacctggcctacccctatctcattaccttcattctccacatcctctttagcttcaggaccagaaacctttcttttatccctgtcatttgttctggctcccttaaaacccttctttgttcttgtctttcattttcttttcttttctttctttctttttttttttttttttgttattgttttgttttaagtggggtcaccagcattcagccagcatggcctttgctgtgtaatttagtttcatgttctgtacccaagaaacatgtaaaaaatgtaaacagcgttcactctcctgggctgtaatgcacttaggaagcaatagccagttgagcttgctgagcctgctgctttggcggtattgaattttgtccctaaaaccacatactcatttctctaagtctgaaagtaaactttctcaagccagacccaaaggatggggttttgaggtgagttagagtttggctgtgcacaagattttgtttttatttttgtacacacaaatgtgttcatttgtttttgtttgtctttcaagtcccctcgtctctactctctattcctccccactctctattccttcccatccttactttgataaattagactgggtatgttacctgtagaatgagaccagaaagggccttctgcctcctcttaagaaactccaaccaggccaggcgtggtggctcacgcctgtaatcccagcactttgggaggccagggcaggcggatcacaaggtcaggagatggagaccatcctggctaacacggtgaaacctcatctctactaaaaacacaaaaaattagctgggcgtggtggtgggtacctgtagtcccagctactcgggaggctgaggcagaagaatggcgtgaacccgggaggcagagcttgcagtgagcggagattgggccactgcacaccagcctaggtgacagagtgagactccatctcaaaaaaaaaaaaaaaaaaagaaactccaaccatgattttcttaaaccctgattaattcttcagccagatccaagcaccagagcaccctgggtacatttgtacatgtttgttttccagggagaaatgggcccagagaggcccatgagagatgtccctgctgagaggttccctgtgccagggcagtccaaaaaagttgtccctggggctcctgcccaccccagaatccttttccaaacatgactcatatgtgcaggtggtgaaaggggacacttcggtgatgtctacatttctctccttcctggaagagaggcccctggggaagtcacaggtttgggagagatctggtctactggcaagatactgctttcagagatgcagatgccacctgggtaatgcccatgtctgcagtgcaactgactggtggcaaggggtccaggaagagaatatcaatttaaagcaacgggaaggaggagataaactgacatgcaccagggagctacggtcaggggtttatgtttcagagagagcaaaattgtatcagtgttcacaggccaggctccagactatctgtccagtagaaacttccatgatgatgaaaatgttctacatatgaatgtcctgttcagtagcctctagccacctatgatattaagccctaggaatgtggttcatgaaactgaggaactaattggtttaattttaattcgttaaatttaaatagcctatttgtgggcattgggttcccctactggacagagcaggtctagagtacttcacatgccagggctgctacttgcattgagatctcgagcaacttaattagcctctctgtgccttagtcctctcatctgtaaaattaaataattaaggggagatggtgagaattccatgggatagcacgcttaaagcacttaggacagtgcttggaatagagtaagtactacctaaattcattcagttctgtcattgcatcgaatcttttttttttttttttttttttttttttttgagatggagtctcactctttcgccaggctggagtatagtggtgcaatcttggctcactgcagcctccacctcccaggtttttcaagcgtcctgcctcaacctcccaagtagctgggactacaggcacacaccaccacatccaactaatttttgtatttttagtagagacagggtttcaccatgttggccaggatggtctcgatctcctgatctcgtgatccacctgcctcagcctcccaaagtgctgggattacaggtgtgagccaccacacccggtctctccagagatttttaaaatgacatttctctttcccagagtgagatatgacatactaatctttttgtaactcaatgtcttaaattttttaagtctgcataaattctcactggaggacttttgcttttggatcatattctccgtattcacaagaaatattggtctcagtgatttctcacctgtgaagctctctattttgttccccatggcctataaactccaaaagtcttagcagacaaggccatgcacaatctctacctttgctttacagactattgcctaaggggcacgttccaggcagtatggaccaacttgcaatttccagatatatcttggggtttccttttctcctgcctggaaacaccatcatttgctcctcaaccttcttagggcttaattatcctacagggtttagctcaagtggctcctcttccatatccctcccctgacaacctcagcccatgagcagcctccctcttccatgtacagaatacttctggaattatcagacaggcttgagcacaagctgactttcagtgtgcattgcttgtgtccacagcttttcataccaaatgaccggttagcagctaacgatttggccctcatcttatgcctttaggtatttcctgtgcccagcacaggacctgctgtgtggacaatactcagaaaatggactcattaaatgatgttgttgggaacaatagctgctgggtgttacctcttttatgattggattaaatttataaatcggtgtctacaagtgattcccttatgtttccggattacagcctcctgttaataccataggtgatcaaagcaggcagggccttctgaaatcccctgtttcatcccttcacattacaaaggagataagtgctactgtgtgaattgggggaggaagaggtcccgaaaacccatcctgaacccagacctcatgttctttctgctactctgtgcctccataatctatcctcacccccggaatgttcactgcacagtgagaagggttgtttggtaactgtttttgtgtgcttactcctgtgtgttccagcatcaagaacagggcctggcatatagaatttcatgataaatactgataaataaatgtttttttctctgctaacagctttgggcaaaaagtaggaaacagcttctggaggctgagcgccaggaaggaagctctaccctttgcttcttgtttttgcaggaaagattggggtctaagcaattttcctgtgattggcttcctacagagatggatggaaatctaagggtcttcctttctgacttgagaatgtggttcaccttcagagagatctcccaatacaaggcccagcacaggagggtgtgaaggagtaagaggaagaaagatgggaggaagaagaggtagaggtaaaaggaaagaaggaatatagaatgaagagacagagaaaaaggaaggactacacaataacaacaaataccagtaataaccataatgtaatagtaatcacagaaattgataatgatgagtagagtaaagagaatggcttggctgtcagagtgattacattatgtagagaactctacactgttttttgtacatttaaacctgtcaaccactgtatgaggtaactactgtaattaagactcacaaaggttaggtcacttacccaagttctacaggtagcccagtggtagaacagggaagtctagaatttgaaaccagaaccatgtccctctacagccaggaagaaagaagcagcaagtgatggaggaaaatgtcaattttgtatttttagtgagtagggtgtatctaaatatttgcatgtgcaagagctctttgaatcctcacaatgctacaacataggtaccatcatctcattctgcagtggaagatattagagtttatgaagggttcaaggccatgttgtcagtgaatggcagaagctgaaattccaactcacattcctttgatttaaaatgcatgtgtcttctggtgcttagtggaagattcagggaagtggcaggtgcaggggttgttgagaagttcacattgtggatcccagattctcaggcactgcatctcagaacagctgcttcaacaccctgcgtttgtgcagatgtctgttgccctggccaaggctgccactagggaaaagcatcactctggaaggtccttgttcctcagagaaccctgctgatagagtggtggacatataagtcaacagtgtccattgcacctgtggtggacaaagctccccggtttgtacatcacagtcactgtttctacctctgaagcctggaggggcaggccagggagaaataccacttttgtctttaaaaatgggagttcttgtttgagttggaaggtctgcaggatgctgttaaaaacataagtgactgctgtccacctgttcctttcatacatcactgcattgcatcctttggagactcttcctaggaaaaatcaagctcgaggcaacctagacaagagtactgcctcctcttcaaaagcaaaaggaagagagcgaatcatgtagtgattcccagcccttactcattgaggctataggaggggatgggaggaccctgaggtctgcagtgagaagcaggactcagagacaatgcactctgcatgatcatcttggcatctagtggggttccctgcaggtaatgtgacttgtacttcaatttcaacacaatctggaacacacagatcttaatttggaaagctgaataacaggagaaagggggaagaggggaggaaacaaaaacaacaacctggaaacttctagttttatgaacttgagaaagtcttgttctttcaagacagatgtttttaagtaaaaaatcattcctctgacctttcttgaataggccgatgcggtcaagactgccattaaccactgttcaactattcataaccaagggtttcggtgaccaggcaccgaacttggatgtgatcatcactttcctgattaacccatgaatgcccagggactttgatttaaaatcaaaggacaaagagaggtgtagaagcttcctaagacatccccctttagtcttaatagctctgagctgagtgatggagatgtccatattttagtgccttactccagggttgtctgtgtttctgaatttcactctagagccagcagagaaagcatttggattaaagctaagtagatttttgttttttatcttcagtgtctaaatctcagtcagtttcaggtttggggctatagagcagaaggcattacccagccctgttttaggattatggtgttttcgtattctggtccagaacttagaagtgtttcagtgctcaacatactgctctagaactgacaatgcctcgggccctgaaataaaattcatgatttttcaggattcttatctggagctggaaatgcctcagaattttctactgctggcaatagctctgtgctcctgtctagagttgagtgttcatcctgactgaagttaacagtgctctcttgatctgatccagagtctacactggttttatattctgatctagaattcatgacatttcattaatttctttcagtacaaatgcaaaaataaagtttaaactacagaaagttagcaatgtatttttttaaataacgtgctcagaactgtgtttgcaacaatattcagcatctcaaacttatccttcacgcctccgctgttgacatcatttgggaaactgggtttgtcatggcttagctgtggccgagtttttctcctctggccattttttttcctccagttcctgctctccagagcccatttgatattaagatcttgcctttcagacctggccttcagatatagattgcctcagcaactcccttctccaagcccctccctcagccttcagagagcttgaacacagaacctaccacatttctctatgagtgtttgcttgcttcgttcttcacctcccacccccatgggaggagaaggaatttttatctttgttgcttttgttcctttggggtccattttcttcatgtggaccatgggaatgaagaacctaacacataaataagtgctaaataaatgttgaatgaatgaatgacagaatgagagagacatagaaacatttgatcctaggctggacagaaaaaaaaaagatgctttcaaaagaaaacagatccctgggagcacccaaaccactgcctctcaccctgtaagaatacaaggaaggttttgcatcccactcttttaaccccgtcagcatcttactcttggaggtagcacatgtgctgtgaagtcacccacggaccatctggctggggatcccgtgttcctcctctgcagcaagagattacgtaaactggacagcagcctccagatgttagcagtttctgctcatttttttcctcccttttcaacaacaataataataattaaaacaaacacaggcctcatcccccacccgcacccctgaaattacaaacaggtgggcccagatgtcctcccccttcccatccaagggcctcctattcttgaggcccagccgccgaccctcagcagggcctgccctgggctgagccggacagtcatgccagctgccctgtggctcaggccacagtctcccgaaaggggaaatggccatgtcatgagaagtctctgtgccagactttccctctccccgcctcccaccccaaagccttggcctccaacttaaatggatgtattttggaggactaggtggcttaagagattagtaatgagatcccaagtctttcactgctgggtcaggagttcataggcgggcctgggcgactagtgaatggcataattagggagacagggagcaggcctgcggagggcccgtgtgaaatgagcccagccaggcctttaatggcagcagttgtcagcagcacaaaaggcggccgccacatccgacactaatcactctcccttgttagaggatttactagctggaggagctcaagccccctgcccatctcctcctcaaaacgggcatctgggaagggactcggcccaatgcctggctgtactgtctgcagaacggggagctgatgccaaccccatggggtagaggtgtgagaactaacatttcatgcaatataaatgagtgactagtgtcattatattaatcagtacttccactgctattgtgaattttctttctccatttgaaaaagggggtggggtgggtgatgaatctccccatcacagtgacataaggatggtgtccatggaggtggaagcatttggatatttatcatcctcaccgttattgtcatcattctcattaagatcagcatgtacactgtgtgggtctcagttttctcatctgcagaatggactgggaataggagatagaactgaagtaacacagacttcaacatccactccgaacaggtgtggccttggcaccttatttattacctctgagcccaggctgtttatctgtaggacaaacaagaaggaggatagtaatactggcttcccgggaatgtggggaatctatgtttggaacataggtgctggacagtaaatgatggcaaagaaaacatgttagctttaccactttcatgaatggtgtcttaggcctctaacataagcttttcccttagaagaaggttgagacatctatctgttgtcccccagaaatcctgaacctgtgtgtatgaaattgaggaatttaatgagtagtctctaagaatcaattctatgattctgaaccatatcatttctaagaaacttagtttccctatctgtaaaaatgttagtatgctgtagggcaatacgtcttatatgatttctatattccctttccattgaaagcctggcttttcctccatgatcatttggtctggccaggggtttgcaccctaaatcccaggatttcagacttgtggggaggtgccagcctgaagggtatgagacccctaaggagtgtgaaatgcctaatgtgttagggacagatccctggagcaacgaggtgctaatcagcccagagctgagccccaaggctggagggcatccaatgccaagttatcttatcagaaagtgtctcctgggtagaggctctgagatctgctgctatttctagaactctgggagggaagaagaagccatctctctgtttcacactctggccctgcacacaggaaatgcttctttccttgattgtctgtctatgccgaataataaatgctcatattgaaagaaacgcaaaccacccctccctttcccctctatctctttaaggcaggcatcaaaggggaaagctgctctggaggcctggggaaagtgataattgtttctaatggttggtaaaagaaagcctggctcccccctctcttttttctgccattgctattaagtgtgtaaaaaggaagtgtgtgtgtatgtgtatgtgtgtgtgtgcctgtgtgttgtgttgtgttgtgtatctgttaaccctcggcttcccttaaagttttctgtgttcattggtcagtttggaattagaggcataagagggaagcagggatagaagtaggaatgaagagaagatctcaggtaggagaggtctatagtgctccgcaggtagtgggagaggccctgaacctgaagttggaagatttgagttgtgtttgttcattatatgcattaactgagatgagacatgtaaagtggtattgttgttatacatttttttttttttttgagacggagtctcactctttcacccaggccggactgcagtagtgctatctcggctcactgcaggctccacctcctggattcactccattttcctgcctcagcctcccgagtagctgggactacaggcgcccaccaccgcacccagctaattttttgtatttttagtagagacagggtttcaccgtgttagccaagatggtctcgatctcctgacctcgtgatccgcccgcctcagcctcccaaagtgctgggattacaggcgtgagccaccgcgcctggccatacattcgcttagcatctaagctggaccttcctctgctcttaatactgaagatagaaaagacaagagctcattcttcccctcagtgagctaatgaccaagttcaagaattgcaaataggattcatcttctaggccagttctgagcaattagagtgactccccatagtgttttgttgagaaggatttagaggcctaccttcagggatgcactatgtaattaatggtgcctgtcctgtgcaatggatgagagaatggtagcactgatgtcacgtgggaatgagtcctggttctcctggtccctttcctgcactacatggttattattatctctaaacattggtctaggccctatagactttgatttctagatctaatgcgtcaccaatcttataaagccttgggaaagccatattagtttaacataggggacatttggtgagccctgcccagtaacctgcattagacactgatgaaaaggaaagagaagtcaggcataggcactgtctttgaagctcatacatggagattcagatggacaaacaagaaaccataatgcaagtgtattacctcaagggtatggaccaagagttattgggaggtcaagccatggagtaagaagagaacagactttgcgtcagacgagcatgagtttgactgctaagccgtggcaggctgatcaatgcctacccaaacctcagagtccttatatctcaattggggataaagatgcttatttcacaagattattaggaaggtaaaatgagataatacacaggcagcacccatactgggcagaccatctttaagagttggtgctggccaggcgcggtgactcacgcctgtaatcctagcactttggtaggccaaggcaggtggatcacctgacgcctggccaacatggtaaaaaccccatctctactaaaaatacaaaaattagctgggtgtggtggcaggagcctgtaatcccagctactcggggggtggaggcaggagaaccgcttgaacctggtaggcagaggttgcagtgagctgagatcgtgccatcgcattccagcctggggtacaataggaagacttagtctcaaaaaaaaaaaaaaaaaaaaaaagagctggtgccctctctcactctcccaggaaagcactgaggagggagaacatcatctgataaaaacagcaaagcctggtttatggaggaggttttatttcacctgggccattctgtgtccaggttccctgaggccctttacagctgtagtcttataggctgtctcccagcaggctttccctcctgtagtcctcaggacccttaagaatcttggaggtttatatcaggaaaccaacttctgtccttcttgcacccttgcaattcttgggaaataacctggcattggaactgcaagcctgaggttaaaatgtggcctaaggagaaatattgagaaacactggctggctgtgtgtgtgtgtgtgtgtgtctgtgtttgtgtgtgttgcacacttgtacatttatgggtactgttagtgtcagtatccatccccgcactcctcctccccattccttttcctattttcttctataaggctcattcgcaggtccctttgggtggaaaaaggaaattggagaggttggactagaggcttgatgagcacttcctccctcccatgattgacaaaagggcatgtaaatctgtaaaatcgaaattcaatggaaacctcatggcatgtcccctgtgtgggaaaataccagagcccccgctccccctcttctccctccgtctccctgcctttgtgtacatcgtgtgtgggtggaagataaactggatttaaaaaaaccctttgaaagcaagacatcgttaactcctctaattgaaagcagtcttctgcaaaggagggggatttggaggcgggtgctggatgtagcggctggcagtgcactgagtggacaagagtctctgggtcctggagccacagagtcctctgtttctgcagacctggaacgcctagtcaccaccagacatcctggcccgtcacagaggagcttactgtatatgttcaagccggtctcttctccctccaccgggctatgtttctccatccatcaaatgtgagaattggagtaagaatttctgaggaccctcccagctcagatatccagtgatcccaaagctctggacaaaggatttccccagctattttgcagcttccaattgcagacacaaaaagaaagaaagagagagagagagagaaaaaaaacacattgctagaaaggctgcagtaaacttttatgttactgttctgattgtctttgcccaaaaaggtgtcttggaaattagccttcagcttcagagaaagggacccataagtctcagaagtcaacaggatgttcacctgctgcacagtgtggctttgtttgtttctttgtttgttttacacttaattttagagtcaacattcttttctgcagcattcacctgagaagctggaaatcaaaagctggcagaatgtcaggactgaaaagccctttggagatgaattcatcttactctgtctttccataaataggaagagtgaaggtcagaaaaagtgagcaattgagtcagttctaggaggcaggtcccttgcctggcaattgcaggctctttctactgtatcactccactccggggcagacctgaaaaggcctgttttggtctgttgaagcagcttctatttcaggagccccagggaaagacaacaagaagtcccaagtccatcttccatgtggctgggattaagaccccgctagcacaaatatatctattctcttatttaaaaatctcatcacagccctgagagacatgtgggcaggctctcttgaagttaacatctatggttaagaatgtgggctaaacttgtgcctggatttcaattttggttctaccgctaactagttgtatgaccctaggtaaattactgggcctcgattttgttatctgtaaaatgcatatcattgtaatacccacctcacagagtcatggtgagcactgcatgatttagtacatacagagtccttaaaacagtgcccagcatagaataggcacccgatacatgttgctgctgctgctactgctgctgttgcctgctgggcccctattatttcctgtgtgctgggaaatctgctgggatttatttgaggataaataaaacatgcttctcaccttggaaatcttcagagtttaaagagatgaggctggactctatacaactataatctaacttgacaagtgctgtaactgaggtataaataaggaactatacggacacataagaaagagcaattaattctgcctggggagtgagtaaaggctttcagaggagggatgatatttgagagtggctttgaaatgcgtgtagtatttcacaaaatgggcaatgcagcggtggtgggcgtgggggttctgggctccagcatcatggagggggagtccacaacatgtgagagaaagagttgtccagcatgaaggaagcaccactgtatagatgccagggaagggagcacagagagcagtgaaattggtggaagctgctgaaaccagctcctgaaaacctttgtaagctgtgtcaagggaaggttccatcctgtggatcatgggcagcatggtgggtggataagtagcagggtggtatggttagtttttctcctttggaaagttaattatggggagcatttttatgaatgaatgtggtgggaccagaagcaaaaagactggtcgttggtgccctttctccaccagaggaagtggaggtttcagttgagtccaagtagcaattgtgttgctttgtaattaagtacgcagaacatggaattctagagatcagtcaactcctagttgtgatatacaactggatttaggaccttgaaaggatttttcaaagcctctgagcctcattttctcaccagagaaaatgcagtggctctaaactcccagactatcagggttaaatgatattgtgactatgaaacccttggtggatattatgactgtgggtgtccttaagctcctggggcccttaaaggtcattccgtgcaaccattcagtacaactgcagagggggaatcggagagtcagagaaatgtccagttaattggtgacagagctggaattaagccaggtcttctactgtccatggacggtatttgaaggaaacacagaatatctctgcagataatggatagtctaagggattctgctaaaatgagtgccccccgcccccaaggccaagtggacaaggggtcacttgcctttcaattcctccaggtgctaggatgaggatgagaagcagtcatctgcccagcttccataaaagacacagggctgggtatcttggagaagagaatggtgttgggcactagaattgccgtctgtcatttctgccatgatttcttgggggaagagatataaatgtcactggagatggttctacacagcaaaaaataggatcaataaggtacagaacataagtgagaaaagtgcactatttctgggagacagaaaaatttgctttttcataaacgtgttgctccttattggctgtatattgccgtgcaagatacctcccttcccttgaccactgcaaaggggaatgatctcagcagataacctattctagtcccatctaactttaaaataagaaagcttataggcattgctacttagaagaaacagtaggagaaagtggatccaggagtctctctctctctctgactgttggagaggactgtccaatggtacataggctttctataaatggaaatgagctgtatgtccatgaagtaatcaagaggcttatgtcatccatcctccaacctgagaggacctaagtgagggtgcttgtcagcccaaccacacctgctctttgcctaggactactatatcaatttatttttcccttcacttgattattttatgtaaaaaatatttaatgtatttatacattaataaatgtaattatttattgttgtcccaggacaacaaagctgtgacctgaagccaccccagggaccaactattttcttggaataagggctggggaagctgcttatagggtcctgctagattgcccaggatgggaaaagaagtaagaaggttttctgccaatgtagacaccattaaatctgtaccaggggttcaaagagtcaaatacattcaggccagtggatcaacattgaatgtcaacattttagtcattcaaagtaataattctttattttttattgtgggaagagcacaccgtgagatctaccctcttaacaaatttttaagtgtatggtacagtattgttcactataggaataatgttttactgcagagtcctagaacttattcatcttgcttaactgaaaccttatgcctattgattagtcactaatcacttttcccttccccatcccctagcaaccaccattcattttgtctttggttctatgaatttgattattttagatacttcatattaagtgagctaatgcagtatttgttttccatgtctggcttatttaacttagcataatgttctcaaagttcattcctcttattgcagattgcagaatttccttttttaaggtcaagtaatattccattgtgtgtatatatcacatattctttatccattcttctgttgatggacatgtaggttgttacatcttggctatcatgaataatactgcaataaacatgggactgggcaggacagaaaaacaggtttgagctccatggaatctctccttatctccttttccatttccctagggaaacccaaagcctagtggttgcctgtgtttctagagcactcttgatgtgttccacaagacagggagcaatgtgaaaggagggaccaggtcttgttcacaccagcatgacagagaggggaaaaagggttactgtgttacttcctgacatctctagggctggaaggctgggaagaaccttggcatcactggaaggatggaaaacagtatggctctgcacggggtataagaaatgtgcagattgggaagggggaaaaggttaagattgggaatgtcaccggagccagtgtcactgaagaaactggaggaggggagatgatgagcgaagaagagcttaggggtgatggtagggagagctaaagaggcccctagaatgcgtgatataactctcctgcatgtctcctcccaaaacattcagtaaagtcaacattgctcagcaatgctttatggagttggatttgcctttttggaaggtgaaaaaaaaaaacacaggcggatgaaaacagagcatccccataaaatcagtcaccttggggatcacacttgtgtccttagtggccaactttgtatcatgggcaaggctcttttgtttgcagttctctgaagcctggcatgccatatgccctcagtaaatggctgctgaatgagcagattcactcaatgtctatgaaagcaggaggcttgtaagggtttgcctctctcttcctctccagcctccctccagttccccaggaacatagattattttgcagatcaactagggctttgggcaaagtttcagctggatttgttcattcttctctgatttgctttgactgtccttggtcaggattgcagccaacttgaaacaaacacaaaacaaaataggaaaacagaagaataaaataacaccagtatattcctttaaaaccctgtctagtgctaatagaactgacaagaggaaatagtatttaagcaataagagggctttgttcatgtcagagaatcctgtagctatgaatgcttcagatgcagagataagacccccaatccagccttcagagatgtgcttcaccaagctctgctgggagacaggcagctaagaacacaaggggaaagaattccaaaatgatacatgtcgaattgctggcctggatttcaaattccatagatagtttatgcaaagtcttgcgctgttgtaaagtgtaacacaatccactggcagatctgcctaaacccggtcccagttgtttttgagaaaaataaataaacttaaaaacgtcttccagcccatttaagtggctatgttctacccttagcctcctcagtgtgaggcttctagagatttgaataactgaagccatcacctaatttgtcagcaatgggataggagattcatggcatgtttcttctcaagaagttaccagtgatattcagagaattaatattgtgctttcagaacctatcaattcctagggccagggtgaggggaactttggcagctaacacatttcaatactttttgatgcttttaaagcaatgaaactcttttcttaaaagaaatattataaggcagctttatatatacaacaggtgagtgcagatgctctgtttgaaatagtagagtggaaactaagtagatcttctctacatcatgatcccctggccaacttcttcatggaatccaaggaatccatggaagacatgtgaaaacctattgtctaacccaacattcggatgtgcaaggtaaactaagggccaaaagacaagacaacttgttcaaaattgcacaccacattttggttatctgtattatccatattgtatttgcaactttactataaatatgaaattacttcaacaaaagttttatttaaaaataaaagtattaatgcttgcaactgcagattataatgcaaccatgtgctttgattagtgtctcattattataaagagaattgagacctggcattttccaagacctcctcgaagccagaaccattgcaagaagtaatggaaagagagacatttgaatttgcacagatttatagatgggattcccaggatggaatatagcatagaatatagatgggattctcagcaagatggtgccaagagtaagaaggatgggctgtcatagaaaattcagacctggtcccgttcattggagcccactgtactgaacacattgttaggaaaactgatgttgatggttttatatctattttcaatggctttctaagctaacagtttggattttttttaatttataaaattacatatgatgatgtaaaccaaaaccacctatgtataacaggtgtatgcactacctgaaattgacaactatacaagtttttcatatttgcttcatgtctctttctgtaagaaaaataacacaccacaaataagattgaggtccttttttttcctgactcccggtgtcatttcctttccttgatacacagaggcaactaccaccctgaatttgatgtatagttctctactctatttttaattcacatgaatcgctgggcaatatatagttttgctttgtgttatttttataaatgacgtcatgatgtacttatccatttgcaccttatttcttttttcctctcaatgttatgttttgcgatctctccatgttgatgtctatgagcttaccattagggcttcctttttatttggctagagaccatactgagccaagtgttaaactatttttatatcatccttgtatatgaatccagtttatttctcttactgttcctttgccataatagaattctgtcatgtgaatatttcatattttatacatttctccaccaacaggagaacatatagactatttccaatcttttcctactatatttattgtagaaatggatattcttaatccttgtatatacttttccattttacttttgtttttgcttgttttaggtgtttatgtttgtttgatcttgttgaggatatatcactttttttcaatagcatatgagatcctcagggctctccaggtcagccgtacttttcggatgagtagaatgcactgacaagacatgaaatgacaggcccaaattcacagggaagttttgtgagagaagccacattagagaccagaggagaagtactaatttgggatgaccttctaccaaagacctcaccgatttcaaggacagctcagctgttcctatcctctttccctcattgcactgttttctgtttatatttatatatacatttgtaattacttgactaatatctgcacacattgcctgctctaagctcttcagcatctgtcttttttatcattttgtcccagagtgtttgacaagcaatagttactcaataaatatcatttgaatgaatgaatgaaccagtaaacgaagtgacatttgaatatgcaagaaacccctaagtttgaagaatcctgcttgtctataaatgtttcctgtttcttttaatactgtttggtatttactatcattgagaatgaatttgtgtgtgtgtgtgtgtgcgtgtgtgtgtaggggtgtgtgtgtgtgtataaagtgatggaactgattttctttgttgatggaaaagcaaatactaatgttttcagtcttttctctgttgtaatatcacttggagcacaatttacagatttgttctaaaatcttctacttgacactcaagattctatgagatctaattgttcaacccacttttctgccactgtccctcagcctcagtagtaaccatttgatcacaacttaaggcgtttgatcaaacctaagcattctgggtttctgctttcctctgagccttgcttctgttccctctgcctgcaatgcccttcctcttatcactgccctactcttccaggcccaaatcaaataacaactcctccaagatttgtctccgtgagaatatctctgtcatctctaccatcaaaatatgttatctattatatccttaaaagtgttgaggattacctcttctacattagaatgtgagctcctggaccagattctggtcttttcatccctgttttttcctgtggtgccaagagcaaaataggtgaacagtaaaggtttgtaaaattgaatttagttgaacttctgacactctctaaaacatgattattttttctttatatttttccaggtgtgtcgaaccaaggtgatagatctcagtgaaggcatttcccagcatgcctggtacccttgcaccatcagctacccatattcccagctggctcagaccactttttggctccgggtaagctgaagctctgagagctttggaatctccagcagcgagccacagaaaacactgactcccatgaccctttctgaagatgggttgtctacctgctgagggtgttaattgtaagaacagggaacaaaacacttagcagtgtgatgcttcctgaaatggaatcctaattgctcatggaatgcccccactgagctcttgttttagcaaagagtttggatacatcttgtctgcctggaacctcctattcattgttcaagatcttttaaaattatcttttcctccttgagccttttactgatcaccagaaaaagaagtgaccattatctcccttcttgtcctgcatgtttggtcgcttgttggatggtacttgtcacatggtattacagaactgtctatggtctttctttctggctaaggattgtggatattactgcattttggcttgtgtgtcactgacctactttgaattcccaaaaatgcaagggccatatcttatttagctttctctcctcaaagccgagtgcagaggttgacatggagaagtgaaagataacagtatgcacctttttttgtgtgtgtgggttttagtgtggaccgggacctttgctacacactttactctcattatcttactagaacctcacaacaatcctatgatgtacctgttgatttttttatttttttttaatccaccatttggaaataatggaacttagacccagagtggcccagccattcactcaatgtcacacagctaagtatgagcagagaaagattgaaattgggtttctgatctcagagcctgtgctcttcactgttaggtttcattgcctcctccttcccatcttggacccctgatgagtagtagcccagttcttaaaaaggaagtttctcctcaaatgcaccccaatgtggctgcctccccaccacatgactgagtgcacatgtgaccctcctacgtcttcacaatttcaggcgtatttttctcaaccaatggttgccgcagctgtcattgtccacctggtgacggatgggacatattatggggaccaaaagcaggagaccatcagcgtgcagctgcttgataccaaagatcagagccacgatctaggtaagcatgctctcttggtcttggcttgctttcagtacctgattccacctctgccccataactagttgtgaggatcagcttagaatgagctcttccttcctttttcccctttcttgcttcttttctatttggcattctggttgccctcaaatcaagatgtggttatgtatccagagaaatcaagatctggcagatacagggataaggggccaatggccaagcactcccttctgccagccacctttaactcagacatcctgtattattccccacagaccccaagaaggagagagactgagtaagagccatttccccgttgtacatgtcaccatctgagacccaaagagaggcactgagagaccccaagtcacatggcaggtcaggaattactagttagattttcagcgtcatagcctattgctttttaccctataaccgggagtgttcatgaccctccaccccaagtggggactgtatcaccagtacaacctctggagaagtttccaatgagaataggaataggaatattgtaggagtagggaggcagttgaggagtcaggttctaccatgggaggacctccctgagtgcagggccaagggggaggacaagggctggacttggccacttgtaccacccctttgaatacccacatgcaccgtggtccagaggagagagcctgaatccagagctgacagctgaggtttggatcctgtccccaccactcactcaccttgagaaggtgagcaatcttcctgtcctcacagcacatcacttagaggctcacttgcttcacatacacagcaaggacaatgatatccaccttagagtcagagtgcactattatttgacactgttgtaaccatgcctagcacaagatcgggccctaagaattcctattgtcgctaagaatttcctatgacaccttcacacttccagtctaccctggagagctctgggcagcctggatactccaagtatttggaatttttggccactactgaagcctggacttcaaagttgtgcccacaccattctgcagagaacgcctttcaaagacctgtatgaagcaagccaggcaaggggtcatttcagggtcagataaaagccaagggagcagggaagattttcttgttttgtttttatgcttgtttatttagttccttttaaaggcaaggggaacctatgaataaggaagagaaagaaaacccctctggacttagcaggattcctgggaaatttccctaagtgagaaacaaatattttcatagttgtcgttgcacagcccagggctctgaggagaggttttttcagcagagtggggaaaagtctggttccacaggagctctttggatcctggtactgatgcctgaggcttttctgtttttcccctccacccccaccatcaccatcttcctcagtctatgacatcccagcattctccgaggcagcttcacctctggaactgagaagggcacctgcttcaggcttccacatgggagatttctccttacatagcaagcccgccaggacatggttaggattataccattttttggatgtgaaaactgagttttaggggctttctggagtcccattattaggaaggggctacaccagcatttaaactcaggtccacccaacaccaaagccaacttctgttttgctaattccatcttgccacagccttcctttccttctgtcccttgtgtatcttttctccctggccctctcccttccttcttggagaatgggaacctgctggctgcattaaaaaaaaaaaaaaaaaaaaaacagggctcttgagtgaggcaagcttgaattctccctagagttttagccatgcctgggctgtgcttctctggaaaaccacccctgcccacgattctcaacctcttctgcagactaagcaagaagtccttccctctcagggctgctcccaggttcacagattacttatgagagtgggctttttaccctgggaagcgcctgttgctatgaattatttccatcacttttccaactgaccaggcaggcagcctgaaactcagcaactcagaccaacaagccctacagcaatgtgggagggaggtgagggcctgggatgcttggctgaggggtggccatttgggggagggagagggactttgggcagtaggtgaaggggaagcttagggggcagggaggcagggggattggaaagatttggaaccaagaaaaaaaggcagacaaagaaactttcaatcagactcaaaatcctcaccggccgcccaatggtgcttttgtgcagtgacatgaaagggtctgggggcttcgggaagggcccgttggggagggcgtgactggccttgagtaatgagcctggcccctcggcccctctgtctcccctgacaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagaggtaagggatccgcggcagactcgccctaggccacttgtagccgagtggagacagtgtgattttgaagctgggtagccatttgtgtggatgtaaaaagtctgtgcatttctcccttctccatccatcctctggcctctggccggctctgccttgtggcccatgagtctctgaattcctggggcaattaagggaaacggttgtgtggtgaaaaaagaacctcattcacctggcttgcagcggcagaattgacaatagcttgcaggttgaccctggaaacatcggtttccttctctgagcttcagtgtcctcatctgaacaaaaagaggattagctctcttttatctctgaaatactggaatattctgcttcccgtggcacaagcaggaggcataaccttcctaaccaagggggatagagtgagactggtatttgcatcatcctagttcaccgtgtgtttcagggataggtgaaatctctatgtcttccacaagcctagctcctgtgacctcatgagtggtctaagagcctgtctttcaactgcatgacatcactccctcagtgcttttgaggtgccatctgttaatgcacctagtttggagctacaagcgagtggagtttcctgaaaagaatacgagctttgggaatactcttacttgggtttgaacctccacattaccacttcttgaatgggtgttcttgggcaagtcacttcagttttctgggtcatagttttctattttggaataagcagatgaaatctactccacagggtggttgtgagggttacatgttgcactatagataaaagtattcctgcagactgttaggcactatgcaaacataacatattaaagaagaatatttataaccatcttttgatgatgatggtgctgcttctgtgcacagaattttttgtaaagttcttaaagttagagctggaaaaagcttcagagattatctcatgcatctgacatgtccaaacttctgtgttaccatgtagaatcacagggcccagaaagggaagaacttgcgcagagttgcacagcgtctctcagatttgtttcatgaggtccagaagaagagagagttgtgatttttgtaggctacccaagagtgaggctctctgaaagtcgattcagccttgccctgtatacctgggggcaagaaaaaaaaaagagaagagggggacactagcctttcccacgcccctgttaccacagaggacacaaaaggtggttgcaaaatccacattgtttagtacccactgtctctagcttctgttgtgcaaagtctgtcgtaatctttcagaggcaagagcttcttaaatataattcattgtcttatttcactctaagaggatgttttccacaagcccttgttctccagaccctataaaaataagttaattctcagagcctagggaaaccatgtcaatggaaatccactagaccttttccacaacactttcccatttttaaccagccttcctgaccatccataagttgactgaggcccagactgacttgtttgaattctcgacgaatggtgtctgtgccctaagtaaatagtaggaaatatttaaccactgaaacatatcgattgatacgtatttgttagttctttggttgtaggaggaacattgaatgagggcaaaatgctgccctatatctgactaattatttgaccttggattagtcattccccttctctgggcctcagtttccccatctttaaaatgatgatggtggattgtgtggattctctgaggttcttttcagttctaaatctgtgtttctcaacagttaggaaacatgagagaggacaggaagggacaaacccttgttgagcccttaatagaaaggaacattatcttattttattattgcacctcttgaatagataggaacagtatcttattttattattgcacctcttctgcgaggtatggctcagagaaacagagtgagtgagtcatgaccattcaggcagtaagaggcaaaatcctgctttgtctgtccctgaaagccgtgctctgcctaccacagcaaggcacgagtagcagagaaggaattttcataactggacccatgtgatgatttattcagaggaactctgagtaaggggatggagctgcagctctgaggtctttggctgccttatccctgagcttggatcaggctatgacaggctgaatcttgagggctgaggctgcagggcaggagcacctcctcctgagtgccccagtggggaaaggacagcagctgttcatggggagctaaagaggcatttaccaaaacaagcaggactctgcaaacatgcaaatgcattaaaacaaacaaacaagggaggaaaggaaagaaaaataagcaacaactgtaaagaaccatgggatgttttccttcattctcaaaacaccaaaataaatagcatcactttttataacacaaatttcaactggttgtaggagaaacatcccactttactctcagctgtttcccaggtagtgaaaagtactgtttctcccctccccttctctcctccctccacaacctttcctctttttcctgcatctctccctctctctcctctcccttttctcccacctctccatctcctctctctctctctcccccgccccccaccttctcttacctcctttctcttcctcattttctgtctctcctgagagcagtgtgatgcctactgtgctgccttgggaggagtcctgtagcaaaaccagtttgggcaatgtgttccactctagcttcaggggtctccagtctctttgcagtacttggtataaattcagagacccaagaaaacaggatcaggtttcaaaggagaggtccagttgtgcaattctagccaaatctcagccccacaccaagttgtggaaaggagaaaaggtggggagggaaggatagtgatggggtgtggggtggttaataggcttctttaatgagaaaaactacagtggtgatattgaggctccagtatctgtcacacacacatacatgcacatacatcatgttcatccacgttgtggttcttaacagaaattgaacagtttattataaaattgaatggaccatgtatttagaaaagtaacttccttccctcctccctccatttattcttctttcctttcatgcttcctttcttcctctcactctttttcacattcgctttcttcctttatctcaaactcttccccatttctacaagctggtccattcagagagagacagttctgattgagagctaagttttaaaaggccaactttggggggcaacaagttcttcacatggctagattaactctttcagccagggagaacttagactgttgtttgttggttgggggtgggggtgcccaaagactggagccaagtatttctagagtctgtgccctgatgagaccccatgtgtagaatatctcattaggtaatgacacagggattcataggtaggatttggaacacagaatgaagctgctcttggccagagaccacagattgctcagatcgctgccataacctcattcaacttccccaacccacaaaggaattagtgcctctcagcacattgattgggaatcactagtctggggaatataactacaaatggaactgctgtgcctaagcatgtgtgtgtctttgactatgccaaatactgcctgactcttctccaaaatattgtccaattcacagccccatcagtgatctaccagagttccagttgctccgtatccttggcagtgcttgagattaccaagacaactttttcctatttttctcatttcaaagggctctgaaattatagacctctgttgttttgttctcataaaatcatgaggcctaaaagcggggaaggctctgaaagatttcctggttctgtgccctcatttgaggatgggaaatctaagttctaagcaagacaagtgactcgcctaaaatcacctaacaagttgggggcaaaaccagcactggaatctagttctcaggaatccagttatctttcctctccatcagaggtttcaaggctggtgttccatagaccatattagtccataaacaatctctctttggcctttattagttatctcctttaattagttgccaacatttaaatatcaggagagttcatattaaaaaacagaattcttcttggaactctttaaagaaatgagaagctttgaaaacatcaggccctccatcctactaggcaaccttggactagagcaaagcgctctgctctttggccaggcacataccctctcctcgacacaccccactcagctcgcttgaaccctgcaggctactgagcttgcatcacctaatcttcaaaacttgcctccataccacaccacaatacactggcgcctagaaatccagggtaaagaaccttttaggatcattcccccaggtgcctcatttctgggtagaaaaatgaggtcctagcatagtagctctttcactgtttcacttcctaagtgaacttgcagaattgatgccaagaacagttttccctccattttctagtgtggagcacttgtcttttttgttgtccccatctgagcaacccagaatgatttataaacagcctttctgtttttatctctgcttccctgtggcataattgcagctaagtggcagggcacagcagttacaccgtgagtcaaggaacagaaccaggagagggacccttgtcagccctttaacttctggctttatccgggttccagcactctccagctatcctctgttatgtgtgactggaatccattcttattgacaatggagacagcagtggggggattggctattggatcagataaggttttacctctacatggaatttgagtccaaaggtaaatatattaaacatatagataagaagaaaagaaaaacgttatttaagtatctgatcagctctgcaccccagggacctccacttttgcccaggtttgagaatttgatctatagaattacctgcattctttcccgctcatccatccaatcagccacctttctcccttcaaagaagtgtcttcatttttttccttcttttgttatttttattgactgcccatcactgttattaaatccttccctctttttttgaatgaagcagcagagccttttattttgttttccttgttttgttttttgtttttgtgtttcagaaatgacagggctgtatcacagagttatttgagacggtcagttagggtaatgtttatcatttttggacagtgtgttcacacaaccttgtccaactaacaggatagcaaagaaaaaagagcagggacttaggggacagactggcagatctctattagaattctttccaagctgagtgcccttgggcaagcaatttaaaactcttagtcctagtttcctgttcttgaaaatgggactaatatcactacctcaaggagttgctgtgtggaatgcaaataaggtgatgtaggtgaaacagagtggccaatgcctgacacatattacctcccttatcccttttcttcctgttttcaagcctgcaggccaggtgcagacagatgtgctgaaaaagcaagatgcctcaatccctgaagtgtattctggaaggcagtagtcctaagaaatgtcccatgaaaaaaaaatgttatcagagtttaaaaaacaatgtgtaccttagccccttctggaaattttcaatgggttatccaaattattgagaagtcctgcaactaagaaaactaactggtttcattaactcaatgctacccctactgatctgaccacgaaatcttttgatcaggtgattcatgggaccaaggaccattttttcttttatagcaaaaagagacagagtagagagactcatcttctcaaggagcttcatagttccagaagcatttctctcgctctttctctctctcttgccctctctttttttatttttatttttttgttttatttatttatttatttatttattttgatacacagtctcactctgtttcccaggctggagtacagtggtgtaatcttgtctcactgcaacctctgccctccagattcaagtgattcttgtgcttcagcctcccaagtagctgggattataggtgtgcaccaccgctcccagctaatttttttatttttactagagacagggatgcaccatggtggccaggctggtcttgaactcctgacctcaagtgatctatctgcctcagctcccaaagtgctgagattacaggtgtgagccaccacacccgacctcaaagcatttctcatatattggccttactagtctacaaacacaccaagctccatcctgtgctggaattttatacctgctcttccctctgcctgattatacctctgccccaaacctgtgtatggcttatcccttcattttacccaggtagtagtttagatgtcccttcctcatggatccttctatacaaagtgccttgcccctttccaccaactgtcactataatttcaccttggtttaacggcctaactgcatgcatcattatctgaaatgatctcatgtattacttttctttggcacacaccctccctcctgaaatacacaggataacaggcatcttgtttatcccctccgtccactatattcccaatgtatagaacaatgtctggtgctcagtaaagcccccagtgaaggtctgttgaatagacgaatcagtggatgatgtctcaccctgttgacaatcctaagaaacaaattattttattacttccactttacagataaagaaactgaacctcaggatgttatataagtttccaaagtcagacaactgataaatggcagagcaggggctggagcccagatttccctgattggtaaaccttgtgctccttctaccccagaaaacgaagcatttcagatcttcattttcctgtgaagaagaacttaatgtgcacaaaataattggggagggcactatttatactttaatggctctgcaacttaaagaagaaagtcatctttccctctgggtcttcataagagcccaggtaccttctgagcgtgcagagtaagaatgcccaaactgttaggcacaggtcagaacagcttgggagctagtagcttacagagtaaatatatttaaattggaaccatgtggttccttcccctggtgcttacacaatgtgaacagatgcattgtttagtgtcaaagcccttgtgttgactccacagttacagtctctttgaggtctccacatggtacaatgctgaggctgtcaggagtaagaaaaagggcagagaattggagttgtctcaacaagtgttccttaatgccagttgccctgcatttcagaaggagagtattggagaactgcaaagctcccatcagtgagggtctgagacctaaattaaatgcttgtcctttctgggtctttaaaaaagtaaattggtttgtgatatgctttggaagcttttagctccccccgcctccagactttatttctcactatacttttgagcagagggtagagaataggaatagatcccagtaaaaccctcagttgggtatcgtgaaactgagagaaaacaaaaaacaaaaaacaaaaacaacgacaaaaaaaaagtgcaaaacttttctgacactggtttggccaaaatgtctccctgtctcctagataaaaataggaacataaaagccttgaggttctagatgtaaatcatcggtgcatacgataggccaggtgttgggggtagacacagtcagagaggcaaaagtcagagaaaactgccccctagaagcttttactgttaggcagaatcaacctctttaaagtgtttaagagctattgcaaggcatcatcaccattggtttcctgccatttaggaaacatctgcaaggaatttttattggcactgcaaagtacaccaagatgaaataggcattttctctgccctcaaggacgttctagtccagaaacatgggacaaggttaacaacaaggcctttggagtcacccctctggatgggcacttaaacaagtaacctaatcttgccagtccccaatttacccaactgtaaaatgagtaacgcttagctcatagggttgttgtaaggatggagtgagctcatgtatataagcaatcagcaaatagtaactaatgttattgagtgcttgcctaactataatacaaggggaatgatcatccaagaatgaggatttcatgctgtttctgtttgcatccttaaagattagcctgcaatctgttatgttccactggcactgaggaactgagtttttaatacatcaaacatgaggcaacagcattatagaaagaagggtagaatacccatgagggtgcttgccgagggacacaagagaaagcttcctatggaaatttgcatgatgcttagacctaaagaacgggtggaattcagactggcagaaaggtagaattcagagttgcagcaagatgcaagacatagtctctgtacaactccactaatgatgtgtaagttatcttacagtttataaaagacttctacctccatcacctcagttgagtctcgtggctatatgaggttggccaaatttaagagtataccgaagctcagagatgtgatgtactttgccaactaggtaatagagcataggtatatttacaacatcagctaccacttatttttatttatttatttatttatttatttatttatttagagatggagtttcactcttgttgcccaggctggagtgcaatggcgcaatctcagctcactgcaacctccacctcccaggttcaagctattctcctgcctcaacctcctgagtagctgggattacaggcgcctgccaccacgcccagctaattttttgtattttcttttttagcagaggtggggttttaccatgttggtcagcctggtctcaaactcctgacctcgtgatctgcccatctcaggctccgaaagtgctgggattacaggcatgagccaccgcgcccagcccagctaccatttactgagtgcttagtatatgccaggagttctgctatgcgtttttttctaaactgatttaattctcaaaatgatccttgtaagtgggtactcacaaaatagaaaaaggcttttgctcaacctggtgcctggtagaaaaatgcaataaatattcactgtaatcatgatgatccctttctcacaaatggaaaaactgaggctattcaaggtttaaatcttgataacatacaaagctttcaagtggcaagatttgaactctggtttgtctgttgccataacttgtgctcttaatgagaaactttaatcgctgcctctagagtcatcttcaccctagccagcacccctttctgtcctcagtctcaagccccctgaaatcttggagaaagaggctcttagcctttatcttccaactgagcatagctgtcctgtgaggagactccttcttcccctcgtttctttcctccccagctgcgtgcacttcgcatgtgagaaaactgactgtccagagctggctgtggagaatgcttctctcaattgctccagcagcgaccgctaccacggtgcccagtgtactgtgagctgccggacaggctacgtgctccagatacggcgggatgatgagctgatcaagagccaggtatgtgcaggtgctgagctcagagcctctctgcagcccagggaaggcttactgggtgttaaccatgttctctgctaaatacccagcagcacttaaaatagtgctgccacatagtaggtgctcaataaatatttattgattaaatgaatgcatgaatgaatcaattaaccaagcaagcagtctggaatctctaagaaaaagggttcctgtgcagagtagtgttccacacaatacttaccaatgtttttgtgtaggttgcaaatctccaagaccatggggctgagtattttggaatgaatatcttacagtgagaacataattgaatgggctgctttatgacaaggtgagccctctgtcaatgagatgctcattcattcactaattcattgcaaagcatctgttcactggaaattggatgctatagtaagtactaaagaaaaagaagccattaagacaaatcgagtccttcttctgaaggagcttagtgcctagtggtggaggaagagtcagacaactcattaatgatgaccccactgtgtgataaatgctgtcaagggaattgtagggtgttgtggaggcacagagagattcaagggaggtgccttggaaaagtgacatggaaacagctaactagacagatcagcaaaggggtgtgtgttggggagaaggaagaaatatatgtagtaggcacaggcatggatagtatgtggaagcacattgatgagaaaaaaaaaaaaaaaaacatgccacagatttttttgtttgtttgttttctttttctgtactcacccaagcaatgaggctggaagggccagctgaatccactggtgcagggcctgttgatttagtcaggaagtgtggggttgatcttcaggacaacagggagctgttgcaggaaatgacatggtcagatcctggttgacaaagtctcttctagatactccatgtgggtgtagcttggagtctagcagtaagactggtagcagggagaccccctccctcagacagtcatcaaaggagtcatggaagataggacgtgtcctgcgtgagattggtggtagtgaatgatttggagtgatgtgacagaatgttgcttcagcaagatggtgctgtaatgtcccaggtggggcttgggggagtgggacaggttgtcctgggatttgaggatttctgtcactaaatgtagcattttccagggctggtcagtggactttgccttcaaactgcaagcacacagggcacattccttactgctgggaatgcctatttgtacagaacttctggacttgctcttcttagacacctacttccgtgtgtcagacttggcaggcctgaactcctgtagaaacaattagactgttttggcagtgagggacctcactcaagcacacatccctttgatgtgtgcttaagagggaaaatgtcctttgcttttaaaatcccagatcaacgtttggcatctccagtccctaggatttagcggcttcctccttgaatgaaagcctccaggctgcaatgattgtccatcccttgactccgtagcatggtcttgccctccacccagctccaccatcgtgtagtttggttcaaatctccatttactctttcatttttcctaggcttttttttgtctttgtacccttctctcttgactattgagccgccaaatctgagagtagggagtggatctttgagcagttcatgagttcaatccatccattttgccaaagggagaactcaagtaaggaaaagggacttgcctgtggtctcataacatggaggaaaaacatggaggtctcctatagccatggagagtgcctactgtgtgccaaacactacaacaagttcctagtaactcctctagagctaataaaagacatacaaatcaacacttgatgtcctaccattgaactgtatttcacagtctgttttgtgaaagaagtcatcatgccctgtgaggtctcaaaacctcaagattctcatcaataaaatggaaatcgtgatctgggaggcactatagacagcagttaagagcatagcctttggactcaagtccaacttatccttttcccagctggttaacttaaggctgatcatgtaatgtctctgagtctcagtctctgtgtctttgagatctgaaatatgtaattcatggagttattgggatcattaaaagtgagctaacgttaaacactaagcattggtctcctagtgcctgggcgagactctgagccgtcaccttgggaagaagggtatttctccacatctagagctcagtctgccactcctcactatgcacgactctgcctttcagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggtatcaagaacgccttccccagctcagccttcctttgtctatgggaaacctagaagctgcatccaggccctctttctgggtctcaaacaccaagggtgggatgggttttatctatgctcctgacttcttcctactaattgtatttatgtaaactgccctgctatgcagataagaaagaaaaaagagtgtatggataattatgacagtgaagccctttccaagaccttggaaatcttgcaaaaaagaaaagaaagagaggataaaagtgaagaagggagggaagaaggaagagagaaaaagaaaaaaaagttacatttgggactgatgaaactaattcactctgtatgattagggccagtaagccttatgaggtaagcgttactattattcccatttcacagatgaggaaaccaagcctcagagggtttaaagaacttgcccaaggctgcaccatcagtggtggggaccatattgaaacccaggtctgttgttctccaatgctggctgccactcattaagaggggccagctgggcagagaagagcagatatggacaggaagcatctggcatcctcctgagctaggcaccagggctattgaggggaaaaagacactggcataccagagaagaggtcacattttagaaaaaagtgagtagctggcctgggtgtcctagaatgctgggactagatgtggaatgtgttaataactccagactaggaaatcatacttctctcaatcaatcagaggcttttgggaaagggaggtgtataaattaacattgattattacagacctcattgtggctaataataatacttaatcaaaatgatgcagatccttccactgccaactgttgttggggaagtgtgacctggctggggagacaaggccttaggaggaccatcattttgacagttggtgatcccaactttgcttttcctttgaccatacagggaaatatctctctatttccatattgatcaactaggaccaattgccacttcatgcaacttggttgtcagcatcatctagtgttcagagtactgtgctgaggcttctgcttggatctactggcagcaaggactgggcaaaggtcctgctgcctttctcttgaacttgatattgccacctaatttgccctcccaccctcatctcaagccagggggtaaagaggtgatcaatttcaactttccttcttttacttgcttcccttttctcctttctaccttttgtttttcctttgatcataacatagtttaagcaaaaaggacaacagtttttttaaaaaaaacttttattttaagctcaggaggacatgtgcaggtttgttatataggtaaatttgtgtcatggaggttcattgtacagattattttatcacccagttatgaagcctgccttaataccctttagccatttttcctgatctcctacctcctcccatcctcttccctgtgataggccccagtgttagttgttctcctctatgtgtccatgtgttctcattatttagctctcatttataagtgagaagatgcagtatttgtttttttgttcctgcattagtttgctaaggatgatggcctccagttccatccatgttcctgcaaaggatatgatctcattcttttttatggccacatagtatttcatggtgtatatgtaccacattttctttattcagtctatcattgataggcatttaggttgattccatgtctttactattggaaatagtaaaagcactaattttaaacaggcaataaataataatgataataatgaccagcttgaaatcctttctgccctcagtttttgccccacctggccctctcctctatttgtacctcttgtccttcttaatctgtcttcttcctctgtacttccgttaaagtctaccccttaccaagtctacccccctgctccttgcaatccccccgtaccagcccttggctaatgcagccagttgattgagtgattgtccttattccagtccagctagtgcatttttgtttcctccaaacaatatagtggccaatattctttcacattctaacatgctagagatggacaagaactcagagacagctttggtttagggacaaacaagttaggtgatttgttcaaggtcacagataaattcatactttatgcattcaacaaatggataccgaggacctactattcgctcagcagtaggctaggctctgggagtaacgaatatacaagatacagcccttgccttaggatctagaaagtgccaacaccatgaggcaagtgcttagaataccagattgaaggtctagtatttctctccttgagttctgttctatgttaattttaatctttacagcactcccaaagagacttgatctcctgggtaatcttttaaatgaagtaataaaaataagtacctctcctttgacactgctacaagttgacaattgttttaatgctcattagagattggaatttccttacccacatttgtagacaggctgggcaggatgtatttttctgcattaaaagatgaacaagtgaacttacagggtcccaaaacttgacggacccaaaacttgatggaatctaatctctaatatcaacacctctatgaagagacgttaccctctaccaggaacttcaggctcagacatgccttcacttcgtgtcttgagtcatgttcccccaggaaatacggtgggggaatgaggacaggagacatggaactgacaaaagtcaacaggctctcttctaaagcaagttgccactgtgggcaactagagctcagtccctctgggaaactctgggagacggtggagaacatgcctccgagttattgcaactctggaaactggcacatgaatccaacaactccaccattagtttagtggtgcttccaggggcattaactccttggtactttaaactcaccctgcatatggacagagtaagcatcaatgaccagtataataagcatccatgagcagtataatagccctcaggcagagagttggcagtgcagtaagcatctttcacagtatacaggccagtgccaagaagacaaacgaagggcacatcatgtatcataccctactttcttcaaagccacattgtagatgcagggtagtggctacagctggtgcacagaaatactgcccagttgaaaactctcttggagtttgttgcaggggtggggggacatatccatggtcctgaatcaccagtgcctgctttagctgtggtgcactgctaacttctattcaccctcttccagaaagcacatttctggtttgcattttctctcttgattaacattttggaaactttatgttctcttgtcacagaaaaccacgactttcacttcataatttaccatatacatagctaatacaatgtactttttaagagtcccaacaccttttccacagatatgttatctctcttaggcaatttggagagggtgtgcttcctgtactttatatacagctccccttcccactaaccttgtgcattagctgggcaccccaaagcaatgactgccccgattacaagggcaatgcaaaaagaagtttgtagacactgactggtattctggacgcttctatgcttctatggaaaccaaatgaatcacctttctgcacactttactctttttacttgatgttaaaatatatatagttgtcagtctcacagtttgtcaatgtggaatcccctatggggtttacagacaccaatctgccttgtgctaaccagatgaatcatactgacaaagaagaaaaatgaaaaaaatgagaaggaataagataagtggaggagcgtacataaaattgcaaagtactttctcccctttcttccttttcctgctttttcttatagtacttggcaccttctggcacactaaataatatactttttaggataatttattgtactcctccctgtcccactagattataagcatcaagagaacagagctatttctatcttgttttgttttattttgttcactgctttgccttcaacatataaaagtatctggtgcagaataagcactaaatagatatttgttgaatgaatgaagacttctgtgaagattctttcagagctactaatgaagatgaaaagaagaaggaaagtgggaggaagcagggaagtgaagaaaggaaaggagggaagaaggaaagaagttaagaagcaaacgaagacattgacaacacttttataggcacttttcataaatgttgttttatttcatcttctcagcaccctgaaaggcagaagcaattgtttgctttccacagatagaaaaattgagatttgatggctccggaatgaataataagggccctgctgatcatacgtagtagccaacttcccattaaaaacaaccatctctgtagttagacagaatttgttttgaacctcagttttgtcttttgccaactatgataacttggtcaagtcacctctttctgagtcttcatttccaaataaagactgtcatactaaatgcactgtttatagtgagaataaatgagattgcatatcagaagcactcggtacatagtaactgcccagtagatgtcagttttctccctaccactccacctctccaacctgcaagtccccgagcccccgacatgtttccagccctgattgtcaacaccattcagtaataaccaggaaaaggagagtttggtggagaaacacaagtttcaggtcctcctctagttgtcttgggaaggttttaggcgggctgtgcctcgataatatatgagctggcagtgaaaagcctaactcccgtgttttacttttatttgcaacgttccccatcagaccagcttcccaatggcagtcagcactctgtcagagctggcatgggctacgggggaagtgctgctctttcacctgctttggcaaagcttcactgagcaccaggacctgaacagaaaatcaaatctcctaacacaatgctgtcacttccaggcattggtggtgggagctgggggaggtggtaggcaggacagatacaggggtgctgggcccagggggagagtggcagcttgaggtcatgcactcactgatatcagaatttgctgtagtttctggtgggagtttttgctgccaagtattagaaggcaagtgcctccatctctgtgctcagatgcccatttgtaaagtaagaaaaatggattcaaggattgtgagtgtgtcttttctatgcagcagaagaggctcaggatcagaagtcagaagccttggattttaattcactgtagacatgggggtaattcactccccccatttagatctcctcttctttgtggcagctctcttgatttccctaggctcctcagttggaagtagaaggggttggaattccacataagggatctcctggttcttcaagtcagctaaaatccaagtagctatacattagcttggctatcagagactcctccctcctctaaccctgcttgcctatgtcttccaggcaacaacagcctcctgacctgcatggaggatgggctgtggtccttcccagaggccctgtgtgagctcatgtgcctcgctccaccccctgtgcccaatgcagacctccagaccgcccggtgccgagagaataagcacaaggtgggctccttctgcaaatacaaatgcaagcctggataccatgtgcctggatcctctcggaagtcaaagaagtaagtggggttggaaatgcaaacttatggtctctgggaggacaagagttaggttcaaatgcctgactggacggaagcactcatttcttcactggaggtaatgactgccattcatcccattctgttctgtgagaagctagaaggatttgttaataatattagctttgggtcaaacagaacaaactttaagtttcagcttggctgcctaatggcaatgtgatctcagacaaatgactttacttctctgcacttcattttttttttaagccacaagaggggtatgataataacagttaccacgtaaggttgttatgaagaacaaatgaagatgtgcatgtaaagtgctcacaaaatgctttgcacgtagtagttgttcagtaaatggtgggtaatcataacatgatggttccaacacacatcagaacactctgcaaaaaaggggagagaacctggggctgaagggcatgagttttgtctcaatctacatgtagctggaagcatgacatttctgcctgctcttgctaaaggagttctgtggatgaattatccttaattcctgcacgggtcccaccagaacccaataggtcaggtggggaatcaaaactaggaaataggaaatgggggcccagctggtggtgttcatgcagggcatggatctagccatttggtccttgagatgtctcctgtttgatcctttccttgaagacgggccttcaagactcagtgtacccaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccaggtaagcctcctggaacttgagattgataccatggtccctttcctttctgcttaccaaaaactagcctgtacttcaggaaccactttctgcacttttgtaatctctgatcctcattttcctacccgcaatactgtttttgatttgctcagagattcttagctttgaatttttttttaagcattggaacttttatgaaggaaatcatacatggaatcccaatgtatgaagttgataaaagttaagttcctcaaacaggaaatgaccagggctcttttcccagtttgctacctccattaccacccatgttggtccttgaagtatttaaaatcacaagactgcaactatatttagacatcaattggctcctgaagcataaggaaaaaggggaccatatttagatgagaagtacagttttgagaacaccatggaagaaaggaagagcagaaggagcaaggtttgaattttatctcaatccacatgtaactgagaacaagtccaacactcctgcctgcctctgctgaaggaattttcttcaaatcctacacatgcccaaaaggatggtacgggaatcaagaataggaaaaaggaacaaaaggctgaaaaaaccttaagtccacaaggagctccatctccatcaaagcaaccatgcagagttgataacccaagtcctgtgtttcacaggtgtgcaaggatcatcagccaggtggggatagatttcagtgcaggcgtcgtcttcaatcagtctttattggtctttattgttagcctccagataccaggcactgccaaatcaccattctgaatccctctcactccctccatatccaagcaattactgagtcatacccattctcccacaacagcatctcctgaagctgttctcttttgtccccaatgccactaccctcactcaggccaacatcaactctttgatgagccaccatgcagcttcgtgatcattttcctgttttaattcctgtgcctctttccagtacattcttcacatttcagccagagtgatttgagcaattatgtcaatctctctgaaccaggagcccccgtcccttaggataaagtcccaactccttagggtgacatttaagacccttcccccatgccaataagatggattttccccccacacctctgcattctctaccttaaaaagagttatccttgtacctttttcagctgtctgacacctcatcttccttcgcaatttagcccaggcaccctttcctgcaggagcccttcctcaatatcccttccactgccgggctccgtgcccctcctcaggttcccccttcacaacattggccacactgcgttgtcactgcctgctttcattccacatccccacactaggctgtgaaacagtccttcactgcatctgcacccttccctgtgcctctcagcacttaggacagtgccaggcacctagtaggtactcaggaaatgtcacaggaattaagggcaggaggaaggactgcaatgaacatcaaaggcaggttcctccttttacagatgagaaaaccaagactcaaagaggttactcaaccccccatggtgacacagctggcatcggctgagtcacagtcagaatccaggttcccctgtctccagctgtaaatgggctgagtccagtaggcaccacctgagaatcctgttctcatacactctcggcgtctgtttgcattcatgggagtcattcccatccttgactgccagggaggcagaagccagtaccggaacaaacaaaggctagagattaccacggcctcttgcaggctgatcagcttccccctcactcccttacataaaactgttgctaacagttacccaaactgctgagccaaataatattctggctgcggtcatgttatcaaactgaaactcagcctgcctggggccttccaagtaactttcatggccagtttgtatttaaaggagaggaaagtgtaaatgtatcagacgactcaagcagctctgtttggcaactaacggagaggctagtcgcaaaggagcagggtattgcttgtctgctcaaagaatgagggtgtgcgtgccaaatggactcctaatacaattgacgtttctactttgtactgaaaatgaatttcctctaccctcagatcagggcctgagagccaaatctagtattcacctcagattccctcttgctgcctataaacatagcagaaatgcatggcccagagcatcttgaatcagcttgtatggagcagggattctttgctttccaaacaagtttcagatcctggcgggaaaggataggggctgttgtaggggagagtcacacactctcttccactgccactaaaagcaaataaaaacctgactttattcattccttgggagccagtatgacactggatctgtagtttgagttcaaatcccagctttattacctagtcactagaggccaagttacttaactcgttaagcttcacttttcttgtgtataaaatgaggagaaagaatactacatacctaatagtttgtttgtgaaggttaaatgaggtaatgaaaatagagcatgtctatgggtacccactggccttgtgcagtgcacaacctgtgcaatcatatgtggtagccctggggaatacacaaatgaactagcctgctttaaggtcactccagtggcgagaatcccttatgctctatgtgagctcctggagggtctagaaacacaacagattgcaacctagccctctgctggctagctctaaaaactgagaagttttctgttttctgcatatggctagccagttttcccagcaccatttattaaatagggaatcttttccccatttcttgtttttgtcagatttgtcaaagatcagatggttgtacatgtgtggtgttatatctgaggactctgttctgttccattggtctatatatctgttttggtaccagtaccatgctgttttggtttctgtagccttgtagtgtagttttaagtcaggtagtggaatgcctccagctgtgttctttttgcttaggattgtcttggctatatgggctctttttggcttaaaacctagatgacagtttgataggtgcagcaaaccaccatggcacctgtatacccatgtaacaaacctgcacgttctgcacatgtatcccagaacttaaagtaaacaaagcaaaataaaaacaaaacctgagaaggaggcacccatcctgcatgaggccaggatgtggagtagagagaccagcatgagctttagtcaaacctggtcccttgctcaaataaacctgtagaataaatagtcctctagttcctgtagaccagcactttccagtagaactttctgccatgataaaaatattcatatctgtgccaggcaaatgatgaccactagctgaatgtagctatggagcacttgaaacatggttgcagcaaatgagcaacaaaatgttaacttttatttaatttgaagtaattcaaagttgaaggcaaatagccatacttatacagtggctaccatatcagatagtccagctctagcacttacggtattctcgtctctttaaaccatgacagagaaccttaataataacagctttctttgtctttgtttttgagtgtcaaatgtgtgccaagctgctgctgcagacttgctctcttttgacagctcacaacatacagctggaaaagaaacaaaatccccattttacagatgcagaaagaaggcccggggagggtaagttcttgcccatggtgacaagagagcaggtgatgttctttctgatctctagctctgctctttccactgctcccaaacatcttcaggccagaccagtagtgaagggcagagattttatccccagggggtgagaagctactcatctcaggatttaatccagctcagatggccctgagctagttgatgagataacataggcctgtgggggctttataggtgagtcagggagtggccagtcttgggatggggacggggtctttggaagatgcatcagcaggggaggacaaaagctagaggtgctttgtgggcaaagtgatgcacctaatgatggatttcagcaactcagcaggagcaagagagaaagggagcggtggaatcttcaacacacccagctcattgcacagatcacagaaggtggctgtgaaagcctttctgccataaggggtgtagagctgcactctccatttgtgagccctgccatggacaaggtacagctcacatatgtgcagtgcctcagctaggttttcatttccgggttgttaaatgtttggccaagcacccaggatgtcctagaggaattcagaagagtcacagacccatgtgatgttagagctaggcaggacctcagagacccccactgtagcttgcttgttttactgatgggagccctaaaccccagaaagggaaagagacttatcctgagtcatacaagcagagccagttcttaaactacgtcactttgcaattcacactttccactcatcctcccttgtggggcaacatgtcacccctgtaccaaccttggaagacacaaaatgcatgtgagggcattgactgggaacagagacaaatgattcacagcagttgaaataatgagcacttactacatgccagccactgagatgagcacgttagattgattgcttcatttaagccccatggcatctggcattattgccccattttacagatggggaagctggtgtaaactggtttgccctgttttatacaaccagacatggtggaactgacactcttgtttttaagtcagcatgcctccaaagcttagccatctagctcctgcactcactgcctggttttgtcttgctcggatgccactacatttctttccgctattattttgtttattttcatgtcttctaaggagaagaagtctactgcttctccctcttccttcctcttctcttctttcccttcatcccactggggtacaacagcttacagtcaagagacatggttctgacattggcaacctttgtgacttgggcacattgcctcccctttctggctgctgtcagttccaaaatgtactgttggttgggttgattctaaacttctcttagagacagtacagcaaagtgagtaagaacctcatctgacgattacagagctcagtatgtgttaggctttaaatgctttatataattggactcacatgatcctcatgatcactctctcaggtagtagactccatgcccatttagcagtcagggaacttgaggcatagagaagttaaagagcatccccaaatctacccagctgggaagttgccaagcttgcatttgaattcaggcagtttgacttacacccaggctcttaaccatgacactagcatcatttgaaaactcactttttcactttctaacagagtcagtttccaagtctgcaaaaataatataatttctactctactgtattgttcaagtgatttttaaagcactgggcatgttataggtgtttgataatattattatatgccttcagctctccgtggatctgtgtagctaaagcagcaggggagttagagctcaatatgcgcttgtaaaaacagatgcacaggcacagagaggcaaactgttttgctgagagattttcagccctcttataagagatttcaccttagcatgaagaattgtacaactggagtcaaacatacccagtcagttccctgacaacacctagaaaaagtaccctctggtcttcccaggttggagcttcagtgatgccagatcttctctggtcaaaccagactcagtcagcaataattgactatgaatttctgcaccaggtggtaggcaatttctgaatgcactagcatctagtcttaaagaaggatttaaaaatccaaagaggctccagaaagtctgcatgcagagggcacagcaagggcaaagatgtggaggtgggaaagcaagaaaagtttgcaggagaaacaaagtgattcatttgtctagcaggaaggatacatacatagcaagagatggagctagaaatgtcatctggattccattgtagaagccctgaagtgccaacctaccagtatgccttgttctgaaggctaaagtgtcttagcaaaaggatgctatatatttttaaaagcaaattttgcaacacaaagtgccagatgaactgggcaggagagagataaaccaatgataacaaaaccagtgctttatgctcccacctttcattcatggtggggcctccccagtgtgaaactccatgagcagactccggctacttctaatacattctctgttacaaaccaagctctccagccagccctggcccaagtagtgctgaggtctgcagccctttaggggttggaatccaaatgcatcacaggcccaggccaaggctccaggaaattggggtcaatttcctactccccagagggcccaggagaatcatggggcctagagcctggggctctgagaaggagagtctgggctctttgaagccacatgaagctgcgtaagtttgccacgagcccctacagaacctctgggagtgaactctgcaagccgccttgcagctgcatgctcaggatgggccacccttctcccaaggccagagaggtttccattgcaattgtaccctccttttgccggcaaaggagaggcctggaaaggggcccctttctcttctgaatcttgtctatctgcagctgttttctcacataggggagcctcagcctacatcagttcttttaaggagtttattcattttctcatacattcattcataatttattccctcattcattcttttcttcatttactcacttgtgcatttatttcctcatctgtgtgttcatttattttcttatttcttaaagaaatacattctatcactctccaccaattcaccccatcttttcgtaaacaaacaattcttgaatgagcaaaaatatctattaagtgatgaatgaatgcactgagtggcctggaccttttaggcattgtggaaaaccctgaggatacaaggttgaatagggcaccagcctgggccttgaggagctcattgtctggttgcaaaacagatgataaacaaataggtaatgtcctgtcagagacattcaggtagtgccccatgcagaattgagatggcaggagagcaggatgggttgtgccagataaggtatttgcaaggtagacaagggtgggtaggaaacaatagcagacagaaggagcagtgagcatgaaagcacaacatacgatgccttcacaaatgcaggcaatttaaactgaagttcaaggttggtggtggtgctctggagagcaagaaactggagaattaggcagaattaaggctgggagggctctggagccagcacaggagtttgcatggaagctgaaggtcacaggaagccattgcataaatttttgcattggtggagcacagccagctcctctggcctcatgtcaagtttctcatcttattataagcctgaaaggggtagagaatatatagcttgttcttagatccttcacaatatgggccccctgcacagaaaccacctgtgattctccatttctgttcggtaaagtctaaactacttaagttggcatttaaggctccacgctttatctgtgttaccagctcatcttcccctgcttcatgccttgagtcatagaattagaaccacaacaggctctccagcacacacgatatttttcatcatttgcacacgcccttccatcttccaggaatatcttctgttccttttctgcctgcaattccatgcatccttgaaaacccttttccatatatcatctcctctaagaggccttccctgattgtcccctcataaccagttactcttccttgtgtactcacagcactggtgtgatatttgccctgcctcactgaacacagtcacactgacatggctggtggatcacatgactgccattcccactagatcgcagaggcaggcactggctctcttcacttctgcaccccacagagctgggcacagattggacactaacgaatcttacttgaattagctttctgaaattcggaggttggaaggggacgtcaagaagggattatgtcttcaagctgcatttgcctaatgctttgcagaagattgagaaactataattccctattttaaagaattgggaggaaagcacagatatataagtatccccatatcaccctcttcatgccattattgttggaatggaatgaaatggaatagaatggaatggaatgaaagaaagagaagatgagaaaaggaaaagaaatgtcttggaaaaaaagcttctcagctagacccagattattatttatgacagagccctgacataggatactttctcactatttaagaggaagtaaactttagtgttcctcattaacccatgctgctactctctgtgtcattcaaggagctgatgggctcctaccctctcaatttaaaaaaaaaactcccacacacaaatcaaaactataattggctctgattgaaatttctgaaagactactaagctcggacttgggagtttggcattctggaaagccttgaacaagtttcttcctggtctgagtcctcagtttccccatatgtaaaatggagacactaacaatacccctctttcagggtggttgagtttcaaccattgttaagaaattgttttggaacacttcagagctctggagagatgaaaaattcttttctgttgtattcagaatagcttattcaattggggctggtgtctctcttggtcctaactctgtttctctgttgttcagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccataggtatgatgggcccgagaggggagcagtaggaggggcaattccttccagcaatgcagggctaatgcctgggtgggtcattgaacaccctggccacatgagttcctgcgtaggcactacagaaagagagatgaattagtgtagaccatgtcctcccagaaagagggtcagggacagggatatggtgacacaatggtgggtgagtgtgcacagttacaacagaatacagaaaagctgtcaggtgcctggtggggacacagaagactcccacaggaagggatgcttacttggggatttgaaaaagcttgtcggggaagaaatgctattgcaggcagaagaaactctgtggctgaggagcaggagttatgaaagcacacatcacatttagggaagcaatagcagtctggtgcagcttcttttattattaatcttgaaatttgcatcatactaaacattcatgagtacctgatatagttcaggcccttcatcaagcacttgaaaggcattatatcttatcctcacaataacctttaacagatgagggaatcaaaacttgaggggataatggaacatgctcccaaatcctgagacccatcctattccaaagtctgacttctttccatggcatctcagctgcatccaagatgagcataaactgcattttcaaaatactctttgcatggtgacaggccagctcgagaaatacacacagtgagaagagacaagctgggattgtatgccagggatttgcctcgttgaaaccaggtgtctggacacatgcattaatcaccagcaccacagctttccggggtactcagagtgcatggagtgtgacctcatttaagggcagtgatgctgaccttttgggctgattccctaattgaccatgatgaaaagcctagggaactgaacatcctttctcctggccaatatgatttatagagcaatcaccaggggtgtctggtgtagaaggttatctgaatgtgcatagagccaacatgatcttcatccagcaaacagagagttatcactgcatgtccagaagcaaggcctgtgtggttggagagggaaggttcatggggactgtccatccttttttgaagatgaaaacacatgccctcagatagcagaagttcttcactgtaacttacagtgggaatcagcactcttgtgtttagcccaggacactggctcctgcatgggtcagaaaacaccaaaacacatgattgctctcgctgatggtttggaaggtactttaagatcttatacagccaccaattcatgagatgctgaccaggagtgttgcagagagatgggatcttataggacctgctaatataggcattctagaaggttgggcaacaagtattgccatggtgagcagcatgggctgcaccatcccaaggccaacactttctcctttccatcattcctgataggtgtgcgtggtcctgaacaagtatgtctgtgatggggtcccaacctccagctcaatcagaatatgcaagtgaatattcattcatactcttaactggcattgagtggctctgtgagaaaaagcctaattaagtgacctttagggaaaacctacagaaacaaatttgctgcatatctatacccactgacacattcaaatacattcacacgtgcatacataaacgcatgccacatgctgaaatgcttcataaacaaacagccccaaacacacacatcatatagtaagctcatgcctaacacctacacatcagccaaataccacacaaatgcatcactctcacaaacacatacacacacaggtagcacataaacctatacacagcactcacatgcaatacatacaaatctcatacttcaacaaacacaaacacattttatgtcccaaaacatatcaaacacacagaaagacgcacaaaaggcaaacaaacctcacagacgcatttacatattttattcagatgtctcaactgtacgcaaatgagtacgatacctggctgtcttctctccatcagaacagtggagaaagaggggaaggggtgggagggtggtatttctttacccactgagtgttttcatggtcaaagcagaaagggaaagaaatctatatgatattgcagcctgaattaactcctttcctgtaccccaagtccccacggctggcacccagatgtccatcttataaatgtgataatccagggcagatgatgagtgcatagggacactggaggagatcagagagaaaaagccacatagggagacaggaagactgagggtgagaatgagaaacaaggcaggagagcagtttttgctcatccactcctcagccccagctgtatcctcgctttcctccaaatgcgcctgacttccacctcccaggctgagcccttccctgaggagaatccactttgccaaggagagggatttgatcactggccttataagcaggggtgagatatgtgtcgggcttgggggctggagggcacattctggagtcacccagaccagctccccctgcgtgcctcccccaggccacctggggaggcttctgtggcagttatgagccctcagaaagttgctgctgctgccaccagggctgccaccctccccgcgcctcccgggaaggagacgcggaggcctggtgagatcaccactctgtaaggatgccaataatggctcatatatcacaacacagcagcctggtcctaaagccccagagctggggtaggggaggagagcctgggggagggagacgcggagaaagagaaattaagacatgaccgctgcataggacagcaagtgtctcctgttttgacaaccgtttttttttttttttcctctcttgggataagatagcctttgtctatttctcagaggctgcatttttttttttcaaaaggattttattatcacagccttgtctcatctttgctccctaaaaactcctttagaactggtctcatgataaagcacactccataagcagtttctctgactgcttagggatttttgctccttattctcatcactcatcatttttgtctgtgttatccccatttcttgtctctcctctggcctctcaccatctctcctgtttcgatggctgcctccttctctcctctctctgtgtggctgcactgttatcgattgtggggcctggaattagagatgtggctctctcctcaccagctttgtgccctgagctttgtgccttttggctctccaacctgtgaaacgggtgtcatgtacatatgtatatttggaagggggcctctgaaatagctaatacatacatatgtatatttggaaggggggactttaaaatagctaatagaataggatatttaaagaaaagagttgacttgctcctagtgtttggagggtggtttcgatactaagagaaatggcctctttcaggcctagtcagattctgacaggttgtttctttgcccacatgaataaatgcctctttggggtactgagtactttccatggactaggcttgatttttcagatgacctcaggatgtgtgaggtcagggtagagaatgaatgagctgaattacagtcaacttgccaacccacagcctggaagtcaactgtcttcacccaaaagttcctggaccaagggcttctatgtagtagccctatctctattagtcatttaccccttctttgactcattacctgattttttttattcctttatccatttaatccataactcactcattcacttatccatttatgtacttacttcttccttcatacgacacctaaatgcatattcatcagtcagtcatcatgccattcatttatccattaatccactcatttcctgatccattgatgtacttattcactcactgtctcttgcactcattttacaaatacttattgggtgcctataatctgccatgcacagtgccaagctctggacatagaatggggagcatgggtagtgctggccctatagagttacagtccagcagggaagagagctattgatatcacactcaccaagcaaacaggaaatgatcatgtgacaattctgtcatgggcacctaggaggggcttggcctgtcaggaaaccatgaaggtcttctctgagcaagtggcttgggattgaggtctgtaagatcattaaaaatgcacttgttggagtgggaagggtctttaaggcacagggaaaggcagggatgaaaccctggggcaagagaagctggtattgcatttatgtgctcatcattcactcggccagtgctcactgagctctacctgggtgtcacacgctgggttaaactccgagatgaatcaagcacatctgatgatggagtactctcactcagttgtggaattcagggcaaacttcttagaagaattgaactggcccttgaataatggatagaattcggttatgggaaggcagattgggggacatttcaggagatgggatgaacaagagaagaagcacagaggatgagaattgtgggactcagatggaaaaccaagtgtagttcagtccggttgaaccaaccaaagagtgaaggtggttagtgagagaggagattgaccagaccgcaggaggcactgagtgcccagcaaagggggctgtattttgttctggatgtggggagccttggaaaggtgtttgagcagaggaggagcttgatcaaactagggtcagagccaatgagtgtggcagcaggaaccagtcagatgggaggcatgtgaatggagtcagggagaacagaggtggccctgcctggcttgccttctccttcccactgccttcaggttgggtagctgagtccaccagggaccagggagtgggagggcccactctgcaggagggcagtttgcagatgttgagggtctcgggcctgagctgcgcctcatgctgtacttccctcagggtcggagtgtgccacctcgtgcctggaccacaacagcgagtccatcatcctgccaatgaacgtgaccgtgcgtgacatcccccactggctgaaccccacacgggtagaggtgagtgaccagggacatctacccacctgcagctaagggggagggaaatgatattgttgagcacttgctatgtcccggttctgagttcattctttcacacatattacctcatttaatcatcacacctgccctgtgggtgtgtgttgcagggaggtggggtagagtcgggaggagacttattcacaatcatttctctagtccttaattatttaatactttctctctgtcaggtcctatgtgaagggccttttatttactgtccactaaatgctgatgtcagcctaggaataaactgaggcaccaataacagaggtagggagcatagagccaggtttcagacctgagtctgtctggctggaaagtccatactcataaggatggtgttgtatggcttctctggtgccctcccatgtagccttccactttacatagcctaggtttctggtatccttctccaagctttacctgttttggggaaagcaattaataggtgtctagcaaactagtaacatcggttgtttgtggagaacctgccacgttcatgtgtccggtgcttagcacgaagactccattttagcctcagcacagttgtatgagagaagggtcattgtctgcattttccagttgtggacactgaaatctcggaagtgaggtgatgggccctgaaccaaggcttgaacccaaacctgagtctgagccctgtgtgcttcccacagtgccaggccggtgtgcccccagccagatgactacagaggccccctcctcagggcagtgtcagtttgacttcaaggttggctgttcccactcgcctttgtgtcacccaatcaactggggcccccagagctgatgtgggccctgcttttctcccccaggacatcgcaggtcccaggccttatgtgtcactctgggcactggctcttcaccctggagaaaccgaaagaaggaggccggggttgcggggtgggcgaggttcagctctgtgtctctccaaccagcctactgcctggggtgctgagaggccatggagcccagggagctactgtctgcctgcctgctgcagatcacactctggatagctgggcagaacctgatactgggtgtactgtttctcaaatgcgctgagggcacgattgccagggcttactcagcactccgagtgtatagacctggccagacctcctccactcctctgtgcgccccggcatgctcctccactcctttctgcttcctctttctcttttgctgtctctttttctgtcttcatcttactctcactaatttttttcctatctctgtttttccactctgtttctctctcctccctcttctgatatacctttcctcttgttctgtcttcctctctcccacactctcctttccatcatccactgtttctctctctctctctctgcctctgactctctgcatatctacaagacagccctatttcccaaacctcaagctctttcatctgtttcctccaccattcctgaaccagaattcctgcacagattcccccgagtgccccagtgcaccctgatatgctcatatacccaggcatgcagggagcccacatgtcagaatctcaaggcagctagagataatcaaggacaggttcctcattgtacagatagggaaactgaggcctatagaggaaggcggctggtccacacaggcagcacaactggaacgacaagctggacttgtgattggcagctcttccaatactaccagctctccttccttttcccacccgaactcccacatacccgaaagcaggtgagtttgactcacacacaaaacagacacaggagacctccctctcaccccagtatcagagatcttcttggcctggaccagcctcccacttaagacctttttcctaccccctgggcaaattcccacccttccctctgtgggccctgggcactaaagagttcagttatgattcactgtgaaataaatccagggatttgaaagcctgcaagctgccccccctccccaccattgcccacccgctgcctgcctgccccatcccccaacccagttccctggtctgcctgcctttattgatgctggcctaccgagagaaccataatgaggttcagacctccactggtctctggaggcctcattatccaggaggaaaaaaatgtggtagaaaaagggaggagggcgaagggcagagattgatgatttccaggaataaggcagaaaagctggcctctgctgcacccttgccccttgtgcggtgagagctacagaaatagagctgctggtgccagcatttccaggccagaggaggccctggatagctcctctgctttctgagggtctgcctgcgagcaccagtgcaatttagatagctgggggtgaggctctgctccagctgctgccacttttatccccggggtaagagagtgagaggcaagaactggcatttattgggcacttgctgtgatcaggcactgggtcaggcacttcctatcctttatttccacctccaccccctaccacacacgtacgaccacacacatatgtccctatcaggtgggtattagtctcttcctgcttccagtggaagtaatggaatctcagaggtggaagccacttgcctaagagaaggtgaagagagacccaggccagtctgatagtttacttcagctatccctgcagcctctatgaaatgtagagtaataaaggcaatacatttagtgatggcttaccagggatgtgctggcaaatagttaacaactggctctccacaaacattagactctgctttgtagcatttcccaatttctgtgatataaatattcctaccgtggcagatttcaaggtttccaggttgctgtcactgagcacaaagttgggaagatccaggcactgctggctcttgcgagcctatgcaagccagctgtggtccaccaccgacacttagccaagacagactctattttaagtcctttgcatatattgacatgaatgaagagaaagatgactgcttagatgagtggaatgtcaacactgagatcacaggtcatgatgtggacaccaggacagtgagctttgtgaaggcaggaccacggtcatattagttaccatagtacctcccttggtgcctagcacacagcaggtacttgctaaatatttatgattgctgagtcagatgacccaggttctagtgtaagctctggtgccttcctgctgtatgtcctggagcaaatcctgtcacttctctaggccacagtttacccagttgtgaagtgagagctaggcttcactcaggagtcacaaactgaaatgccacctgaaccaggcaggtggagaaatgagtgaagcaggccaaacatactcttttgtatattaaatactgaggcagccgggcgcggtggctcacgcctgtaatcccagcacattgtgaggccaaggcaggtgaatcacctgaggtcaggagttcgagaccagcctggccaacatggtgaaaccccgtctctactaaaaatacaaaaattaggcgagcatggtggcgcacacctgtaatcccagctactcgggaagctgagacaggagaatcgcttgaacccaggaggcggaggttgcagtgagctgagattgtgccactgcattccagcctaggcaacagagtgagactctgtctcgaataataataatgataattaaaaataaacactgaggcatattagtagtagtagtatttactgtaaatattttggaaagaaagacttgcagaaaaatataacacccatacacatactacccaacttaataaataaaaactttacagatactgttgaagttcttttctacttttctttttttcaattttttatttttatttttttttagtggagatgaggtctcactgtgttgcccaggctggttttgaactcctgtcctcaagtgatccttctgcctcagcctccttcttttttattgagctataacttacttctttaagtgtaaggcattataaattgttttgggtacactcatgaaaccactactcatattaggatgtggacctgtccaaatcttcagggagtcctccctccccaggccaggcaatttctccagcaccaaggtaaccactgttttgttctctattgctatggattggttttgcttatttgtaaatttatttgtagacttggtccctatcactacgaattggttttgcttatttgtaaacttcatataattagaaatcatgaggcattttcataagtgtgttttcaacttctataaagagaaacacaatgtaccttcttttttgtgtcctaaaccttctttttctcagtccccttccctgtacatgcacttttcaaagtgattagaggtacagagaactcttcctctaatctaataaacaaaatgatacaaactcaataataggtggaaatgcccctcaggttcaatgctagagagaaactgcagggaatggtggggactatggcaaactatggaaaacacagttgttgtttttctgcttccaaagggggacagcattagccaagtgcagcaatgtggaaatgtgggcctcctgtggccaaatttttcattttttcttgggtacaagaaatctggagttcttaaaatttgaaatctctttctttttttaaaaagtttggcaactaattttgactttttttaaacacttgtatgccaaacaaaacatttctgtggtttgtgtagcctagaagctgttggcttgcaacctttggatgagatagactattccagtctggagacctagaattctggggtggcagcctgtctcccatcagttcctaagaaatagatccaatttgctcacacattgtcccttgcccagggatgctgagagtgtttcacaatagaaagtgcatctccctatcctcagaaccttataatgcctttaggtgctgagaccttggcttttataatagcttctgaaaaaaaaatgggaggcggaaagagagggagggaatgacttaaggaaagaagaggtaaattgccatttattgactatctctaatatgtagacatggtttgctaggcaattctatatatgccatttcattttgtctccatcactccccagtgaggtaaggattatcacgttacagatgaagaagctgaggctcaaagaggttgtcattgcccaattcacataacgactgtggcagaattagctagctaattccactgcattccatcctgcaagggcaaccctcatacatgtcttttaaaaatatgcaacacatgcagacagagaatgcaaaattcagttgtgaaaagaaggtagttttgtggaaagccctgccgagtgtctaaaggtcagaggtcgaatggttctgagtgactgttaagtccagtctaactgacctagagatggagaactaagtgcactggaggggaagcccatagacaaagagatgcagccagaatctactgatttttttcattcatttatggacacgctcatacattcgttcatttgattgtccatttgttcatttacttattcaataaacatcgactatgcacctccaagcagatactcttcaaacactaggaatacgaagtgggaaatgcctaggcttttaaaaagcttaccctggaaagaagccagaaactcagtggctgataacaaaaagcaaataattaataataataataataataactgatatgattcactcatagcaggtcccagaaatcaaggaaaaaagctaagggaaaaagggcttatcttagaagacatccaggaggggtgtcagatctgagcctctggatgagggggctctcttagatgctttctcacatgtctttggctctgcttggggcctgtcttcttgggccttcatcttttagatgctctacccactccaacatttgtctcaaagggcctctccacctttctgaactttggtcttcccatcggtcaaaaaagtaagctattttatacttacagcttcaggggatggtatactttgaaggagattatggcgttcaaagcctagaccttaaaaccagataaatgtgggtttaattgctgactgtcactacctatgtgtacgatttggggcaggtcatttaacttctctgtgccccagttttctcttgtgtaaaccagagtcaaaaatagtacctatctcatagttacggtgagaattaaatgagatgaaagctctgagcccagggcttagagcataatatttattaaatagagaattttgtgccgatgaggatgaggatactgatggtgatgatgatattgacgttggtggaggtggtgatgttagtgatggtgttttcatgctggtgatgatggtggtggtagtggtggtgctatgatgatgatgataaaaagaagatggtgcagatgatggtggtagtgttggtggtggtgttgatgatgatgatggtggtgatgatgatggtggtgccaatggtgctgatgatgatgacagtgatgatgatggtaattgcaaccaggaagaaaagatagtctattcttcctaccaccaaggcaggaaatgaaagccttcttacaaaacctgatctgaaaaagctctggctgggctagatgtctcactggtatcaagaggaaaaaggctgacatctgaggggccccatctgagatctcccaacttctcctgtaaacagcctagccaatccttcagctcccactgcctgtcccctttcccagttctagcacacagaggggtcctgtagtgagacaggtggggcgtgcagccctgagtaatagtggaaaatccaaaagccttggaaagataaataggcttatgcagatagtataaaagtcctttttccaaactcacgtcaggtaaacctcaactgacagaaacttgtacaaccacaccaagacactcctacagatggattaaattagctctcaaataaacaggggaaggcatgggcatcgaatccctagtggattctaactctgctgttttccacttcttgaacctttaccaaatgccctccaacatctctggattttgactgggaacagactctcatactgagagaggaaaatctggttaagagaatgaaagcaggtgatcctcttcacccagccccatggctgggaggcagagggggaagaacgtagcttaattgaaagaaaggaatactgaaacaacccaaattccctcatttgtatttgtatcacattccttcatgtatttcttcactgtgctccacgcttcaccctggaaggatacagaagtgtctataactcaggatctgccctcaagaaacttaagaaattggtactaggtttaccattttcacagcatttatatgaatgcaccatctcaacaagtctatgatgttttcagtacctatcttgtggatgagagaaccaaatctcatagtggaaatgtacaaagcaattccaaatcagaattgcaaccacatctgtcccatatcatatcccatgacttttcccatataccactttatgcgtgtactggggatgggtagacaatttcaatagaagcagtaagatgcaagacagtagatttcacattgcaagactgattggaagatcatcaagttaagctctttctccaaggtctttgatttacttgaaggttgatagtggctacattcagcctatactaaactgatcctctaaactagacttgtttagaggacaagtctagtgcttgaccttagatgatcttctgatgctctagaagacaggaagacaagtaaagaaattattgtccactggtaaaatcatctctattttgagaagaatctgttcctttataaaataaatatttatttagcatcccctctgtcaggcattcctgaaggcatggcatatctaatgtgaacctgagattttatggagcagagaagaaaggcacccaatccagtcttggggtcacctgattccctctgtcacagcctcaccaagaggcctaattacaatttggctaccatataggtctgccctcagggagagaataggctgtttacatggattttccacattttggcccaggtgactcttcattttttaattaaaattaatcaactggcctctcagtcagttgaacaacctctgatcatgtggacttccatagttggttgttcacagttacctgtcactacacatctaagcatgtaccattttattttatttcattttattctttaaagaaataattgtaatctggcatgaaaactggggcatccatggagaatagaaaagggaacttccaggattttttttttttttttttgagacggagtctcgctctgtcgccaggctagagtgcagtggtatgatgtcagctcactgcaacatctgcctcccgggttcaagcgattctcctccctcagcctcccaagtagctgggactacaggcatatgccaccacacccagctaatttttgtatttttagtagagacggggtttcaccatgttggccaggatagtctcgatcttttgacctcatgatccacctgcctcggcctcccaaagtgctgagattacaggcgtgagccaccacgcctggccaagcttctagaatttttatggtaactgtattcctaatactatgttatctttctagtcttatttagctttcttatttcacccactttttaaaatatcatcatgttggattttatgttatgagctttattaaatcatttctgaaacaactggttattttcaaatcctggtttctccaccaaacagctatggagcatggggaatttactctcttatgacacaagattaatgcccacctcacatcatcatggcaagaaataaataagataatgcatacagtaattagcacaatgaatatactcaatatattttagttgtcattatcttcatcataattattatttttaaagaggaggctataaataagtgcctataagctctgcctaacggggctaggaaaagtgccaaagaagacataaattttgagcagacatttaaaagattctcaaagtgacaaaatggggaagggcattcagggaaggggaagagcaagaacgaattcactgtgggcaacctcagagaactgtgggcagaccagtatgacacggcagcaggtgacagcagaggggttctctgcctttccagggatttgaaccataggttggttcataatagcccatgtgctctcagactgtagtgtgcattggaatcatctgcaaggcttgctaaaatgcagagtctcagggcctggtctcagagagtccaattcattaaatccaaagcaggtctgaggaatctgccgttaattaaacacactcccacggcaatgctgatgaaagtggtcttcagctcatgctttgagaaatgctgctccacagttttctcccatccgcctgctgcagtcacacacatgtatgcacacatacacacacacacatgcaaacacacacatgcgcacacacacacacacccctcctccccccaccttatcccaactccacgaatgggtcgaatattagtcgagaattttctgaaaggcctttctgatcgtgtctctaccctccagttctgcttctcctcaacccttgttcctgccagggaaatacagaaccatgacacatgcggtgaacacaaatattattttaatcttgtggctcctgttattgcaagtacccgggcaagttctccatgtaaaagccagggtgaggtcaggaattggaaggtcccagaagaggtgaggtggttaaatgtaatgccaacacggaggtgggtccctcccaatcccaagcccatctgacctttctctccctcttcccacagagagttgtctgcactgctggtctcaagtggtatcctcaccctgctctgattcactgtgtcaaaggctgtgaggtgagtcacaaggaaggcactcctcagttccctggaaataatcctgctgttgttattgttattgttatattaatgttggctatcctttgccatacctactgagtgttgaaaatatccatttagcagacttcttggacagggattagcagccttattttacagatgatggaattgaggcacagagatataaagaaacatactaaaaagcatagggaatgggtaacagagttgggttccaagccaggcttttgtggctccagagcctgtggtctacaaaatatgggatctgtaagaaaggaagggcagggggctataatgatttaccatctagaatatgctaatgttggaaatttaccaacattgttacatttaacctttacagagtcaggtgaggtggttttatttttaatttccattttactgatgacctttacttgcagacctattccttctgccccacatcttagtcatttactcatgcctcaatcccagaaggaatatgaatgccttagacctaaccattgagctgaagtgaaagagcctttataacccttaaattctatgacttcacagttgagccattccttacagcttggaattatagagatctgtctctgtgtgtcagtgacaagcttgggaggactcaaggagcatggttcttgggagatcagctgtgtcctgaagggagggctgtccacggaactcaaagacatttctgcacatcactctgccccttgtggctcttcccagctggcagtgaaaaagcggccccaaatcccttccaggtggatggccaaatctctgtggttcatccagagcccactgaggcaaacgcaggtgaaaaggatcagaccatgccctagaaaaagtcgtatctgatgaaactcttagaatgccagaaccagaaagactcttttacctaatctcaactaatcttttatttttaaaatgggtaaacagagacccaggcagtggctggatctaaaatttgatggaatgccaaaactgggaaggctcttaatttgatctagctctattttcttggtgtatagagtagaaaacgagggccagagaggggatggaatgtccaagtttgcacagcatgataaccacaaagacaaaacgtaagcccagctcttctaacgtccaggctggtgcttttctcctgctgcctgcctatgatccattccctgatctgtgtcacaagacaatccctaggttacacatttttttctctgcattgttgagggatttcctgagggcacttgacattgtacttgactttaggaaccccattctctcaggcttcaattaggaatggcaaaatcaaagccaaggccctgtggctgttgcttacttctgtctttttggatcaatccagcattttgggaaaagaaagcttgagttacctgggcactcattctgctgagttggcggtctgggcaaccagtgtgacagcggaattcaatccctccttggactcagcagtgagacccaagagaccctcacctgtcagactctgagccctgccagtgatgtttatcacctttgcccttgcaggtgcccctcatctcctgtcctctttagctttgttctaatagtgccttgtctggagctgaaaattatgcttagaagacatacaaactctgggactatcaaccttgaatatccagaggtatccaagataaagaaagggtttggggacccctgagcccctgttttctgcaccatgctgggtccaaagtgatcattcactcacttgttcaccaaagcttcactgagaacctcttatatgccagatactgttccagttctgggaatacattggtgttagtccagtgaaaatagtaactatgctctccttgagtcatctatgatatcttcttgcctgtcatccatccatccatccatccatccatccatccatccatccatcgttttactaaataaacatttatggaatctatatttgataaagttttgcacaaatacgagacattttgctagcaatctaggatacagaaatggatgatgcgcacagtatagtgaaggagatagacaattaaagagagaattttaaaatcctgaagagctatcacaaaatcaaatacaagaggctatggcagcagacagcatcctgaggctattaggggtggcattttggagaggtaacatttgagctagatcttgaaggatggtttgtttgtctgaatgcgttactagtagaaggagcaacatgagataaaccagagacaggagaaatctctaagtaccagagcttttctcatattgttccctgtctctagaaattctctcttctccacccccacctaattaactcctactcatctttatgatctcagctgaagcgtcatttcttcagggacttcactgagctccctgtctagatcaaatctttctactttttaatagcatcacaaacctcttctccatagctcttatcagagttgaaattggttaattagatgtgtgattatgtgattaaagtctgtctcttcaccagagtataaggtctggaggggtaggaactatatctatattaattcactattgcatccttttccttagcataatgtgtaacacatcgtaggaattaaatacataggatggaataaggataaatgaatggatggatggatggatggacggatggatggataggtggatgaaaggatatggttgcaggaaagaacatatagggtagagtaactagtgatgggactggagaattttttcagggccaaataaagaagtatcaccttcatttaatttttctcttttcccctagctacttctttatcaagccagttccttttattctaaggaagggacaattagtctccatcattattctgttcatttattacataaaaaagaacataacccacaggcagatctcctgaggcaggaaggaaaagaaagggtttattgtttgttgtttgtttataccccactgctctaatgtggatgtgatgtgttcattctggtggtcacacagcagagtcacacctgaacccacagccatatgcatgcacacccacacaactgagctcaggtcttccttgctctcagagctctgtctagctgtgatcttttagactctagtagtagagtgatgaaatgaaatctggcatcatgagttcagggtgaaaagtttctgtgagtaagaatttggaacagagaggcaaaagccaggaatgccacatgggatggagcttggttctttctggagcagtgaggatgggaaggggagaccactggatcacagatggcatgcttggatgcaaaggtcttaaacaaatgttgtctctttcccatgaatgagtcactgatctttagagaccccaaccagcactttaatcagagtggtttcactttcatctgctttctatattgaaatgtcacacaatatggcatttgatggtgaggagaggggtaggttcactgttttgagaaatcaatggactaatctggcctctttatttcattagtgggagtcctgaggcctagaggagataaggtcacttaaccaaaaccatgaagtaaccatcccattggctgaggttgggaggactagaacccaggttttctcaatccctgccaactgcccttgccactatgccggtacaattacattccacttcagaaacattattaagagccaaagttgtgtgcagccttaaatgaggtgattgggagtcaaagacaaactagacattgcccatgtccatgaagagctcacagtcttgcaccagctacagaaacataaacagaccacagaatacaatgtgctagcggttgggatgaggaaatacaagtgactggggaatccaagagactcctggactttcccctaataaggctctgggttcagataaataatggcttgactctattatcttttcttcatcttgggagtgtcctggggtggagaaacacacagaagaaaagaaataaatcagtatatgccagaacagccaagagagatgaagtaaaaaaccatagagccaacttagatttaaatcacttactctgactgtgccaatgtgattttgggcaagtccctgtctttgagtctccgcatcttcatctgtagagtgagaaaaccaatacctacctcacttattgtttggagagcaaaagaagaaaacaaacatgtaaaatgtgtgacatcaagtacatctgccctccttgtgagagggagcccactatcacacacagaccatggtgccaaattcctatgagttcttacattttatcttaatgcttcttgggcagtttacattcagcttcctaacatatttgcatatattttattacaaattacgtttttaattacatactgctgaaaaaagtgggagaaggaggcttacatttcctggtcatttctttgagtaaaatgagccctctttcaggaagatgtaagccatctattttgtggttttgcatacccaagcacacaagagtatgtctctcagcataaccatactctagttggaaaaaactgggtaagagtctttatgaatggtagaaagaaagataagagtctttatgaatggtagaggtgataactcattcaagggggtgttggggatgtgaagcctggccagctaatcgtggaaggctgtgaaaagatgacagacacccgaaggactgcagacgtcagctcccactcactccaggatgctaacaaggcctcatttcctccttctgtctccctttccagcccttcatgggagacaattattgtgatgccatcaacaaccgagccttttgcaactatgacggtggggattgctgcacctccacagtgaagaccaaaaaggtaggccagtgtgcactcctcggcagctgcctcctgcccacttctccagcttgtggggccaggatcactccttcatggctggacaacccttgtcctaactctgccagcactgtccacacgctttatttctttttttaatttttattcttttggtcagtagttgaactaatatcataggctgggccctggttgatttttgcagatgtggttctcaaagcttagaattgggtacggaagcaggtaataaaactgcaataagtactttcggaaaggaaggacaaagtgcttggggggctaggcaaggggtcagagaaggcactctagagcaagaggcatctgcactgaaacttgagggataagaggaaggggtgaggaggtggtcaaaagaacggtgtctggagcaggagactggcatgtaaaatcccagtgagaacacacatttttagggggtagggctgaagtctaggaaacagaaaatagtacatccctaatgaggtcatttacagtctttgagcattttattatctatcttatttgtcacacctgtagaattagagaaagatggtcatggtcatggtattttttctttatatcaggacacacccaggagtgattcaagtgtttatagtaaaccaaagaaaaacattcgatagatgcacattaacccctcacagaaaagtggccacctccatttttctccgactgccgctgagaccagagtgaggagccccagccaagggttgggagggaggtggtaaccctgctagcctgggctgagaagcgttcttgtgatgaatgagttaatggaaaactatttctatttttatattcatctgcagtcagagctgaaagatcatttcatctgtgtcattttaaagaagggggaactgagtttctgagacaggaaaagcaaagaatcatagtcaatcatgcctaaagagccctctatgactatcttggcccaaacgcttcattttattaataggggcactgaggcccataaaagaggaatgatttgtcccaggtgacaaagtgaatgatagaaagagtgaggttcctggattccaatcccagtccctttattttgcaacatccttaggagagttggtttcttcaagaaagaatctctgacccaaaatacaggaacaaatgggacaagacccaaggaacacattctaatcagatggctgttagttactgaatcttttggttgaggaataaaatttctgggattgtccaggatcagtcagtcccaggtgggcaacagttttcagcatgcctacccttctttggtttcggtttggttttgatttttgattgataggacactgaagacgtacaatttttgcttaagtagagaaaaataaaattcattttctgttaaggaattttatcatttttttctaattatgaaataatgcatattggaaaattcagaaagaagaaaacaaaagaattcacttattatcttaaaaaccaaagaaaaccactgctttttattttggtgtattttattctgtgaattttgttaagtaagtgtgagggtatttttgtcgtctgtgtatatatcactgcctttctagcttgcaatcttgttttgcttagttttgtttacttagcacaggaaatcttagacacaagaattacttgcgctgagcacagtggctcacggttgtaactccagcactttgggaggccaagatgggtgaatcacttgggaccaggagttggagaccagccagagcaacacaggcagacccttgtctctacacgtaattaataataataataataataataataataataaagtagccaggtatggaggcacaggtctgtagtcccagctacttgggaagctgaagcagaaggaccacttgagctcagagaggtcaaggctgcaatgagccatgatcataccactgtactccagcctaggcgatagggtgagaccctgtctcaaaatttaaaaaagttctgatagtagtataaacttctcagctgtattttttgctgcattgttgtttattatatggctgtgatgtatgctaatttatgtaaccatttacttcaacttttatttttaacttttggattatttcttttttcttataattttaactaaaatgatgctcatgagcgtctttgcacataaaatacttttatagctctaattatttctttatagttgattcttacaattggaatgccaagggagggatgtaagcatatttaaggctcctgatacctgtttccaaatgaatatagtgaacaatattatctattttcttccattggagtcagccacctttgaacgtgaatggacgatgaagtttgtatttgaaatagaagtttttacagaattatggctccatctgacaccaacggttggagaaagagcagctctgtttaaaataatgttcctatctattgtaacttaggtactaaaatataaaatatgaagctgattttttgacagagaactttccaaaatggattcctctctctacagagtgcattgtgggaatatgaagtcatgagaccagcctcgccaagatggtgaaaccccgtctctactaaaaatacaaaaattagccgggtgtggtggtgggcacctgtaatcccagctgcttgggaggctgaggcaggagaatcacttgaacctgggaggcagaggttgcggtgagccgatatcgtgccactgtactccagcctgggtgacaaaacgagactccatctcaaaataaataaataaataaataaataaataaataaataaataaataaataataatttggaatccacacctgaacctcaatctcatgacttcatagtcccacaatgcactctgtagagagagaatccatttggaaagttctctgacctcatgatccacccacctcagcctcccaaagtgctgggattacaggcatgagccaccgcacctgaccagattccaaattattatagtaactttaccgtatacatatatttgaacaccaagccaccattttggctctctgttcccatactcagttccagtgcagcaatttcagactcccaggccccaagataagcacagactcttcactaaggaaccccagaaccagttctttgctagctctgaatgcatttcatactgttgtttcctccttgtctacccacattataaatgtagttaggctttttgtgttaagaaatcctcttcttccactttaaattcttgtttcttcttgttggctgagggtgcagaatgcagatggccaagctgccttcatccaatgcggtgaatctccattgaggatctctgtgtgctcagcaccagaccaggctgtggacagtatttctgcccttgtgaaacgtgtagtctattagaggagcctgttattaagcagggagccacacaactattgcatttaattacttttgtggaagaggcaatgatgagaaagtgtgagattttatggagaacagcatgaaggtccgagaaagcttctctgaggaagggacatttacatggagatctgaagagggaacagagtcttcctggtggaggtgaataatggttgggggtagaaggggaaaggtctcttaaaactgtacatgaagtatggattagagagactaagggcctcctttatggcagataggactttgccatcattatttcagttgtggacaggtgtttggggcttttcagatgcaagattcctagaagtcttacttctggaaaagtgtctcagattaaagtcacacttcctacaatttagatttcccagtttgacttttaagggaactccaacttcttgaaacttttctcctctttcttggacacccccaactactccctgcagtagactggcttaaaggtggtgctagatggagaaaataaataagaacacaagacttccctaagtgaactattgcatatttcagacactctgcgagacacttggcctctgttatcctctttaatcctcttgtcaacacagagaggtcactattcttattcccatcacacagatgaaccagtctgggcttagagtacatatgggacttgcccaagttcacttggcaaatgagtggggaagcccaagtttgaacccagttctatctgactcaaaagttctgctttttctcctgcatggtgctgagtttcagaagaagaaagcatgcagggtgcctgtgtccttggcacaccttggcatgaccctccctgttctggttggaaacatttcaccatgagcccagactgccagggaactttggcaaagaggagagcagcttttcccagtagcagcaaagatggggtcgggggaagataagtctcccagccttcccatcatccctgacatccctggcagcccagagaggagtttcccgtgggcatccacagaacagaagaaagttctggtttttgtttccatcttccaccgcaggaagcctctcagagaaggagagaggttactttcctttcatgcctctgcccttacctgctggacctgtttaggtcccacttgtcccctcagccccagtcccatatcaagagacaatcccttcccttacacacccaggctagcgctcagagaaactcacccctgggtgagtttcaagcaccttcctaaatcacaggaattcagttaactgagcacttaatatgtgcttcgctgtggcctggatctctgtgcatgtcatctcacttaaactccagaataattcagccaagtagagcactgaggttgagggaaatggaataatttgtacaaggtgatagagctatgtttgggatttaggatttcctaactgaacaaatggtaatagctaagagttattgctttgctttacatgtcgtttcatttcatcagcacaataaccctgttgtagatgttgttcttttttctttttcttttgagatgaagcctcactctgtcacctactctggagtggctcacttcagcctcaacctcctaataagctcaaatgatctttccacctcagccttccaaatagctgggactacagacacacaccatcacaccatgctaattttcatattttttgtagagaaagcagtctccctgtattgcccagactggtcttgaactcctgggctccagtgatcctccagcctcagcttcccaaagtgctgggatcacagatgtgagccgccatggacggccctaggcgttatctttttaatcctcattttatagatgatgaaactggggcttagaagggttaaattcacacagttagcaagtggtaaagctaagatgcaaaccaagagaattcaagctgcacagcacctgcctctaaccccttggaacatccttttgcagcaggcttgtgtcttgcccaagcgtcttgtcctgccccttgtgggtgatattcttgcttcatagacctccaggaatggagttcttggtatgaactccaggcccagagttaagcactcagcatcttctcccagacttccttcttgccagttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtctgacaggggtgtccaatttcccacccagacacctgcctgcagtgtgaggcagacaggaaggggcaggactcagcctctcaggatgtcagtttattattttcctgttggagccttgaggagcctcaaatacaaagcagatttccagaatggttgctccagtggtttcccttcatgacaaaaaaaattcaatttataattggaatcattctaagtaagcacgtgttagggtgtgagggagaaaagggaaacaaccttaacatattcaacataccaaagctttctaaggtgtggtggcctggaacactagttgtggtcatgtttcagatggctgctaagagagtgattcttatagatgtctggggagttggggtatagtcctggttctgtgacttattaactctgtgaccttgggtaggccagactcactttgggtttttatgttttgatatttgaattagattcctgtctaataactcaacataacaaggctttctaaaaatgtgcctaaggactcttcacatggcttcctggatgagttggtcattgagcaggaagttgaaggctagttaagactgagacctacagagaataagaagaggttaatcccagaaacacatctcagcacaggatggtgcacccaattcatgcaactatgtgtagggctggctgcaatatttgctaaatgacagatttactaaatcttaaaccctacctaaatgagaacatggtttcttaagaaaagacattatacccaacatgtagcacattggtcattggtctaagaaggctagtgattctataagatatggaaaaataatcaacatcattacatggagagcaaccttcttagcagagtgggtgataacctacattgacaaagggctggatgttgggtagctgacttggggatgtacatcagtgtctcttcttgacctagcagccagaataatcctttttttttttttttttttggaaacagagtctcactcttgtcacccaggctggagtgcagtggcataatcttggctcactgcaacctccgcctcccaggttcaagcaattctcctgcctcagcctccagagtagctgggattacaggcacacaccaccacacctggctaatttttgtatttttagtagagacggggtttcaccatattgctcaggctggtcttgaactcctgacctcgcagaatagtccttttaaatccagtcagatcatatcacacctcaatgcaaagacatacagttccttcccattttacttggaatgaaaaaccaaagttttcccaatgcctacaaagctcttgggaaaatgtgggtgctttgcccacccacattgcttctctgactttgccccctttccactgtctatgccttttcttattcacctctggcattctggaccccttgctatccttagttcagctcaggcatccttctactttacagcctttgtcactgtgtcactggcaatttctttggctaagaaccctcttctattcatcctcatgactcactccttcacctctttcaagtctttgcccaagtgccatgttctcaatgactccaaccctgaccacccaacccacatcacccctggcactcccacactcatttgctttgccttctgtttttttttttctttctttcttccctaatacttatcaccctggcacacactataaaatatatttattatttatgatcagatgacccctactcctcttgatgctagaatgcagaattaatgaggataagaatgtgcttcttgtttgtttattgatatattcaaatttccagtgtacctcattgtttcctgtccaatagtaggtactcaacacccacaaataaatactttttgcatgagtgaatttagggtattacctgctgtgtgacagatactgtactaggccatgagcaagaacttggtcccagctgaatgaattcatgtcttatggatgagtagccagacatttagagtatagcaagtactcatggagacacagcaagtcaggaggtcagcgaagtttcccagagaaggcaacaccaaaggcaataaatgaaaggtccagaaggtatttcccagatgaaaggagtaaggaaggaccagagataggggtgggagggaaaagggtatctttggcgagaggaacagtctgtgcaaaggcccagacaccagggaaagtgttaaggaaattataattccctgagtatgcccagagcatggtgcaaggggaaaagggataaaagataagcctagatggataagcaaggcttttatcacccaagccagggagattgaactttatccagaggccagtggggggtattcaggaggatttgaagcactgagccagtgtagggaatcccagaaggccttttggaagagagagtagatatgcttaacttggaggattagtaagagacaacaagcagatggctaagcacactagactaactcttccatgttcaaaaattactggcttctggaatgttattaaaccctctgcctccccctgccccccgctttggaatgtagccctgactttttccttatggatgaagtaggcactcattttagcttggtcctatgatggaatccagcccttctatcccaaaaacttatcagcatcattatcaatgttattaccaccaccatcatcatcattacctcactgtcaaaaccatcaccaccatcaccactagcatcatcatttattgagcccatattttatgccatgcattattctaatgctttacttgcatttcatactttacccaacatacttctgtgtggtaggactgttagtacctcctttttacagatagagaaactgaagcccagaaaagggaagtaacttgccggatagcatacacgaaagtcagcaacagggcaaagactcaaacgtgtctttttctcctctaggccagtgctttcctctaatttacccatattttttccactttatcctccatttatccacatgaccactttatcttcatttaaacaagcttcgtatacattaactgttccacgttttatgccaggtactgtatccatcctacctttaagaaacttacaggggaatcctcgtccttggcatcatgcctttatctacttggtactcatgaaatctttccatcagcactgtcaagaccctaagactcaaccaggtgaagtgacctgccagtgatgtggccccccacagccagcaggagacacagtcaaagctctctgaccatcagcacaacatgactgttgtccctctccaaccggcacccccaccatgctctgctagttacctccctgtggagtctgagtcagaatccagcccctgcatgtctctcagctctggacaggatctgcagccagggccttgtggtatagttgcctgagctgcattcctgagccactcacactcacagatggaggtgttagcctcagcagctcacccagagggagaacccatgtgccggagcaccatctctagccccgagtaaaaacaggagagaatcctggcccttaatcatggacctggcttgctaacacaatcccagagtgggtggccaagccatttatgggacagcctagccacatggtgctgagaatccccaaatgtaaactggccaccatggtgttcatgctgtgggtggtaggttttcttgggaggccgcctgggggagaaggtggggagctgcttggggagtcagggaatctggcagttgggctcagagctctgattttatcaagatgtgattcttctctccatgcctcagtttcttcgtctgtgaagagaggaccctgactcctgctctgccgtcctcctggggcatggtgctgaggagtgccaggccacctgacagcccactgattcatctctttgcatcttagtttcttttaagatgtaaaatggggatagtaagaatagttacctcttagcattgctgggcagagtgagtaagataatgatgcacattgagtttagctcagtgccaggcacataataaggataaaggttattggtgattaaaaagacaaagcagcagtcagccttttcaggttgtgaagaaaataccttttttttcccccttctttttactctcacttgctgaaaagctctcaagtgtttgaagtggggtttggaatcctgcatcaccaactcactgactggtactgaggcctgagacaggttagttttgctttaaacattctgaagcctctattttctcatctgcaagatggggagctaataatgatagtctcccaaggtggtgcagagtcagagagctagcatatagaaatcatctggcatgtggaaggccctttggaatcactagtgtgtgtacaatggtattcaccgcttgagcctgcatgaacaggtgtccccaagtcctttccaggttagacctagcaatacctgaaaatctccacccttttcttctcagctttatatctgtgataagtgaggaagcttgtaacagaggaggctctgaacaggcagttcacaaagaggcaagaggagggaagaaaacaccatgtgtctcctctacattgggcactctgagagctggactggacctgacatgacttcactgactcctcactagagcccttcgaggtcttgataaagacccttgtcttacagatggggaggctgaagtccacaagatgccagggacttgctgaaagtcatacagtttctgtataaagtctacaacatattacttacaagcatgtagtggagacaaggaggctctggataggcctcctgagaccaaccctcctaggctttgtcatattctgattgagtttcctccagtgtttatttcggaagtgctgaaactgcccagactggcctggggaaggaagaaaaaggtgacaccaccccagcatagccagagtgccaagaccggcctgagaagctaactggtggcaaggccttaccagccaacaattttggagaagctgattgaactggggaggacaggaaggggagcattcaagacagggtctgtgaagaaattctatgtttcaagttcctttctggccaggtctttgccttctacctttctcagactgagaaggattttcagccagatgagaagttagaagctatgaaaatcaactcttattataggcagggaaacaagctcagagaagggaagtaacttgtccaaagtcacccagcaactgactgtaaaagtggaggctccctgacttgtattctgcctgcatattcatgcattcatttgttcattcattcatgggtcattgaatgcataaagactgagttcaataacagtcatggtccctgcccagagtgagctgacatcgaagtaaagaagtaattcagtatcagaagggtgcaaaaataagatgctgtgatatggtatgaaggtgatggtgctattaggttggtgcaaaagtaattgccgtttttaccattactttcaatggcaaaaaccacaattatttttgcaccaacctaatatctttggtcagactactgagggaggtagtgatacttgcgaaaagacctggacaatgaaaaagagctggccagggaagagcagtcagagtggagggccattagtggctaaggacacaaaagtaggaaaacagagtatctggggaaccaataaataaagaagccactgagagtgaggaggagaaggaaaccatgtaagatctgagacttatgtagaaatcagatcatgcaaggccttgaacttgtggtaaggactttggattttattctaagacatataattttttgaatgtttgccttgagtgaggtgcagcagaaagcacaaaagataaagcagacagacatgaaaccatccctcatgggtgtttgagctcaatgggaaagtgttacagacagaatattagagaagacattagaggtaactggatcgtgctaatgatagaatgagagcaagggtaggagacggggatggataaagcatgggggagttaaggacaaggagattgttcaagtgtggaaggtgggcggtgggggacaataggcaggaaagatcgtgaaatacgagtgagggagaaatctgattcagcatatatgtatttggcactgagcatctcaagggtgttaggccatgtgctgaggcttttgcatgtttcttcttgcttgatcctcagaaaaaatgcaacatgaaatatggtattttaaaaatcctcctttcatagatgtagaacctaagatcatgacagtggagggattttcccaaaatcattcaacgagtatgaagcaaacaaggatcccaacccaaaccttttggctttcatgatagtactttccacactctaccccagtggttggattttgacttggctttgccctcagtttccctgtttggactggggggttttctctctatgccacttccagttctaatattctgtgcttctcttcaaggtaaaatgaataggggcaaatattctagattctagatggaatatcctagatgtattccacaaagtcacagaggatggaaagtaaatgtcctaaacagagaacagcaagtagctgtgagcaagaagagaggtgctgcttggaaaaggggacggtggaaatgcttaccacagcatcaagcacttatgaatttaaattgaaaagagaaacaaagacttgtggtagccataagtacaaagagtcagagagagatggatcaatgaatacaaatttattcattctgtggcttagggcctgtgaaaacaggaataaacaagattgacctggtccctgccttatgggccacagaattggtgggaggatagaccaaaaaaataaaggagagggagcgggagagagaaagagacagaataattgagcacttagcatatgtcaagcactgtgtgaggtgttttcatgagttatttcatgtattccttatcacaacctcaggaggtctacacttttatttttcccattaaatgaatgagttcattgagactcagagaaattgtcacatgttcaaggtcacatctcaagtagatgagagagctggggcatatacttaaatctttctgatgttccattctacattttaaattattgcaaactttcaggatggagagaggttgggagggagggaaagaggtcaaagaggcagagaaaaaagaagaggtagacattgagaatgagtccacaagtacatgagagagaaggatagaaacaaagattctctctgagactacgtgaccacttggagaccctgcccaggcaggaggcaaatgaggtcattaaatccatctgcgcagatgggaggctctctggggaaagttatatgcaaatgtcatgatgcaatgaggtgaaatctacttgcgttagttcaggtggggactcaagcaggaactgcactgtgctctttggaaagatagattatctcctggatggggaagacactcactctgttgggctcttcctatcagtttgcagaaaggaaagctggccaaggtcacagagcacatgaaggaacgaactggcaactgtattgaactcagttctctcacttgttcgtatgctaaaatctgcttcccaggtccttcaaatttggtgcaaaaccaccatgcgatctattccctactcaggattccaagcctcccagaaggtggtctagcttccctgagacatgctttttgttttcatcattgcctactaaagtcaaagtgaccagtatgtgcagagacttatgttttctcaaaagacacttccacatcctttctttcacttgatcacttatacatcagatattccattacacagttctattaatcaactttgctacagtgcacgacaattttccacccatgattttactcagctcctatagtttaaaatacaaagtgggtcttattatatcagctctacatagggacctgaggctctgagataagtaagtagcttgttttactttaaataccagacttgacacttattattacttttggcaaattcttattcctttctgagcttcagtttccccatcaataaaagggtgattgttgcagcatctgtcttatagagttgtcaaaagtgttttcttgtttggaaatcactgagtacattgccttaccccatagcaaatgcctgacccatagcaagtgcctctgcaaatgaaaactgctgtgattatgatcatggtgtgctcgataaaagttatcaccaggatagcaagaagcagagccataacttgaacttgaaccttctgctcctcaaatccagtgattgtatccctgcgctgcactgcctttctgatcattactgcttcagaccaaatcacctgattcacttcttctttctgcaggtcaccccattccctatgtcctgtgatctacaaggtgactgtgcttgtcgggacccccaggcccaagaacacagccggaaagacctccggggatacagccatggctaaggaaggacaagaagttgtcaaagaattcccaacgccaggacccacatccctttggtattgatttcacagtcagctgctcaacggaatggcctctccacaccagggatccttagcacccaaccggtctgcctttaattttacccaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagatgctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggctttgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagcccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctatcatagcacttaaaaaaaaaaaaaaaaagagaccaaaaataactttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacaagctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaagaataaaaaacctatttttatgtttcctaaaggaaattgtttattctacagcctcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattatgtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttattattgttataattattatgggtatttctaattaatatgatgttgaaacctgtttggcaccttctggaagctaccaaaaaaatgacactccattgaagtgcttaaaagctgttctcataagaattcttctggcctattgtaaaaaagaaaaaaaaaaagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttcagtgtgttgttgtgtggtttttgtgtgttgcggaatgataaagggctgtcatatatacacgctaacatggagagagccctggggcctggaattagacaatcaatgatagaacaagattttatccaatatatatcgattcctctacaaaattaattcctgaaagtatctaattttgcatatgcaaaaactgaaaaactttcttacatgttataagaaagttctggggagctaaagcatatgtcactcttggttatatattgccttttgcacacagcctttaataatatacttccagatgtaaacactggtatggtccaaagacacaaaccagtgcagtggttcccaagtgctaagctgtggatcagagctagttcataactaagttttcatttgtctaaggcaaaatgtggggtcaattgttcattcttgtggagttctatcttttaagatgaactctttcttactcttccggtattaaaatgtcatattttatatacatatatacacacaatatatgcatatgcaggctcatatatacatatatatatatatatatgtatctccacacacacacacacacacacacacacacatatatataattttacatatgtgaaaatgagcctgcagctggaactgaaatgttgctgctttcaatctgtctagtgtatctcactgttcatcttatcactaggtagtagctatgagatttttagaaaattatttaatggctttaagatttagttttcccatatgtgatatggaaataataaaagtatttcataaggtttttgctagaattaaatgagataaatatgcaaagtgtttagaacagtgctgaacatattatattatctcattatgagtagtatgagaccagaattacttatgacaagtaataatacactaatttttctgatatctacttattttataagataatagaaacaaaatgcatgaatcattcaagagcttgcacaggcattttatgtagtaaatttattagcactgtccactgagctgctagctggcagtaccaccataaggcaggtcaaaatatgtgtttatctgctgataactacattttgaatttttcacaaaaaggctgtgtgggaacatcaatgtgaattatgtgtaagggcagggatagggaagtcaagaactactcatagtggggtggcttttttttggactctaaaaatataactcatggagaaacattagggagactactaaaaaagaaaaaaaaagtcattgctaaattcttccagataactggttattttcaaagtaaaataattgacaaaagaaaaatattttacacagttctattcaatgtgaagattgaaacaacatttagacaataggctcctgaaaagaggcaaatatttctcaaacagaaagattaaaagatgagagttttaatgtggctttttatattccttggtttcgtctgaagagacaaaaagtcatggggcaaagagcttcctacttcaagatgaaagatctttatcccagtatcttcttccatctttctccagccctaaacacacacacacatggacacacacgcacgcacatacacgtacacagacacacacacagagtaatggagagctcactggactttattaatctgtcaaatgggaaattatttctttctcacttcaaagtaggcagaaatattcagtattttgattcatttatatttataatgcaagttttggagtttgtctatccaaaaaaaaataatgtttcagtttaaaaaatttggagggggcactctattatgctgcactggcattagtaaatctattcagttcttaacctttaacaccagaaataaaaagtttggacaaaagcacagactctctaaccttcaatccataagaacccttgcttctttgagtaaatgctttaaattctaaaggaatgatgtttaaggtgagaaacagcggtgctgtacagaagcatgagttagcaatgggggaaaccaagttcaagtactgtccaccctgtgacttgggcaaggcactgaccttttcagagacagaaggaattggcaatgagaaaaagcaggtggtgtgtttaagcaaatggaaccagcaggtgcgtccttctaagtaagaaaaagtgtgacactttcaaagaactgaaaaaaaagccaatgcgtttagacagtagaaagggtatcagtggcccaaccagaggatggagaagtcactaagagccatacaaaggatttggggctctatcttaacagcaatgcagagctgctgaacaatatttagagatttacatggtcagatttgtggttgagaaaggtccctcgggtggcagtgtgaaggagttgactgattaattttagatgtgttttttttccttcttttaattaatagactgggtatttaattaaaaacctatttcttaaataagtttttagttcatagaaaaattgagcagggagtaaaattcacattagatttcagttttaaacaataaaatattggaacaggaaaatctagctattttctaggaccagctatcaggaaaatatagaaacctaagaccatgtgatcaggtttgtaggcttgcgaattcaaacaatgtccttgatgacccctcagtgatgttgtcataaggtctcaaaatgagataggaaggctttgggaaaggggtcagaatggaattaggtgagatctgggatcatagcctcttacatgctgtgttaccatgcagtgctggtaatgttctgtttcttgatttgggtgctgtttacacaattctgttcagcttatgaaaattcatcaagcacttaaaagttcacatgcttttctgtatgtatattatatctcgatatgaagaagttttaagagagtcatccgcaaaatttctccgtagaaagaagacattttttcagagcaattgggggaaggagaataagacaccatttaagttcagccacaaaagttgcccccctataacaccttttgtactataaaactggtatacaggggaaatgtcaaaggggaaatgttagcaaagattccttaaaatacaacagttttataatacaaaaggtagagcagggaagcaatgtgtgttggcattgtggaagtatgagtaggtaggagtcctagtttccagttctgctattctgctttatagccctgtgatcattgacaagtcacttaacctttaagcctcatgactcctcatttgagcaatagggataatgattaccaagatgaagatgagatgagctgtctgagcctgctgctaactgaacaccatgacggaacactaagagatgctatggagaagccagtgaagaagcagccaaaacaatggaatttatcccctgaggaaccccatcctaccccaaacagagctagactagtttttaatttgctttacccaaagatattccatgtactgacaatgaacccctgccaccatatatcttttttttttttttttttttgagacggagactcgctctgttgcccagactgtgccgtggcacaatcttggctcactacaacctctgcctcccaggttcaagcaattatcctgcctcagcctcctgagtagctgggattacaggtacctcccaccatggctggctaatttttgtatttttaatagagacaaggttttgccatgttggccaggctggtctcaaactcctgaccttcagcagttcacttgcctcggcccctcaaagtgctgggattacaggcgtgagccaccgtgcccagcccctatatccaattttgatatctactttctcctacgctgggttttatatccttgaggggctgcctcagatgtaattgaatcagtcaaacattctcagaaatttgggccacagaatccattcttcaagtgcaaaatttatttgaaatgccaagtcaaaagagcttctctaatcaaaggggatggggtagcccaattcctatagctccattctattttcttcagagctttggggttccaaagagcatgatgtaaaagcaattggtctaatctactctgttttacagacggggaaattaacagaggtttcattcagaatttgaacttgccacttgcccagagcccctgagtagaaaacacagtgacatcactaactaacttgcccctgctgctacctggtacctgggctctccccacaggggtcttgatgaaatgcagagatctgtggagtcttagaaatctgggcttcatgcctagggacaaaatgagggggatttgaaggcagtgaaggaccacagtttttgagatgctctgttttctttctgcttgacatgtagcccagccacagactaccctgggagtgggaagtttgttatctccatatttttctgaggctggaacatgtatattccagcctggactacatgcttagctgaatgtttttatttccctctttaatctttggcactccaaacagaatttttcccagaggctgcggagatggtgaccaagtttcttagacaacgtctgggtgtcagcttgttaaaatcatattagaaatagttctttccatatgtataccactttataccacagaaaaacacatttgttaacttatgaaagtattcatttactcaaatatttttgaacaattgtttattgagcattattatgcacaattcattggactaaacactgataagagtggtggccaagatagacatccacagccattttccttacagagtatccaaatattccaaatacaaagacaagcaactagctcattggagtgcaatgtgtgaggtgttgcaaatggggaaacccattgcagaataaaatggccaatattgcacgcagagaaaacagcatgtgcaaagaccaaacgggtgaattagggcatggcttgtttggggaatagtaagtgttcaggccaccaggatctcaatttggaagaaggggaacaagaaaccacactggggaagaaagatgccaggtgatgtcagagagttagaaagagaccagctgccaagagctttgtaaatgcatgtcttggtttgggttcctttggaagccaacagtattagttcattttcatgctactaataaaggcatacccaagactgagtaatttataaaggaaagaggtttaatggactcacaggtcctcatggctggggaggtctcacaatcatggtggaaagtgaaggaagagcaacggcatatcttagatggtggcaggcatgagagcttgtgcaggggaattcccatttataaaaccatcagatctcatgagacttattcactaccacaagaacagtatgggggaaactgcccccatgattcggttacctccacctggcccagcccttgaaacatggggattattacaattcaaggtgagatttaaaccctatcaccaactctgaggcaaaggttcaagtacaggtagattatctggatgatgattccaatgagtaccagaagagaagagggcaaagatggtaaggtcatgaaaagaggtagtattatcaaacacattactactgtgatcagctgcagcttaatcaccctggggacgaattctgtgagccaggagaagacacactcctcagaattatcccacctgagatgttaggaagctggggtatttaatccaatcatgcccatcagtggttgagggatttccctggggcattaatcctccagcacatctgtcttacctgctggtgggcagagtgggctcaggccaccagagaaagctctcaggcaaagaaaaatgaacagtgactatggaaagtcataccagaagatattacagtggcaacaaatatgggcagagcttcagtgggatctgttgcagcactaaagtggttggacactattgcaagggagattagcaaacagggaagagtctaagaaaagagttttaggaataattttcaattttgaggtagatcccttcatgtgaaataaagattgcaagggagagccaggattcactaggaccaaatgggaagcaggagtagtggtggaggtgagaaatgatctggtagtgctgaggcaatgagaaaaggaagttgggatcaatagagttatacgaagtagtaggatagcataagtatacggtttatataaaggactgagaaaaaaaaagagacgatatgatttaggtaaaatgcacatacatccctgggtgcttaggggccaaaaaagtagccataaaatatataaaggccatgaggagtcatatcgataccaattcatttttcacagaataggagaattgagtgcaggagatataggccatgacagacctgggtggttggatgagtccttctcacagtttaaatccacagaagactgtccagagagttccctggattaacctccaaataaagttaagaactgtttgtccatagctcatgacacctttgagttctgttgaagctgaagtcaacagaacctctcagagctatggacttctcatcacagtggtcaacccttcttctagaccagcagttctcaaatgttagcatgcatcaaagtcctctagaaggcttgttaaaacacagatttctgggtcccactccagagtttctgatttaatagttctggtgtagggcccaataatttgcttttctaaaaactttccatatgatgtgattgccgctgatcaagagggccatgctttgagaaccacagatgccagtcccttcaacaatccacatactcacatacctactatcctaggcgatagggattcccaaatgaataataataataaaaaaattcgcatggctccttccctcagagaattctctgtctgttggtgcagatatgagtaaatacatctttaaattccaatgtcaaagaccctcaggcttgagggtaagaatgtgttgctgatgtggagttttgaacatgagtaggagccactcagatcaagaagggagagatgggtgctccaggcagagggcgcagcctggacaaaagtctgtgggtgggaggatgcacaggaatgcacttagagaactgcaagccgttaggtgtggtcagaacattgtctaaatgtggataatcacaggagatggggctggagaagagcccaggagacttagaggaggtagcacttgagctgagtcttgaagaacaaatgggattttagaaaaataaaagaagggtagtctggctgagaagactgcaggcacacttgatttcaggattccatattgtctcctcattatctctatattcctcctccaaatgtatgagagagcataaaagtggtgtccttttacaagagtttgtctaagagctggggtggtgctctatggttctttccagaggcctgtttgagccttgcatggaaaggagtagctcattctcctgcatacccttgcatcatatcgaacacattcctttccaggataaaaaacatgtcaaggtaacacagatcacatgtaaaaagggaggtgaccagacatccccttttcttcagtacttacagcagtgacatagtgcgtctattcatccattaatctgtacagacacagacacacacacgcacgcacacacacacacgcatgcataccataccagcacagaccaaggaagtgaaatttgcaaggaccaatttcaatttcaaaacctctttccaatgaaccaaagacagaacttagttttcagacattttatgcgccatccaagacctaaacccaaaccttgatatttctcttccactagcagaatggttttccctcaggttgttacaaatatttctctgtgttgatatttaaaaatattttccacaaagctccctgccaaatgctttcatctcaaacacttgcggttctcctggaactcatgttaacacatacaaggcatcagctgttggaactccattcacctgtaaatttgtcttcagagcctgaaatttgtacgttcacttcttcaaaaattctgttgcccaaagttttagcctacttaaacccttcacagtagattctaccggccttgttaggcttatcttttactaccatccccatccactccctacccactcctcattttttgcagccaaaccaaacttcctttagttaccttagcttgcaatgttctcttagttctaagttctggaacatctgcctttatctatacatacacgcacacctcactcctctttgttcttcattttggagtttagataagctcattaatgatcattattatagcttacattaattgcagactcactaaatgcctggcatggaattaagtacttcacacataatcatttatttaatatatgtaaaaacccattgagatcggtataaatatcaatattctcattttaaaaatgaggaaattggggcaagaaattttaaataaatttctcaatgtagtatgactagtaaacagatgaaatctgaatttgaactgaggcaatctgttcatgaacacaaaaacatagcaatgcctaatgatactcctagaaggcttctctgagcctgaccaagcctggaaaccctgtgagcccacatcagctcttatttcctccacaattgtcttaaccacactatgataattgtccatttacttatttcattccttagaaacacacagaagctgcctctcattcaacctgtatcccctgacatacagtaggtcttctgtgattatttgagggagatatgaataaatttgaatggagcctgagtcaagcaccatccatgaagaaaacacatgctaatccaattagtgatataaactccaggctgaaactaaaccgattaagagaacaaagtttttcagcactttagaaatgcctgctaacataaaaatcatacatcaattaccaatctttctcatttttcatgaaagaagctgccctccaaagacctccaactgctaaagctttccaagatgagtatgtgtctagagatagcaaatttgactttttaaaaaatcagtaattccaactcttagcacatccaaattgcctgtgtttggataatggagtcagatatggaggagagtttggttaatcgagtagaaagctaaggtttaaagctttgaggccaagtggggaattggaacagacagaaggacaattaggcacctgagatgtggtaggtataaccaacactaaccccaccaccgagaacatgggtctcagccttcaattgggaaatgggtctcagccttcataggctcagaggtgaggggttgccaaactccttctcctcaggctgagatgggttctacaacctgaatctgcaactggcagcaaggaaaatgaggtggcttcctggattgacctggtcctcttcttttaacagcctcaggttctgaatgagagggtttctggtcactagttaattcacagagctgatgattagccagacttataggtttagatagacttcattgtgtgaccagactcactaagacatctgacctctcgattgtcatcaatcttggtcagttaggaatttggttccattattatcaacattcacactttttctggtaaagcaacagtatccttctcttttccatccaaagctagtcattctcttttcatcctttattctgatttttgcttttctttgagcttcctaccttgttgcaattagctagaaggaaactacaagctgaaagattacagtctaccctgctaccagaaggatacctaaaaatcccattgcactgatgctaaagtccagacgttgttgctggcctactggtcctgaatgatctggcctggccctgtttaatccagtagccacatgagtctactgagcacttgaaattcagcactggttagtctgtatttacatgtgttgcaagtcaaaaatgcaccacggatttcaaaggtaatgaggtttttctcacaataattattgatattaatcacattaaaatgtcgaaattttagatcaaacaaaacacattattaattttaatttcacctgtttattaaaaaaagttttaatgtggctattagtgggccaagcgca
